United States Patent 11,001,841 (CCCTC-BINDING FACTOR (CTCF) RNA INTERACTOME) - sequence listing, part 26

SEQ ID NO: 64171 - DNA, 1014 bp, Homo sapiens
tggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcattctctcggctcggctctcacgtctaggaagggagggtgccctggtcccggcccgcccaggagccttggggtcccgccgccgggcttgggaaggtgggacagcggcgcgtgcaggtgctggccctactctgagcgggctgagctgtcacgagctctgttctctgtgtggggcgcgcagaacacgtgtcctgggtgcgaatcagggcttcgcggagacgcccgaggtcaccgcctggcgtggcggccggcggggggtgggtagggggagccctagtgggttggcgagcctggactctcgggttgcgcaacggagtcctagatttatagggttgctca

SEQ ID NO: 64172 - DNA, 1069 bp, Homo sapiens
tgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttcca

SEQ ID NO: 64173 - DNA, 1993 bp, Homo sapiens
gtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtct

SEQ ID NO: 64174 - DNA, 1035 bp, Homo sapiens
ctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcg

SEQ ID NO: 64175 - DNA, 1178 bp, Homo sapiens
gattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggtt

SEQ ID NO: 64176 - DNA, 1001 bp, Homo sapiens
tgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctgaagaatttgcatttttaactgctattgtctgaagtcaagcttagtctatccgggaataagaaaactacttgcagatgagggaagttaacaggtcactcacattcatgctgggccacacaatgacgatacaatacaaacctaagcagctgacaacagactcatttgttcgtatgtctattcaccctgctgtagcagtcctcaacctttttggcaccagggactgcattcatggaagaccatttttccacagaccagggttggggtgggaatagtttcgggatgaaatttttccacctcagatcatcaggcattagttagattctcataaggtgcatgcaacctagatccctcgta

SEQ ID NO: 64177 - DNA, 1088 bp, Homo sapiens
tttattaaatatgggggtgtaccttagttttgacacttttcttttgctgtatgaaaatttgtgcctgacttaagtctaaaatcaaacatttccctttttcctcctttttttctcctcatttctacatttattctgtgtatgtgtttagaaggaataaattcttgaatactggacctcagggaactttagagatcagctagtcaagttcattattttacaaaataagacttgagcgtttaggataatttataaaatacatacaataaactacatgtatttaatgtacagtttaatatgttttggcatatatacacacccataaaagttatgaatttttataaatggaatcatataatatgtgctttttttgtctggcttctttcattcagtctaattaccttggtatttattcatgttgtagcatgtatcaatagttcatgcctttttattgctgagtaatgtctgttatgtggataccatagcttgtttattcacctattgagggaaattagattattttccatatttatctattacaaaataaaggtactagatacattcatggacaagtcattttatggatgtattttggtttttttcttgggtgaatacctagacatggaatggctagatcatatggtatgtgtgtgtttaactttttaaaaagctgccagctattttccaaagcagtcttgtgccattttacacccccactagcagcatatgagattgcattgaataaatatatcaatttagggagagtgaatttcttactagtgcatcttcctatccacatacgctgtatatttctccacttatttaggtcttctttaatttctgtcaccaatttttttagttttcagtgttgcatatctttgacatctatccccaagtatttcatagttttatgctattttaaatggtatttaaaatttcaatttatgattgatactagtatatggaaatacaatagatatttgtatatcaaccttgtatcctgcgcccttattaaactcatgtatcagttctggtagtatttttgtagattccataggctcttcttgaatgtccgaatatcatttttcaaa

SEQ ID NO: 64178 - DNA, 1582 bp, Homo sapiens
actcactgcctgaaaaaagcaagccttttcatactcagatggctctaatcactatgaagtttttcctattgcttcattttcctcagagtagccaaaatctttcttgaggcagcacggcacagactctagcagcaagttgcctgtgttcaaatcctggctccactcctgtgtgatttttttgacaaatcaaactgtttcctcagtttcctcatcttctaacagaggttgataactgtagtatatgctttataggatttttgagagaattaaaagacataagatgctcagaacagtgcttgacacataataatttgtctataagagttaactgtcattattattgttactatattctatttattgttttcaatggctgtgccctctggaattcctccaaacaaatctgttctcttttccagcctttcaaatatttgaaaacagtcatcaaattctcactgaaccttctgttctcaaggataaacacccccagttcctttggcctttgtttatgtgggtctcgtctacatactggaggctttcccagatggtcttttctctgtcagtatgtgtgcctttcagagtatgaggcatagaaccaaatattccaatctacaggtgatctaacaggaacaaacagcacaagactctccttccttctggtcactgtgctgctaagaaggtagcaaaaagttaagagaactttgtactggttccactggctatttctgtatctcccattcttttatctctctccacaatgctcttctttgtagtcctctgcttctcacttttaaagtccagccttcagaatattctttcactctgtacagattcagttatattctctgctactgagaaactcagatacattagacccatatccatctaggtttttattcagttttcccattccaattcagtgacttccctcttttccctgttactaacgtataacacttaatctattaccacataaaagatttgtcttttataatgcttcttagacctaattatctctcagatgaattgctgaaataagatcctaaccagttttcctctttctagactgtccctcatactgcactcccaatttatcttcctgaagtaccatatcagttggagttcacttccccttgattatacactgattgtagtttgcttgtcaggacacgttcaaacttaatattttgacatttaaggatgagattatctccactttatctaatcaatctttttcctcagttttccatacccaagtatcatgccagcttcctggttacatatacacagacataaacacacatgattttgctttttacctctacaactttgtttatgcacctagaatgtcttctattaaaatcctattgtttttctatctcatcatttcaacaagtttgagatatattcatctcttccttctttacttagcacttactatatttaatatacatttgacatttatttttacattcaaatcaaaattttaagtactatctaaatatcttacatacagtgctataagcacaacagggaatggaaaacatattagtgatagctcctatccttaagaagtttatag

SEQ ID NO: 64179 - DNA, 1056 bp, Homo sapiens
ctaattttttgtacttttagtagagatggggtttcaccgtgttagccaggatggtctcaatctcctgacctcatgatctgcccacctcggcctcccaaagtgctgggattacaagcatgagccaccgtgcctggccgcatgactcattcttgagtctcagtatttttttccctgccttttcaaatagtaagcaattaataaacgtgttacaactattattttcatttacaatattcaaatgtataataatattttaaaatatgtaatctacctcattttctgatacccctagttccatcaatacattccagaacctaaagtcacaattttatggccctgtgtctttgtctctctccctatattcttcatttctttctaaatattttctgattttgcttgttcttactctgatatgcacttaatagatttcatggcttacttcttccccagtcttccatcctatgtcttgtgctgaaaggaagtctttcatgtctctaatctttctctgatttcaagttcttcatccaagaacattataccttcaccttactggcctcggtcatttcattatgcctcactccatggctccccaaagcttgtgaaagcaatctcctctgcttgccccaagtatcttctacattagattgtaaactggatgggggagaggtacaacctgtaaaggtacaacctttgggccactggtttcacctcatattaaacgagttttttgataaagctcaaaatggccttctgggaaaagtccaaccaccttttgttaggatttattttaaagtaattttcttgctttagtttagaagttttggtacaaaatagaacttaaagatatttaagaaagtacttgtttgagttgtagaatctcatgcggttgttggagtcaaatgaatcctgtggttaagaaattctttaagaaattaaagtgaaagaattgttaatactgatctctaaaatttatttcttaactctgagaaagtcaccttacccatcaacagcataatgcctaattaatcttacagggtgattttgtgtgttaaatga

SEQ ID NO: 64180 - DNA, 1040 bp, Homo sapiens
tcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccaggtacacctctattaaacagcctttgtatttcctgttgtctcagcctggaatgatcttccccctagacatctatatgactcatttctgcacctttcagttcttaaatgtcaacttctctgtaaggccttccctgtaacccctcagcgttccttctcccctgtttcatcttctccattacacttattttcatctaacctaatctgtatctgtattttatttgcctgtctctcctacctatcatgtaacttgcttgagggcagggattttgttttatacacactgtggctagtgcctagagcagtgcacatagtaccaataacatccacataatggtactcaataaatacttgtttcaggaatcctatgatgagaatagttacagtgtgatacactttgctatttctgtactgaccttatatggattattccataatttcttctgtactatgcagttccaaaggactacccgtttcctcagctctgaagatctattttgtaagcctgttaaattcctgttactttttaattctgtttattctctacctcatgtacagtcttttagtacaaagaaccttgtatatttgcatctccagatagattttaccttcccaaaatttaatcaactttctgattattagagatggttctaa

SEQ ID NO: 64181 - DNA, 1064 bp, Homo sapiens
ataaaccctgtctattgtatgaagttttgccctttagcataaagatacaggtattagataaaatgtaccctataaaaccatccacaaactaagcttactgtgtgatacagaggtcttccttttatttatttagcacaggatatttctgactggatttgattcttaaaaccaatttccatgggtcagaattggcatttcagacgtgcagtgatctccgagaactgtagaattaaacctatacaggacgaagcttggcagctagaaaacagagctggaaactggcacggctgaattattttcaccgaagactttgtttcctaaggctagttgcttaactttcgatggcctcattttatttagctgttagttgagtgtgatatccccactggtgctcagagagagttgttagtaatgataaaagggaactgcaatacttaagcatgtcttcgaactgatttaaattaatgttgatagcatgatattgaattatcttctagaagtgatacatttttatgtttaaatcctttagctctctaaattaaaattactctgctaggggaggacagtagagctatatataaagtgtctcaaatcatttgttttacttgatgtagccccaaattatctgaacaaaaattttcaagaggtttgttagtatcattgtttgaacaaggactgaaccaagagcaagatgtttttcatgctttatatacgtctgaggcaacagtcaaaaaattttgataaatgacactagctaaccttttttttttttttgagactgagtctcactctgtcgcccaggctggagtgcaatggcgtgatcttggctcactacaaccttcacctcccgtgttcaagcaatgctcctgcctcagcctcctgagtagctgggattacaggtgtacgccaccacgcccggctaatttttgtatttttagtagagacggggtttcaccatgttggtcaggctggactcgaactcctgacctcgtgatctgcctgccttggcctcccaaagtgctgggattacaggtgtgagccactgccctggccaaccttttttt

SEQ ID NO: 64182 - DNA, 1054 bp, Homo sapiens
ttaggtttttcaagccacaagtctttttatatatttttaaaaattaaaactaaggtacacatctataaataaagtaattcaacaaaaaattatttagctgatgtaaatatattgtgagccagtatgtcatagtggataagaatgtaagtactagaatctgaaaaacaaattcagagttcactttcaccacttacagctgtgtaactttagataaatcacctagctcagtttccctgtctatgggaaataggtaggggtgtaatattgtctacctcttaggattgttgtaagaagtaattgacataatatacggaaaacagtttggagcctgacatgtggtaagcagtcaggaaatgttcttaggaaaattatagaaggtagacaaacttcctcttaaatacaattacttgaatgcgtgtgtgtgtgtgtgtgtgtgtgtgtacacatgcacatgtgctttagtggtttttgacttggtaaaattataagaattagaggttcatcaccctcccaataatatataagtgaatcctgttttctcatttagctatgtgaatctgaaaacagagtcatttaaattctaccttagactcatgtaggtctactcaactctcacttaaaggtatccctagtttttctttatgtttttgaagaatgagtatattgccgtttttgtataatatgtaaaagtaacttttctgtatatttgacagaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtgtaaggcttgctctttttgtttttcgtttttccccttgttgtatgtatgccccatatgtcatggctgtgtaagatataaccagaggtgttgattggtaagacttaatgttttcagttagcattaacaaatacttattgagtatctattata

SEQ ID NO: 64183 - DNA, 1043 bp, Homo sapiens
agcttttgaaattattccttcagttatttgtctcggcgttacaaaatgtggatttacgattgttattgaaatcgatccctatgccccttattaaaggtagtgtaccttttatattctgacactgtcctatttagcggtgccagctaattcagttcttgcctctggcatatatataaagctgctggaacactttcaattgtttataattcttacatcttcagcacgaatttattcgttttcactcccttctgcccattcttcttgctataaaatgacctctacccattcagaattttgtctgggggcatgagctgccaccggccgacgatcctaaattagtcacctccatgtcgaagtcacccgtctgagaagtgatgctttctgaattcagagctcaaaaatagtatggatttttatccttttctttcacattgcctgacttcagtttctagaactttttctcaagaatatgactatatgtttcaaaaattaatatttgtcatttggtgtaaatgaactttatattcgatgtgtgtagcctgatccttcttggttcccatctaaatacaaacacgctttccttcccaaaaaggcaagggaggtccagagagaattcttacaagtctaatatgctttttccaatatgaaatgcatttagtaaacacactgttactgtgagaaatccatattcttaatctcctagtacggcactctatccttttgtagtttctctctccttctctctctaatatatatgtatgtatctttttctgatcaagatctttgattctggaacaggcattctggactctatagtgactctggcctaattatttcactatgtatctatattaacttgtcttgaaaaaaaaaagttgatatctgtttacagatctacagtttgagtaaacaatgagtaataaagtaaataatatccttagggacccagtcagtagtacttggtatttattactgatgttaaagttgacttgacagtgaaaatcattgatgtttatttcaattaaatccttttaggtgaggtt

SEQ ID NO: 64184 - DNA, 1069 bp, Homo sapiens
tctcaaggggaaaaaaaaatagatagggtctggctgcactggttcacacctgtaatctcagcactttgggagggtgaggtagaaggattgcttgagcccaggaatttgagactagcctttgcaacaaagggagacccccatctctacagaaaatcagccgcacatggtagtgcttgtggtcgcacctacacaagaggctaggcaggaagatcacttgagcctaggcatttgaggctgcagtgagccatgttcatgccacggcactccagcctgggcaacagagccaagaccctgtctcaagaaaaaaaaagtctggatagtagattataatataatctttttgccctatactatttttctttccaaaatgtcattcatgtagcaaatttttactgagtaccaactatgtggcaggcagtgttctaaaccctgagaatgtagcaattaaccaaagagacaaaagttcctgccctcatggagtccagttttcagtgggcaagataaatagtaaagtatgtatgatgtgtaagctaccagtaagagccaaggagaagaataaagcagaaaaagggtatgagaagcatcaggaattgcttagaaaggatgaccaaggaaactcatcagagatagtgacatttgtgtgaagacctaaaaaacaactagcagccatgcagatatataggagaagaccactcctagagagagagcatagaaggtacaaaggtccagaggaaagagagtgcctggtaagtttaaggaagagtaaggaggccattgtttctggaatagagagagaaagagttggggggaaagtagtaagaaatggggtcaaagctataaccagggactgactaatcacgtagggcatcacagattattgtaaggactttagtttttacatcgacagagatgggaagccattggagggccttgggcagcagagtgacgtgatctgacctatatttaaaaggttcgtttgagctttggggttgagactagagtggggctcaaggggagggggtcaaggacagaagtagggagagcagggagaaggcatctgcagacaggc

SEQ ID NO: 64185 - DNA, 1178 bp, Homo sapiens
gataaatttggattgccatgcaaaaaaaaaaagaaagaaagaaaagaaagaaaaccactgttgtaatatagtttgtaaacctcttcagtaatcagctattgtgggaagatgattgatctctgtcaaactaaactgcagattttccttcttcatgtatgtatgtttcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggtaatctctttttgtccttttaaacaaaactgatactctacattctcgtttgaatcttttttaagagcacttgtttctataggaaaagcgtcatcaagatcgtgctctggccatctacaaacaagtactcagaaatgatgcaaagaatctgtatgctgccaatggcataggtgattataagacttgagtacccataacaatttgtttcaaatgaatactttcagaggaatgtttgtaaatcagaatttttcttaaaatgtgatcaatgtagttgttttaaaatagaatttttagttgtttttctgactccaattagaaaattgttaagtgtgaacctttttatatctttaggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatggtaatagcttctctttcaagatatttttatatcttgttcattgttaagcagatgttttcttagccattctggccctgtcatggagctgcatgctatctcttgtgatactgtgtctatttagagatttataattatataatgctaaggccaggctttggtatccagacagagatgtgagtcctggttccaccactaattacatgcctcaggcaaaggacatcctttctgagccagttttcctatctataaaatggagataattgtaccttaacttcatagaattttgtgaggatcccgtatgaaaactacttggcactagcatgc

SEQ ID NO: 64186 - DNA, 1071 bp, Homo sapiens
acagggaaatgtcctttgaaacccttttctgcctttggaaaagggttaattcttcaaagtcttcaagccagttgagatcctggatttcacctttgttgctgttaatttgtgtacagagataaacaaatgtatcccttccttttcataattttatatatgaaattgggaaatgcttcattctgatgaaaagtgtccagtgagtcaccatccctgtttatattttgacttatagctaaagtgccttatctttttttcctttttaaacctttttgagttgtgaaatatatcacatttacagaatagtacacaaaacaagtatcacagaatgatacctgtgtaaccactatttaggtcaagaaatagaatattaaatgcccttctgttttaaaagcacattgtctgctcatcaaggccccagttagccagaatcctcagcttctaaccaatgatcatctttgccagacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttga

SEQ ID NO: 64187 - DNA, 12463 bp, Homo sapiens
ccaagaaaagcaatgctcactcgccacgcacagggttcgggggaggtaagggtgcgttttcttcccatattcccggtgagaaaacgaggtcgagggaaaaggggatgatacaactggagcatggcatatggactcagtgaacaaagggactggagcaagaagcagcagccacgccaacgcagactcaaaagggctctccggctttacgcacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtgagttgagccgctgccgccgccgagtggagcgctctaaaatggccgccgtccctggtcgcttcttctcgagtggtacaaaatggcggccgcaggcggagccgggtggggcgacccttttttagcatttcctctgcgcttcagatacctggaaagtcttggcttttgttctctcttcctgttgctgacggagtagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcgggaccagggaaccgcaggcgtcccggagcctggcctcccggcggggaggtgtgtaggacctggagtcggcaggggctgcccttcgtcggggaggaaagagagagtgatgatttctgccccttttgtcagcagaggaggccgtggcgaggcggttgtcagtcccggggggatttatggtgcaggagggggcccgcttggaggcggcgggtgggcaggaggccgccttcctgcttggagaacaaagagctgggcgccgggctggcgggggtggcctcagctgctcctccccgtcgagcgacccgggcctcgcggggaggttgtcggaagcacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtggctaaacaaaatgtaattgtcagtgttttgagtacattttaggttagtcttacagatctgcaatgcagtgacagtgccaggatctgaaatacgttgtaattgaatgaaggcttatagatctgtatgttagcagtgtctaattttggtgctctttctcgttccaggtatttcatttctcctgtcccctcccctccccaccccatctattaatattattcttttgaagattcttcgttgtcaagccgccaaagtggagagtgcgattgcagaagggggtgcttctcgtttcaggtacttgtagatttattttggggaatccttttgaaaaggccagtctcaaaaagtagttaacacagcaaataagtccgacttaatgggctgcaattttcatttgaaaagttcttaagttttcattgacagccttctaagaactgccatctgaagaataaataaaatcaattatttgcctttcctttgggtccgagttcagtcttcatttgtagcataatatacaagcactaaaatacaggcctggctccagtctgggcaaaatagcgagacccccatctctacaagcaaagcaaaacacaaaatagatgcttattctttttgagtgagacatagttgggatacagtaaacaatttttttcttttaaatagtgcttcttcgggcggaggaggaagtaggggtgcacctcagcactatcccaagactgctggcaacaggtgtggtaaacatgtaaaaaaacagtgagctttatttaacagattaaaagtctttcccatgtgacggtataattaaggcaatagccatcaagactcctaatcttaaggggcgtggtttctgttgggtatcctaaatacagaatatcagttcctgattattccttagccaaattttctaagtgagttgagactctcaagctgttatttttttccttattctttgggttatttttactaatgtgtttttctgaaatcagtagctattattcctactgattgttattagtaaagtagtacgcactcaacatggtcaataaaacattagaaagtgtttattggcagccggtacagtggctcacacctgtaatcccaacaacaactttgggaggcaaaggtgggagggtcgcttgaacccaagagtttgagatcagcctgggcaagacagcaagaccccatctcttaaaaaaaatgttaattttcaaaatgtggttccacagcgttgatactgggaatatttactagacatgcaaattcttaggccccaccccaaaccagtgaaagcagaaactgggtgggcccagcaatctgtattaacaagcccttcaggtgattctgatgcacactactgttccagaagcactaatttccagagttggctttcttggaggggaagtcgagaaagcctaaattacttttttctatgtaagagaatttatgatgtttaacatttggtgtgtgacaataagtgtttttgctgatttttattaatcagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagagggtaagtttcaaggtctgttttactaaaagatgggaagtgtggattagctgtgtttggtgtgtgtgctgtattactaagaaggcaaggttcatgcccagagtatgtatgttttaatgaatcctcatggtagcaatttttaaaaatatcttgaactggccaggcactgtggctcacgcctgtaatcccagcactttgggaggccgaggtgggcagatcacttgaggtcaggagtttgagaccagcctggccaacatgttgaaaccccatctctactaaaaatacaaaaattagccggacgtagtggcaggcgcctgtagtcccagctactagagaggctgaggcaggagaatcacttgaataccccacaggtggaggttgcagtgagccgagatcacgccactgcactccagcctgggtgcagagcaagactgtgtctcaaaaaaaaaaaatgtatcttgaactgaagaacagcacgtcatattttggggcttcccgttgctttcagccattggattgcaatccataatcctgtcatgctagcatttcccttgactaagggaagtgctatgttatttaagccagtgaggcagggaatataatggtcttagttcatggtctagccttgataatgagatctttgcgctctaaccttgagaaagtgagaaaggattcttgtcaaacagctggggaccccccagtccaattcaaatcattgtaattaaaataacaggtttatttcagcatccctttggttttagatgagtaagaaaacatgtcttgattttttaaagggagcaagttagaagaaaaatcagtataatttaaaagcagtttttcaattcaaattctgtgtattagctaacacttaaaatgtaattcctttttctccagcatactaaataagcttactcctgaaaagtttgacaagctatgccttgagctcctcaatgtgggtgtagagtctaaactcatccttaaaggggtcatactgctggtaagttttaaatattggcttaactcaaaagggagagggaactgtttaacaaactcaagttgtgtttttttacacttggattactacttaaaacccttaggtgtgagttagataggtatgtatttttgaatactgatggtgattaaaaagaaccactgactttagtagcattagattgaagaggtaaatgttaagttcatggtatggttgaagaggtaaatgggagtgcttagcaagctgttctttttcttttgtggaaaacaccgtatttaggtcttggaaatgcattgtatgacagtttatgtagacttgaaagttttgatatccatggcattttctgactcccaggagatggatgtgactagatgaaatctgtataactggacatttttggtagactgtaatagctaacatttaggtggttgtatttttcctaaaggaagggttcttggagaagttttcatatttagtttaagcaatgacattttctgtagattgtggacaaagccctagaagagccaaagtatagctcactgtatgctcagctatgtctgcgattggcagaagatgcaccaaactttgatggcccagcagcagagggtcaaccaggacagaagcaaagcaccgtaagtggtagtttttgtttgcttgttttaaagttgacttgaaaaatttccttaataaagcatgacaatgtcttcttttccagacattcagacgcctcctaatttccaaattacaagatgaatttgaaaaccgaactagaaatgttgatggtaagacttatagctgataataagtactactgtatattttcagcttaattctgaatgttggcttacttcattggtatctttttcagtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacagtaagtgtgacagggaagttaggcgaatgtagtcagtcgtttggaggaaatgagtcaattattcatctaagagggaggttgactagttaaatacagatgtgcaacaaaatttactaaacagaataatttgaaatacgtggtgtgtttgacaaagtagagttagaactgatcaaccagactggtagaaagccctatactagattctgtaggaactgtgaatgagtcagtgcaaacataaagggaaagaaagtactacgcctaaaccagagtaactaaaactttgtcaccatggccttttattcttgtagcttttggaaaagaagaagagagtccaactcaaagatatgggagaggatttggagtgcctctgtcagataatgaggacagtgggacctagattagaccatgaacgagccaaggtacgtgtgtagctgatgaaagtagtacaagtagtttgtctttaaatcaagctattgatttttgtgacatcataagggattgccatatttagccattaactgggttataattttagaagtcttaaagctgtaaattgaacacatttgctttagctcttccaatgaatgtattcttctcttatcagtccttaatggatcagtactttgcccgaatgtgctccttgatgttaagtaaggaattgccagcaaggattcgtttcctgctgcaggtaatactggtttctttaaatttgttggtaagctgagtttttggtttaggaatattaaaataaaattatttttcaattaaaggataccgtagagttgcgagaacaccattgggttcctcgcaaggcttttcttgacaatggaccaaagacgatcaatcaaattcgtcaagatgcagtaaaagtaagattgggttttgttttgtttgtcacatagactctgtgtgtgtagaatagaatgggtttcctcctcacccaccccaaacgcttgaggggtctgtctcatcttagtggtggagcttaatgtttttagtgtctcgtcttccacttttatttttttattttttgagacggagtttcgcactgtcacccaggctggagtgcagtggcgcattctcgattcactgcagcctctgcctcccaggttcaagtgattctcctgcttcagcctccccagtagctgggactataggcgtgcgccaccacaccccgctaattttttgtatttttagtagagacagggttccaccatgttggccaggcttgtcttgaactcctgacctcatgcaaaccaaggcttgggcctcccaaagtcgggggattacagatgtgagccatcatgcccagccttgtctgccatttttggaagaagttatttacagaaataacataaattatggtttaatattctaggtttccccccctagttgcaagaattttagttttaagtgaaatagtgtccagagacaaaaagtgcatattcacttcatttctaaaggatctaggggtgtttattcctgctcctatggctcaagggatgagaagtgacttctttctggagggaccgttcatgccacccaggatgaaaatggatagggacccacttggaggacttgctgatatgtttggacaaatgccaggtaattttgaaaaaacaatggttgcgttaagctgaaaaatcagttaactttagttttgagagttgtccgtatatgtattttaaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggtaagtaatatttgagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgaggtacatttgcctatgttacttatataccatagtttgtccattcagaaatttattgcccgatgattataaaaagacgcgttattaagaggactttatgctggagttcttgacgtttttctctcttttctatacttctttttctttctttgaatgtccagcgtcctgtgagcgaagattatgagatatgagggcaagtctcctaaagtctgttagagcaagaaaactggttgtcaaaatattgtggtttctttctttgtaagggtgatttaactaaggataaaacagggcattttctaaactgtagttaaatttgcagttttttatttgaatattttagtcatgctaattctaagagaatgtaagatttataatagtatcttactactgtatgcatcagatctttaaattttttgccaaaaattaaacctgttaatgtggagtaccttctttagtttttcaaaaagcttaatgtttccctagattctgtcactgtataggattttagaatgttgtatttaatatgttcgccaactgcatgttgttaatttagatatattttgttttcaattccagattagcctgaggcctgctcagtcgttcctaatgaataaaaatcaagtgccaaagcttcagccccagataactatgattcctcctagtgcacaaccaccacgcactcaaacaccacctctgggacaggtacagaccatagtaggacagcattttctaaagatatctgaagacttttttctaaatttagtgtgttcttccccctaatttcatagtcctctttttaaaaaaagtctgtcattgcttgttttttagacacctcagcttggtctcaaaactaatccaccgcttatccaggaaaagcctgccaagaccagcaaaaagccaccaccgtcaaaggaagaactccttaaactaactgtaagtttcaaatatcccattttagtgtaattagcctgtatttgagatagagaatacattaaagatacttgtgttcttcacaggaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggtaggacactttactgattgtgtggtaagaactcttaccactcaaattcgaaaactgataaactgttgtatatttctttcaaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccaggtaagagaatgctgacttgtttgttttgtttttttaatattatatctagagatttcaggtaccttgagtggatttatgtaggtcagacagtctgattgtcctgctcagataatgataaacattaccacagatctcacctataaagagagatttataatttaactactttcatttgatccgtatgttgagtttttttcatttgctgggttggttctctattctgctacatggatcttacatacttggggacatcatttgtgaagctctgctctctggacaggacaacttggtaaaatgaactattagatgatgcaggtggctttgtctcttcagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactaggtaagacgaatggttttctgcatatggtaatgtttcatgtactggaaaagaagcgtaggagactaagagttgtctcttgagcaagaaaactcactgttgggttctaacaagacctctttctgtccagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggtgagaggacttgtatcagaagaacggcgtgaggaagttcttaaacagaacactaaataatgggcttattacttttttctttttttttttttttttaaggcatgttacttcgcttttttgtgcacttctatgacatggaaattattgaagaagaagctttcttggcttggaaagaagatataacccaagagtttccgggaaaaggcaaggctttgttccaggtaagtcttttgttaaaaatttggtctgcttacttcagtttgcttggtattaacttcaagttaagagcctttttcaactgaaatacaggcaaggtagtcctagttagtagtttgtcttcacctgtacatttcattctgcactatttgaagctattattaagtaaagctacacaatgaatcaattctagtggtgtataagatgttagaggtagctaacttttcaaggagtatagctacttatatacatgggagtgactgtacaagtttcgatttaagcttttttaaaaacatcagtaaagaggaaattgtagctgggcacgtggctcatgcctgtaatcctagcactttaagaggctgaggtgggaggatcacttgagctcaggagttcaagaccagcctgggcagcatagtgaaaccctgtctctaaaaaatacaaaaaattagccagacgtggtgacatgttctgtggtcctggtcccagctactcgggaggatgtcttgagcccaggaggcagaggttgcagtgagctgagatcacaccactgcactctagtctgggcaacagagtgagactgtgtctcaaaaaaagaaaaaaagtttaaatactatatatttttctaaaaagaggagatgtttctgatttctcacaatttgattttttcttattgaatgaacttgtagccctaggggaagaacatcagggcattctctcaaatcacctgaagagcagtttaaaaagcaggttccaggcctattcctagagattctggtttagtaggtctgtggtacaaaatccaggtgattctttctcatgctactagttttccagggggcccaggcttgagaaacattggtcctgcagcatcttcctacctttttattgctgatgataaacaagattcacgaggatcatccttgcaggattaaatctttagctctgtgttgtcccaaatctggataatataccactgttcgttaacttaatatacaaattgttggtagggatatccttgtttcatattctaaaactgtgtagtaccacctaaaactttttggatggatttctgtttatatcatgaactattttaatttacaaatcttaatttataggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtgatgtgtggctgtaaatggcatccatagtctgggagaattgtcagctttgtttttgaggtataggagacccaccttagtttgacttaaggacttcccaatttttgtttttctg

SEQ ID NO: 64188 - DNA, 1052 bp, Homo sapiens
ggagtgatacacctaggaataggaaagtagtctgaagccagatgataaaggtccttttatgccaaactaagaagttcagatattattgttagaggagagctattgaggtttttgagtagggcacttatatattcattttgtacttcaggaatgaatcagtagaggggataaatgagggtaccctcaaaattgcaagcaatgaagtattagaactgaatttttagggacagcaataccagcctaactggctgcataagagaagactgggtgtttgggagaggcaaaaaataaggccaacagaaaaggtagggtagggacagaatataaagggcttgaaagccaggtaaaagcatataaactgggatgcctgggttctaataactgtttccctacttggagaaactccccttatcttttttaaaccccagtttccttttcctgggatttgcttcagctataaatgttgtaattttctataatgctctgacctgctacagtggctctgaaaccttgactgcacactggaatcacctagagagctttaaaagctactgatggctagatctcactaccaaagattcagatttatctggtcttaggtgcagcctggacactgagatatttaaaagttctccaggtgattctaatgtgcagccaaggttgagatcaactcatgtagaaaatagtgaagcactaagattcttaagcatggtaataatatgttaaaatttagtttagtttttttgttttttttgttttttccaagacggagtcttgctctgtcgcccaggctggagtacaatggcatgatttcaactcactgcaacctccacctcctgggttcaagcgattctcctgcctcagcctcccgagtagctaggattacaggtgcgcaccacaacgtctggccaattttttgtatttttagtagagacagggtttcaccatgttggccagggtggtctataactcctgaccttgtaatctgcctgcctcagcctcccaaagtgctgggattacaggcatgagccaccgcgcctggctgaaaaaag

SEQ ID NO: 64189 - DNA, 1055 bp, Homo sapiens
tttctttgaagtcttgtgtttacttctaaattcaccgaaattggctaatttaaaatatgactaattttcatgtaaaatatagagtaaattgctgtcaactactaattccttagaagatgtatcataatttcttatatatgcaatgctttttatttactagtcccagaattataccctagtttgagaaggatgtgcagttccttaatatctgtgtccagcatatacctcaagcctggtaactagactcctgcgattgctgagttcgagcccttcattagattatttgtccaagatgtcagcctcttaaaatataaaaccattcttgttttccagtccttttcccctaacctccttggagactagattcctgctcttaagtccaagtccattatctgagaccctgctgtctgctactagacctttttaatgctgaccgtacccattttggttcttgatgccagctgttcacctcatctgtaacgtatcaggactaaattatggataccatgcacagctagtgagaatggacttttagtacgtgaaggtgggtctggtggacaacagacaagtcgagttccagatagcaactagttctagattaccctaacctaaatgtagttaccgtgactgaatcccaaagagaagattcttttcctttgtatttaaaccctacctacccttcagaattggcttttttttctctaaataaaaccaaaggaaaccaagtaacaagcactgccagcctccctttcttccatacttccaaagccctttggttacccttctgccactgtaatgtccctgagactgtaataatgaagcactctctggagctggagggaaacctctgacaaaccctttcacataaaagagagaacaactcttagaggaagaaatgaatggcattccatttaataaatggaagagctatttggggactaaattacattctcatggcaccctcaaatgatagctactcttccaactcatgcataaaacagtaaaatgcccctcttgtgtccaacgcaaaaggactttcccacttttaatcccta

SEQ ID NO: 64190 - DNA, 1034 bp, Homo sapiens
agataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggtggggttgaggaccttctttctgaaaacaaaagcttcctactcttctgtgtcctctggcaacgagagggatcctgatcttttacgtgaaccagcagctccacagagttctccgttgcaaaatccaaaaggagactgtggaaggagaatctgcttttttgctcccaataagaagcagggctttatgctgttgctagtatgagaccctcgactttctggcagttataatccattgttcatccgtttcgctgcataacccaactcctagtaacgagattttttagtagttggggaattaaaagtattcaggaacacccaagtaatggctagacacatgggctatgcagtcaaactttttgggctctgaacttggtttttcacttacaagaggtgttagcgagatgtgttaacctgtgtctgtttatctctaaagtggggttattaataatccttgtgtcttcatagatgagataatctatatgagggatttagcagtaattggcatacagtaaacaatcatcagtcattagacattgtttacctgaggagattggtcactggggggctaaaaatgattgtagtgaaagaactgcttcatgtaatagttctatgtataattccattttagattcaagacctagttttagagacattgatgaggttgtacttttaaaaattaggcttagtttcaagttctagaaagtgtggtggtggtgttgttttaacatgtttctatgaagtcagtaggtgggggaacatctcaaagcatctaaattgccaagatattgaacaggatgaaaatgttagaatttttactatgctaggcgtcttctctttcagtccaagatctgcattgcagtaaagaatcattttcact

SEQ ID NO: 64191 - DNA, 1047 bp, Homo sapiens
tcaccttagccactgggggcagcacaaaagcccgtgctttatgaagaggggtcagtcaatgtcgttttgatttacagggtatgtcatttgactatacatttttagtctgcatgttcctcccttgggcatttttcccacaaaaagaatgaaatcagcaaatggtggcaaactggatttagagttgtggctttcaagaggtttacttgtcactccaaagagctgattttacaatatgggtttcttgccaataagtagcagagtcttcttagtcatgtggtgtgaaacaccaggctctggagctggaacttggaagggaattccaggcaggggcaacggcacaagctaaggggtgagaaaagtgaagtggattagtttggggaggagtggctgggccagccgcaggcaggtagtatgagcaaagctctcatttttattttaacagctcccaaggaaagattgctactgtttcaaatgcctgaaactgtaaactgtggatttatattgtcagtcaataatggggctcagacaaggaaaagaagaagaaaaatttaatccattttacattcagttatatctggttactaataataattacacattttcaacgattacaacctcctacaccagttatgttttatgacttcccgtgattatctaaaacatgtttcacaattcttgatgttcgtgtaagaacactaaaggtttacatttcagatgggtaaaaaacaagcctgtcaaagcagtttgacaggaagacagcccttatctctttctatgaagtggcaactgagaaatttgtcacctaagaagagcataatcatgtttagttttactgagaccttatctcaatctgacttgcaagcatatagattctttaactacctagattgtaaacaatttttatcctccagcttctctcattaggcaagaaaagcattttacagcgtaatgcctgaataaacaaaagcacttttaggtccaagtgattttcttccatttgtctttaattaaagctgatttgcttcttaaaaggtgattcatttctca

SEQ ID NO: 64192 - DNA, 1043 bp, Homo sapiens
aggcttctggcccctgagtccacatgtgccttcagagattttagcgagagaggagagggcagagtcagaaaccctgggactctaggtaccctttgctggcctttcataccctggaggctttctgagtgctcttggcttctgcagctccagttttgggctcatggaccactgggcaagggccacaaaatgtggcttctgaattagctccaaggggtggatggaaggtggaagggacaggaccacacctggtttccaggccaaaatcttgcagctgaggcccacagagaagcctattcaccagtcactggttggcagttcttactttaggctcttctgccacaacagttctcagtgaaaatgctgtggttttcagttccattggctcacactttgacaggtgctgggttgttaccaagtctttgaacagccagtcctcctggtctgctgtcttattaatgcatgacgaatgggagctgccatcttgtatgcaatgcagagacccagagtgcgtcctgggcaccatggagatacgatgacgcttttctcaaatgaaacatgacaagtagcacctcaggaactggggttaaaattggttagtaagactagcaagacagattttctgttgttgttaattaggaacaaatgttcgtatgcccctggtttcactcctagtggtattgaaattgtttttgtgaggtgacacagttggttctgtatttgaagatcacatgtctgtgccggatcccttatggaaacagattcagctcagttcctgcctgcgtatctcatacaaacagatgatagagttcactggcttatatattttgtgtatacatctatgtgcatgcatttatctatacaaagtataagtcatggatacaggtccatgtaagtaatgactacagaaaggaaatacatttagccaataatgaagtatgcttctgtcacactgctcaggcttactacttgcttatttttaataatgatgatgatgatgagaaaagaaaaatcgctcaaagcattctgagctatgcaagggtatg

SEQ ID NO: 64193 - DNA, 1049 bp, Homo sapiens
ggggaagcagatattcacatggccttggagtaacacccacacattacttattaattacaaacgaatgaagtacttttacgatggagaaatatggcagatgccaccttaatcaagtgaccacacttagaattaccaataatggggcaaactgacattatgtggcttttgatggagtgcagtgggatgagcacaacatcacttatgtagtatttgccaaacatctttgacctgaatctaataaagagatattaatcagacacattcacattataagatctcctacctcaaatagcgtatcctctaaaaatgtcaatgatttaaaaaacaaaaaagggtatatgtgtgtagagggaatgttccagaccaaaggagaccaaaaagatatataacaagcaaatgcaatgcttgagctcagattggattatgaatcagaaaatgaacaaagagctataaaggacatgattggataattgggaaagtttaaacatggaatgtatattagataataggtctatcaatgttaaatttcttgggtatcatatggtattatggtaatatacaataatgccgtcatacctcaaaagtagagaagctaacagtgcagccttcagtctgtggtcgaaggtagaacttggagtccaatgttcaagggcaggaagcatccagcatgggagaaagatgtaggctgggagactaagccagtgtagtctttccaggttcttctgctgcttttattctgaccacactggcagctgattagatggggcccacccggattgagggtgggtctacctttcccagtccactgactcaaatgttaatctcctttggcaatgccctcacagacacagccaggatcagcactttgcatccttcaatctaatcaagttgacatgaaatattaaccatcacagaggtggagcaggatactcctatagaaagggaatatatatgttttataaggtttgtagaaatatttcacactttaatctttgtgcatataaagcttggatctatgtaagaactaaaaagttagggaaggggaagaa

SEQ ID NO: 64194 - DNA, 1039 bp, Homo sapiens
gcatacctcgcaggacaggtggcaggagaaatttgtgtctgcagttgtatttgtaaacacagcgtggagaatatatcaagaatccagcaagaactgcacaggttctatttgtctgctaaatagaatgaagtaagtgccaatggaaaatggattgaggaaaaggtggaagttttcaagtcacatagaatggcaggaggggtggtaatctgacgtcttgggcaaggatagacctgtatctcagtgtgtatgtctgtagctctggctcagctattgctgtctcatctgtctccctggctggctaagcatcttgaggacaagactgtgttatattcacttttgcatcagcagcatccagcacagggtctggcatggagttggcattgagcaaatgtctgttgactgactaattgaaacccattactcaagataagagtgagacaaaatggctggtgagtagctcattctcctttcatattatgcctaccatgggctaatacttcctccttcagagggttctggcagatctcatggtcattgtgtgtctctttgaatatcagcctccctcaggggccatcaggttggcgataggagtcaccattggagtttgttagttctgaccagctgtggtcaaaggcgtgaacctattacccatggctaagggcctggacaccaaagtctggttgccctagttcaagtcttggcttcatcactttccatgaccttgggcaagccactcgacctctataagcctcagtttcctgatctgtgacgtaggggtgctagcatggggtgtgatgaggctgcgtgagatgatgcatagtgctggcacatagcaacacagctcaatccatgttaggtcttgtactataattcccgaggggctggggtacatgacagacccagccctactccatctgccaggcaggcagtaagcaagtcatggccccatgccacgtcacctttgtttagaagcacaaaggagagcaggagataatgaggcagagaaacgaggcatctactcggaatggcactgggagaa

SEQ ID NO: 64195 - DNA, 1045 bp, Homo sapiens
gaaatgttgcctgttaattttccttgttataggttggttttgatgttgatgactggtattacttctctaggatataactttggaaacagcattggtgagggcattccatgtaaaacatcaacttcagcttttctgttgtagggtattttccgtgcttgactactgatggtcttgcaaagctcctgtattcaaatcctaggctgagctccagagtgcttcctcctagatcgaggctttggatatgctcactgctcattagcaacctgcagaaaagctgggatgcagtcttcactgatttggtgtgtaacggattccttgaagggaagcctgctttgctgatggggtcagcatacgtggcgtactgacatgggaatcatggcatttccagccagtgctcaactctgtggaatgcttcccctttcagcccaagtctcaaattgcctccaagtttcctcatttctgagaaagtgagccagtgaaggttgatattcaaatatataaacagctaatgtggcatttggcagtgtccaatcagaaccagtcatatagtgctagagcaaattgctgtgccaggcagtaactgttttgtggctggctcttggggaaggtttggatactgggggaggggtcaggataatgggtgctggaagcatctctcaagtaacttgggaaagcagctttttctaaaatgggaggaaatttgagtttatttatttatttatttatttatttggagatggggtttcactcttgttccccaggctggagtgctttgacacgatctcggctcactgcaccctccgcctcctgggttcaagtgattctcctgcctcagcctcctgagtagctgggattacagacgcccgccaccacacctggcttttttttgtgtgtgtgtgtgtgtgtttttagtagagatggtgtttaaccatgttggccaggctggtctcaaactcctgacctcaggtgatctgcccgcctcggcgtcccaaagggctgtgattacaggcatgagctaccaagcccggcctatttcagtatttta

SEQ ID NO: 64196 - DNA, 1029 bp, Homo sapiens
ctaagggctgggactggcagcgcgccctctccgggagcttcaggtctggggcagcctgtgcaggcgcgggtggaggcccgggcgcgtccctgggggcgggagccaggggcggccagcaggtggggcctgggagctggactccgccccccgctccctccccgttggtccgctgccgctcagcaccggcccctctcccgagccggagcgcgattggtggcagcgcttgtcgctcggagggggccgggccgctctgcttcgcggctctccccgccgccgctgccgctgccgctgttctcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaaggtacgggcgccccggaaacttgggtcgcccatgaggcccgggagtgccccgcgcggcgcggggtgcgctggggctggtgcgcatcaactcagcca

SEQ ID NO: 64197 - DNA, 1005 bp, Homo sapiens
ccatttttccattgattgcagcgggctgggggaggggccgacgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggtgaggggccccagaggaggttaggccttaggcctgcggccgctcgaggcaacacaggcccgggccggggttcggctgcgggcccggccggggtgcaggctcggctgtgggggaatgaggaggcgtgaggcagtcgggggtggacggtgggtgcggcgagcagttgggagacccgctggctctaggggccggggagcggacctcccgcctcgggttttatggggctggacgaataaaggagcggacgggaaagaatcaggttctgctctaggggagaaggtggccttttaagttcttgtttaacgtgtggagccgggagagatcatttcaaagaaaacattctggaacagttgcctatgggcacggcagggtgacggtgctgcttctgggtttgacagtggcagcgtatagctttcagcgcttgtgaaatctacacccaagtgagatctgtgggagggcagacttaactgttacgacttttttcaactcctgttacttggtagtactattggcctgcctaaatggggcctaccgaagatcgtggaaaagtagtacatgggacattaatgtaaaggaaggagataggagaacattaccacatggagagctgaactctttttttttttttttttttttgaggttgggttgtgtatgccaatttgagtgacttcttaaattcttaaaagcaagtgatacgagaagccttgact

SEQ ID NO: 64198 - DNA, 1039 bp, Homo sapiens
ctttcctggagcagatattcagtaaatattcgttgatgtggtgacagagttgtaagtaaatttagcattctaaccaattatcctgtccttggaggttttccacagcatcattggcaagctatttgccaacttttgctttaatacatacttctatgactaatctttgataaaatctttgtcttagaagagatctgttatttttaagtttttgagttgagagaagtctagatctctatagctgccatcttttgatagttgccttacagaaatgttaaagcatttcccataggatagtttttctcatcattgaagatgggagagggtagcctgagaactgaccttttctgttctgagtctgagcttcctcagttctttaactgtttcttagttcctctcttttggacataatctggggtttttagtattcctcctaaattgttgtacccagaaagagcaaagagagtggtatctcttcattgtggtgaagaacagagcttttcacccgtttcattctgccgtatgtctttgaattgtagtatattgatttctgctttgaggtctcttttaatagcatcccaattttaattattgtttggttgctattttgttattctgttttcttataaggatgtgtgtcattaatattcattgagtactcactgtgcatattactgtattctgccaaataggaaaaacttagaatagaaaaatttgttcttctctcaagtgtcttatagaatgatcaaggataaggtgcatatttactgatgctttaaaaataatacttaaactgcagtacttaaagtagtgctcatggactctaaatccagagaaaatggaaaaaatgaaggaaaaagagtagaaatgtaaattctttatctctgggtttttttctcctgtctttcatgcaatcactacttctgtctggaactggttttggcatctaatgatgatgatgatagtaataaccagtatttattgagcatttatttatataccagatactgttggttgtgctttgtattaactcatttgagct

SEQ ID NO: 64199 - DNA, 1465 bp, Homo sapiens
tattcttttaattttatttctcctaattaaattacctgaggaaatgtgctgcaattgtcattcttgattttagtgattcttttaaaatgaggctttttcttaaatttcagatgttgactctctcttaccagtaagagacaagtttgtcaagttatacccgccagcgttttaaacaaattggagtgtttaataaaagtcagtattttagatatcattggaaatgctcatttaatgaatgaaagcaaaagctgaatgcagaattgtatatgattctaattttgtccaggaaaaaatgaacaatttagggttaaatgcgttgaaagattagaaggaatacactaaaatattaagagttgctatttctgaatttctggattattgggatatatatttagactttcatatttaaaaatgagcatgtacattattttcaaaaacagaaattgagatgatctgattgtagttttgggggtatttacatagtgttttttttttttgtgctcacagttttcctatttcccctctcctcttactctgtatatttgtcttgagtaatcggatccacttgtatagcttcaacctttgattgtgatttacacatttatatctccagccctgaccccttctagattcagatttccactgttctggatatctgtacttggttgtactctaggacccacaaattaaatataggtaatatcgaacttatttctccttcccttctcacaacccaattcttggtgttctcctgtttcagttagtgttatcgccatctatttatatgcttaagttagaacagtttttgactcctctcttttcctttttctcacatatagttcaccacttagaaaatgtctctgtatccttatctttctctccatggctctgcctttgtctaattattgttattttctccaatgtgtagcctttctaattggtcagtctgcttccaaggcctttcctttcttaaccatcctccccacaactgccagggttactttctaaaacagatgagattaagatttacctgttttaaagtttataattattaccctctgattgcaatttgaatgataggtactatttgtaaacagtatgtgctagacactatgctaaccagttcacttacattatctcatttgacagtatgacagtattagctattattcttcattatccattttacacatgaagaaactaggcttaaagatgctaagtaacttgctcaaagttacatagctatttgattctaaatcaaggtagctttaaccagtaggaaagtccttgataatatggattcagttgattttttaaatttaatttttatcaaagttatgtttaatacatgcatatatttataagagttaaatagctctgcagaactatagtcacttgtcacttaatgatgaggacctattctgagaaatgtatcattagacatcatttgaacatgatacagtgt

SEQ ID NO: 64200 - DNA, 1060 bp, Homo sapiens
ctgtgcccttgccctgactgaatactatgaagtatttctttttgtcctgcagtttttaaggagttttaaatgggtggacttttattttacatgaaaatgactatttgaataattaggattcttgcctatcttctattttctcttttttggattagtcatatagattttttgtcttttagtgcccagatactgtaattttttttttgccaaatggaaaggaggagttcctgcatctccagaatagtagggtatggtgatagcccaagttagaaagaaaagattgtatcaaaaacaggggttgtaaaaaacagagcattaaatatatatatttaaatacctattgtaaattaaagttccaaaagacatctacttttagaacaaattccttggtattaaggaccttcttcagttcaggcagcatgtgtaggtggcatgatatgcagaggcatattctgttatgaggtttatgacacagattttcaaatctaacatacagacattctccattgtggaaaagtatttggcaaaatgattgtgcttggcagtgatggcagatgactgacaaaaaatgatgtgatctttcacatcgacgttcttaaagaatatgtgttttcctgagcctggtttttactggtatagtgtaagaagggatggatgtagatgtagtgtgagtaaatagatgcgtcctctctaccttactgcatacttccatttcctttgtccttaggtgtggaagtaataattgccctcttctttcatttaatgaaactaaactgaaacatgcatacataaagtatccatgtatatgaatgttttaatttatgcaaaactgttattgatataacctgctgttgagagattacagtttttacaaaaattactgagatatatgtctcaagttttgatgttctttaaaacatgctcttaaaatcctatccaaccggctgggcctggtggctcacacctgtaatcccagcactttgggaggccgagatgggtggatcacgaggtcaggagattgagaccatcctggctaacacagtgaaaccccgtctctact

SEQ ID NO: 64201 - DNA, 2024 bp, Homo sapiens
tgattttctgtagctctggtgtagaactagttgacatggatagaagagactgtccctgtcagtggtactatgatgatgctttaaatttgatgctgtgtagtggactgcttctatactaataattttcaagtattagtgtaatatgcttatattaaataaagtgactttctagtagagaaaaattaaagaaagcctaagtgacataattcagaaaaaggtctagaacttaaatctttctgtataaagatgtgaatccaatacctgtggtaaggttataggtttaacttcaggaaaatcatgaacctcatttacaacctcagtgaaattttttagtacaaccaaagcattctagtttactacaaatacctttcttgttttaaatacttatttgtatttaataatgaatacactttcattgtttttagtgtagatttccatggctcctgattttatagaattcattcagttaaacattgagttagtagctgccaagaactactacagagagattcaaagatgaataaggaatctggcctagttctagatcctagtctagactaatggaagagacaaacaggtgaccagacaaatatataatgtggaaataaagtgggaccatagagcggggagcagctggctttctctaggggattctgtgagaatgtaatcacaaaggctgacttgattattatgtagagaaggaggaatagtgttcaaaacaagaaagtttgtagtgcattttaggaagtggcaaaaaatttagtgtagatgcatggggcgcctggttctggcagattgtgtctaaaaattccaaaggctttgtgtgcccagaaagtgtttagatttttattgtttagacattagggggcaaaaaatatttttttccccagaaaaagtcaacagatttgtttacaattgttataaaatttagttgctgaaacttgttcatggaaacattttttacttgctggaatgttttttgtccccaacattaataccaaaaatttgcatacaaatcaaagtgggggaaaaacttgctaataccttattctctcatccatttatttccatttgcaatcatataattaggtacctttttgttttttaagaataaaatatttcttttcataatacattttagcacattttctacatatgagtctttttggtgggatatccttaggcataattgttacatatttgatatggataaaacaaaggtgggtgtcttcaaataggctaaccaggtaggcctcacttgcctttagaaaagtgtcagtggctgcactctggaagtatagatctgttttgaagttctcacaactgatgctggaagggaaatttgcaagtgagaagttcagcatacatttgataacttctgatctgattttcactgagagccacagtacaaggcttataatgatgtggtttcttaacctttctagtacacaacatattcttgtgagtggcttttgtagctagttacttcctgtgtgctttaccactggcatttttgtgggcatttggctttgtaggaactgtagtgtagagaactccctatttacttctcttcttggctgaagctctgcaagctaaaggtgacaccgtgctaggcagtgatgactgttggtggcagtcacagtgcagtaactgagaacaccataaggaatgtctttaatttgagaattaatggaatcttcctaaggttatccacagtgctccaaataatatttatttaataaaaataaaatatttaataaagagaagctctggattataaacctagttccaggttgcattaataagtagaatttttgtataactcatctccaaaagatgcagcatgttgctttagtaaatataaataagctatcaatgaatttatatacatttccttcattttatagtgtctgtccttttatgtgtttaggtattttacttgtattgcctttaagtttacaccagtttatataatctattattttatatctatttatagtactttgtgataacaagagaattgg

SEQ ID NO: 64202 - DNA, 1180 bp, Homo sapiens
tcagcctctgatttggcaccacttcatttacatgaggtgaataccaagtgaccaatgggaaacctttggcaggtatttggacccaagaagattctgtatccaggccctttagccgctgctggtgcagttcccattagtggagtgtactttcgttttcagtacatctctgctcttgttgtttcattcttttccttgcttcttttgtacattttgtccaattctttgttcaaaacgccaagaacctggacatgctccaccggtaacggttaaatactaatattatagcccctccattttctcggtaagaaaaactataaaggccacagaaactcattaagttacttagggtctcaggtaatgaaaggacataagtgagactttttgttttttaaatcagtgttactgaggtattatttatatatagaaaaattcatccttttaaggcatacagttttgtaagttttgacaaacatacagttgtacaaccactaccatagtcaaaatatagaatatatccatcatctcagaaaagttctctgttgtctcttcatcacctcaaaaaagttctctgtcgtctcttgtaatcagttctcttccccttcctccaggctctggcaaccactgatctgttttctgtcctcatgtttttccttttccagaatgtcatttacatggagtcatatagtatggtagcattttgggtaggaattttttcacctagcataaagcatttgagattcatttatgttgttgcttctatcagtagtctattcctttttattgctgagtgccacagtttatccatttaccagctgataaacatttgggttgtttccagtttttggtgattctgaataaagctactataaatatttgtatacaagcttttgggtggacatatgtcttcatatggtaagtgtatgtttaactttgtaaaacactgccaaactcttttctgaaatggctgtaccgtttgtgcattctagacagcaatgtatgagaattctggttgttctgtatctttgtttacttggcagtgtcagttttttttaagtttagttttgttttttaaccattttattaagtgtgtagtggtggtatctgtttgtgcttttagtttgcattttcctaacgactgataacagagcatcttttcatgtacttaatactggtttttatt

SEQ ID NO: 64203 - DNA, 1447 bp, Homo sapiens
tgccctgtatcctgccctgcgagttgtagctctttccaccccttgaactcccaactcctttaactcagggagattgctggactccacctgcactctccctccctgcactgcagcctagaaggtggcttaccttttttgtttctgctttcacagggatcattacctgtgttgcctcttgttcagtgtttgaaaatcattgtttcatacattgggagataaggagcaccaacaggattggaatgttagataagatgagagaaggacttgattgagaaatgaactattctgattatcttttgctatataacaatctgcccccagatctagtgacttttctcgtagatgtgcagtttgggtaaggttaggctgaaacagcttgtttctgctctgctaggcatcagctgggggcagcagaaaggctaggggctggaatcgtctgaaagcttcctcactcaacatgtaggtggttgatgctggttgtctgctgagatctcatttgggatgtggctggaacatctacacatagtttttccagtggctgcttggcttccttcctcacagcatggaggctgggttctaacagtaaggagctgagggccaggaggaagttattacaccttttctaacccagccttgaaaatcatgctgtgtattacagggagtcactaagtctggtctatattaaaggggactggaattagcctcctacttttgctggaggcaagttagactcctactttacgtagggaagcaagtcaaagaatttgtggatatgttttaaagccccacagcagtgatacttgagcaaaggaggtgaggacatccagggaaaaatattccaggtacatggtacagatacataaagaccctgaaggatgatggatgcctgatagtttagatttgcttatagattagttaccactgcacagcatcacctccttgagagcagggtgaacagtgttgggagaacagtgttgaaagatagttgcagttcaacaatttttttgtgaaaggcaccatgtattaaaaattctaaaaatgcgtacatatactttgatctagtaattctttctttgagaaattatcttaaggaaaaattatacaaacaagcaatgctgtagtgaatgtttggaggggcttaaatgcccattaatagcagattagttaaattatggtttgtctatataatggaacactgcagtttttaaactgaatgttttggcatacaaaaacaatgagtattgagggacaagaagtagatttcaaatactggtatatgaaattgtcctatttggttaaaagtactctctctgtataataaatattatatgtgcatagactggagaagatgagatgagagcaatggtggctattttagagttgcttttcagaaaactgtatgttgctattataacagaaatatatttctattgtaaaagtaaaagcg

SEQ ID NO: 64204 - DNA, 1302 bp, Homo sapiens
tcaaactttgctaggaaatctagctttgtttctgcaatgaatgtagccacagagcactctattagcttatacagtaaatataactgctgttgactttccccttagtctcataagtgtaatattgctatgagttgcctgtaaaataaatagtttcaactttaggatttatacctttttttgtacttggctagattttctttgtagaaaactttgtcctcttcaaatagcgcatctaaactacattaaatgtttttctaaatggaacatgctgtaggcttttctaaaattttacacttgttttctcttacctcaggttcatcagagaactcttgactaaaaatttttgctcccttccctaaatcatgatgtatcctcagatgccttttcttaatgttggatgtagtacttaaatgaaaagtagtacctttccctccctaccaacagcaccatcatcatactttccccacttgaacttggatgtgctcgaaggtgtttagctatatttattttttatctattactatgtaacagtggaccctaaagtttagtgacttaatagggcatttagtttatttgttcagatttctgtgggatgggattggggccagggctcaccagctattcagttctgctccaggtggcatcatctagaattacttggctccattaagttggtggcagtcattgaatggaacgtccaaaaggcttttctcatacatcaggcacctcagtgtctccaccaagtggctgcttcctctgaatgtggatttctagggcttcctcacagcatgctgattgatcccagggtaactggatttcttacatggtggctgggttataagagggaatgtttccaagaaatacaaaagcagaaactgctggtttcttaaggctctgccttaagttacacacacagcgtgacttctgtcacattctcttggtcttagatggtcacgtcagattcatgagaaaaggaaaaaaaaaagaatggcaaagaattttttgctatctttaatccacctcaagacgtaattgtttttacctttgggcataagtaggatcagttttggttagggctacaaagaaattaagaaagatagctgccctaatttcccatttccagaaaaaacctttttacatttaaatgttttggaaatgtttcctgcatgtttaatttatattgtataggtttttttctcttgaaaagctatttaagaaaaaaaaaaactattgccatatcttattggtggtatcttaaaattgcaacaacaaaaaaattgttttcttctcagttcccaaact

SEQ ID NO: 64205 - DNA, 1044 bp, Homo sapiens
tattatatactacattagttttatttttgttacattacataattatgttacataattattttggttgggttgcttagtatgttgcttatctggtatttttcatcatatttatatatcaaaacattttggtttttagttatgtaaaattatctttggtcaattttcttgaaaccccattaaatatcatattgcatatattgtatagaacatggaaagagaaatgtttatagattctttttatgtgtatgtagtgcttaacattacctcttaactttcgccttttctctttttagtttgttagatgttggggaatgtgagtctctgggatacctatcagtgtatgcactgttactgggcttagctattccagttaatgaataaatgagttaattccaagcctagatgaagagaattttaccagatcattactaaaaaaatactatttaaatgtagatatgtatctatttacagattacttattttatgtttctcataatctgaaacattatgttttatgtccataggcaccactggatcataccagtgacaagtcacttctcgacgctaattttgagccaggaaagaagaactttctgcatttgacagataaagatggtgaacaacctcaaatactgctggtaagctacttagaaagccccatatttataatttttgtgcactgtcacctactacttgaggatgcagtttcccaaaggaaataagatgtgttttgtaatttgtgtaataaattaatattttttcattttatgttggtttgttataagtgtgtagaataacatagttacactggacatccacagcaacattatttgtgtatacagtctgttgccgccttggatttaacatatactgctgtcttcaagaccactgccacaccagggatgggggtgggtctaggataagtcaaagtgccacaaagatctcctgtgtttcagtagtgacccttcctttgtttaagcatttgcttggttgctgtaaatctttggtggttttcatgaggtttttcagtatctgcaagaaggt

SEQ ID NO: 64206 - DNA, 1020 bp, Homo sapiens
taaatgcccatcaatgatagattggataaagaaaatatggttcatatacaccacagaatactatgcatccataacaactaacaagatcatgtcctttgcagggagatggatggagctggaagtcattattctcaggaaactaacacaggaacagaaaaccaaacactacatgttctcacttataagtgggagctgaatgatgagaacacgtggacacagggagggaacaacacacactggggcatgttgtgagggagagcattaggaagaatagctaagggatactggacttaatacctaggtgatgggatgatctgtgcagcaaacaaccatggcacacattacctgggtaacaaaccacatcctgcgcagatacacctgaacttaaaagttgaaaaaataataatttaaaaaattaaaatgccaaaaaaagattaagaaaacctggtctgatttacctcactcttttacaggctgagactttttcagaatccttctgtttaatgacgctttgctcaggaaagattgttctgtttgatgcttttcatttagaagtttattgtgattaacaatgcctgtctggatactagacagtaattaaacacagtccatctgtactgaagcagtaacagaatatgctctctgatcttcattaattgcatcatttagttttatgacatcatgagaagattttgattagtctgagtgacattgaaatctaaaatagctattaatttagggaactctggattcacagttcagggattcatgtttttaaatgcataagaattcttcagttctgttctaattgcttgtgctgcttttatgtcccttaatccttttcagcatcttccttattaaaatgaagtttcttgtcagagacagtaggaaactatccatctcaccaacaataattgtgtgtcccctatgtgctaggcctacgtggccaggatgatataaaaatgaatgatagactgtcatcacggagtacaatggtacttttcgtttattagtaccaaa

SEQ ID NO: 64207 - DNA, 1080 bp, Homo sapiens
tgaatatcctattatgacacatttaacacacctttgctttgtatattttctttaagataaacacataattttttagtttttaaggatacttttaagtatgagtaaactgatttttttttccttttttgtgttactttccactaacatctttaaattactgtaaatatgtatttaggttatttttggaacttttaatattgctgattgtgttactcaacattatatcaccattagattaatctgtcagcttgttatctgaacttacagaagttgatgtatttgtcattctgtatgcatgtattgccctgtagtgtttaaatgctaggcacttggtggatagagagggaattagtaataagatctttgttcttgagtaatttataagtctttctacaatagcaatatgtatatgtttgaaatagtttaaataacatttaaagacagccaaataccattagagtttaaagagaagaaaggttggtgaaacttggagaagaaagtaagcttcaggtaggtcatgaagctagatatggtttggccaggttgagaagaaagagaatacactgtgcagataggaggcctgtcaaaagtgaaagtgaataataggaagggctacctgagtgttagtcattgtttgtatcagatagtgttccgagcactttatatatagactcacttaattctcatagtaactgtatgaattttatgctattattgtccgcattttacaaagaaggtaactgaaggcacagagaaatatagctttgcctgaaagcacactgctagaagttgcacctagtagatgccaggattcactactctgttctgcctgtgcactagcggatgccaataagcacagtgtgttgcggggggcttcaggagatcagcataaccagagttttgtcagagtactggaggatgaggttaataaatagagttcagagcctgctctcaaaactagcacagaccagatcgttggacaatgtgcctgttttagggagtatgcacaggaatggggatcctgggcacttgtttaaccatctgttttaatactctgaaagtggactgtaaatttacagc

SEQ ID NO: 64208 - DNA, 1221 bp, Homo sapiens
ctcatagtcaatcttttttgtctataccctccaacttgattgtttggaagcatacctccatcatatcatctgtaaattatatctcaggtcagggctacgatttccctgattgcgtcatttaacaatttgtttaaatcaagatccatatgagctgtatattgcagttgattaataaaattcttaatctatttaatttgtttataatcctctttcatcttttttcatccttgcaatttattccctgcaaaaaatagaaagaaaactgatgtcatctatcctgtagttttccacagtttgggttttgatggttgtatgccgtagtatctcacgtaatagtattcttctgtttcctgtatttttgtgaattaataattaggacagaggttatggtcagattcaggttccacagttaaatgagctttgccttcttttcttgagcacttttgccttgttatgccttgttatgccttttcttgttaaagtctaaagttcttctgaatttatgaattagggaaacactaatgtttcattagatattattagtttcaattagcattcaaactctgtatagcttccaggattaaaatcttacattattatgattttgatattaattatgcttttaaataataaaatcattttataaatactttattaacattttattttaataggtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgagggtactaattctcttgtaatgataagcgttctaatattcaaacaaattctagaagacaataatattacaaacacattacacataattacctttatcttaaacctttcattgcaagtttgttgtcatatattttctaacacatttcataactctacaatgaaaaataacaaacatgacaaatattgtagcaccataaagcatatattatttatagaatgctgcaatctattttctggcgtgtgatttccttttcatgactgtcatgtatattcttatgttcttttttaaatttggcattatttaaggtagacttcaatatttctgtctatttgcttttaaacaacagattgtttcattacataaagtttatagctatttctaattgaattttatcttaaaaca

SEQ ID NO: 64209 - DNA, 1040 bp, Homo sapiens
cttttttattcaggattttgtcattaatataatattttaagtaattataaaacaaatttttttctaactaggaagaagcattgcatgcatttattcagccagagattctggatggcccaaatcagtatttttgtgaacgttgtaagaagaagtgtgatgcacggaaggtaaatgccatgtagagattaatacttaggaatctgagataatattccatattcaatagactctccccctttttgttgtttgttttttagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgaggtaaatatttgttattttaaagtatttttcattaatccacattagtcagtcatggttttgaaagagctgtttgaggtaataacactgatgtcatttggactgtcttcttgatggaaactttttctttcttattttctaatgtggaattcaataaaatgatttacctttgtataagcttttcctgactgcataaattatattttaaatattcttgtttgatcagagtaacttatgatactctttgaaaagacaataaggaactcagctttggaattatttcttgaagttgagtgataatcttatattttataatttcgtcgttattgaaaccagcctgaaggtaagccatactcatgtttctgatctataataaatgcagacaatgcctatgatggaatgaatgaaccaactgaatagcatgggcttaatttcttgtacttacctactattttgtatttactatttgtctgttttccttttttagtttttttaatttgaaactttatttaaataatttaagcatgggatttgaagtgacacatgatgtaatgcttatcaatttcttcccacactttggcctgccaaaattctctggttcttctatccttattcaatgaaagacttacaata

SEQ ID NO: 64210 - DNA, 1053 bp, Homo sapiens
taacaaagagaattcttcaaattaaatttgtgtgaatgtggtttaaaaccataaagtagaaaagtataatgtgctgtaaccattatatttctacttcctgtaaaaagactatcaagttcttaaggatgaatacaatgtcttgtttctctttctaattatctgtaatacctaacgcactgataaaccgagttggactttttgttcaagaaaagaaattatattctttcctgatttgagaacaccagaagctcattttggagctcagcttctctgattttgtggattttgctaaaagaaatgataatttcaaccattatgttgtaacagtaaacataaatgaggtttaatagaattctgaatcactaatttgttgtattagaattttaaggacatgatagaaatgcttttaaaatacactgttgcttgtttaattttacttaaggtctcaatttttaagagaaaataaatgtactcaaagtaaaatatttttactaatatgttaaattgtgtgaaaatattagcagtatataggtacaaagttttgttgaacatattttctctgtatatggtttataactaagataattatgtcttattaagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaaggtaccttttatagtttgcattttttagttgaaagtgagaataatctctgacttcctatataattctatagctgttgtgactgataaagttatctttaaaagaaacttaatttttgaaagttaagacttctcaaatatagtttttttgtacatatatatatatatatatatatatatatatatatatatatatatgactataattaaacttcaggaaaaactgcttacaggtaagaacattaatttttgggagaccatactttaaactgtctaagcaagctggatg

SEQ ID NO: 64211 - DNA, 1010 bp, Homo sapiens
ttggacaaatcatttaatctgtgtgcctttcatttgctacattttggaggaatttggactaggtgctttctgttctacgcagatctagaaatttgtaattctgtttgctagtaccatgtttgaagatgtatccccttttaattaggagtaatgtattgctttgttaaatagtagtaaaagagaagaaaatgttaggacacgtttttatgtaattttatttacaaattatcatgctacatttggatgaaggcactttactttccttcctactttttggcaatgtatttgtgatttgaaactaaaattattgcaattgggaacccttactctgtcatgactgtattatctttgctttaaaatagatatatacaattctaatttggaaggtgattcagtcttctgaatatatcaccattattgtcatctagaagttgctgctattagaattttccaggaagataattatgttggctttgatcattatgatgaaacttaaaaaatgtatagctgttggttggcagactttttctgtgtttattttttttctaaatggggagactgcttatgataagatattcatatcattcagtgatatcaaaattttgtctagtgtatttactacattcaaagcattttaatttaataacatggggttaccacatttcataagttgttcaatgctttaaacacattttggattgcaaataaattctgaaacttcctccctatcaccactgtaattaattttagttttaggaataaaatttgaaccacaaaacaagttttcagacattttcaaaatttgttctagaaatttcactaattaacaatatattgtggtcagtttaaagttattttaagataaattagaatttcttgaaagttatagaaggctctacaatgctttttaggaaaagaataaagaagagaaaccctagtacttgtagaaaagtaaataaaataaagcttgtctgtcataaactggaaatcttctgatgtcaaattgcctt

SEQ ID NO: 64212 - DNA, 1020 bp, Homo sapiens
acaacccatgagccaaatccaacctgcctccatattttggaaataaagtttgaacactgacatagccatttgtttctatattatgtgttaatgcttttacactataataacatagttgagtagttgcagcacagaccatatggcctgcaaagcctgtgatttttactatttggtccttgctggaaacaacttgctggcccctgacttaactgttgtatgtagacattccaatacacagttttgttaaagactttactgtattaccaagaggagatacggaatcttctctaaatgtgataagaggaaacagattttcctcttatctggaatgttttaaatctcagtgtgtctgtgaacagtgacatgattttctaattgttttttaaaaaatcacaatttaaatatttcatgcttagaagtggaatctttttaatctactttttgtccttattaatcttttttatgtttctactagttccacaaatgcatatatgctgatctatagactgaaggatccagccagaaatgcaagtatgtttacctacagttatttgattttaatttgtgttataaactaatttcttttgtaagtttgcaaacccagataactacttttaaatgataggataattaagttgttttatgcctggaagaattatttacaaagactgttacaaaataataccaaatgttaaggaccttgaaaaaatgttgttgaattattttttaatatatgaagagacaaaactacattaaataaattgaatgtttattagtagtaagattatattatgtgcagtctgatgtagggacgataacatttttggaattattgcttttaaaatattgcagtgtttgttttttcttgctaattctgactcaggctgtattacaaatatctaggggggtgtgtacagatacatatacaggtgatgtgtttgctcatagtcttttcataattaaaaaaaatataatcacaatctttgatttcagtatatttcctttgtttagacactaccg

SEQ ID NO: 64213 - DNA, 1462 bp, Homo sapiens
aggcatttcacatggcaaaagcaggagcaagcaagttccggggttgggggaggggtgccacacacttttaaatgaccagaactcatgagaactcagtatggcaaagaaagcaccaagccatgaggcttgacccagacatctcccaccaggccccacctccagtattggggattccaattcaacatgagatttgggcgaggacagatgtccaaactatatcacataatcatcactttttgtattcaaatgaatcttgaccatatagagagggagaaatccaatagatgaaggtgtcagttttatgactctgcattctttggttaggaagcagctaaagactgctttgagaacacaggaaagataatagtaaacaaatgggtagtactcagtagcagcaacagcagcagtatttattaagttttattgtatctcaggtagtaactttatggggtagatgatattaataagctgaagagacctacatttggagaagtaaacttgcccaaggtcacacagtttgatggggatggcatgatttgaagtcagaaattattttcaagttgcagagagctttttcattctaaaatattaatccacatactggagttgttctggagccaagagccattttgaataaatacatggctctttaagatatggacctaaccatgtgtccctgttaactgtctcttaacccttttctggacgaagcttgtattccaagttgagagaaggatgtaatggagatatatctccatgagtgctacagtagaagtatataccatgagagcatagtgaagcaggatgaataaaggcagctcagtttcagtgacactgtcttatcctgtttttattactaatagaatttctagaagtggatgaatacccagaacatattaaaaacttggtgcagaaagagagagagttggaagaacaagaaaagagacaacgagaaattgagcgcaatacatgcaaggttgaattccatcattttatttttaattgaaagtgctatttttaagctcgcttacctgcaattctaatgactaactcattgggttgattctgagacaattatgctatcatgatcattgaacagtgtaaccaactatactataaaggtaaaatttgatttgatttgatgtgtaaaaacccagtaacatgtagtgacggtgctcagtgctggtgaagccacagttgaggtagacacattctcttatcctactaaaagaaaataaatccgtaaaaactggatagaaattgagtagtatttatcaagagccttaagcaaaatcatattttttaatataatttctcttatggaattacctaaggaaataatcataattactgtaataatcttgattacagggatattcattatagcattttccaaattagggaaaaattggaaacaacacaaatgtatattggtaggggaatgattacataaatatgatac

SEQ ID NO: 64214 - DNA, 1515 bp, Homo sapiens
taaaaaataacctccaattctgtgtttatgtcttcaaatgtgacagaagtgatggtgaaagttcatgttgttgatctaaaggcagaatctgtagctgctcctataactgttcgtgcttacttaaatcagacagttacagaattcaaacaactgatttcaaaggtaagttttaaaaggggtctgtaaataaatttttgagagcctgctatgtacaagacacactatgtgacagttatgaataagatacatgctttacctccaggagctaattaatatttgtagttaggagacaactgtagttaaaagaaacagattgagtaaagtgtggaggtaagaaagtgtaaggcaagtacatataacaacttatatgtgttggctggattatcataaaatacaggattggaaatgtaagtacagtttatttcatgaagagctttaaacagtaaacacgaaagtttgggctcctttttggcgtaggcaataagtcgagtttttgttttcgtcatttttaagtgcggcaatgctgcatttagtgtctggtgacactagactagcgttccacatgccttgaggggagtcaggaatggagaggaggaagctgttgaaataattcaagtgcagttgtatgactggaaatgagagaaggcatggattccaagagagatagaatctgtaggacttgtaattgttaaatgttggggtaaagcagatgcaccgatgacctgagccaggggtttcaaacttgggtaaccagaaaagtagggatacattaatagaaatagaggaggaaggtgaggctgtagacttgacagggaaggtgatgaattaaatactggtgccattatgtgagctagtgataaagaacataggctcattccgattttttgagctggaaaaatataacaatgaaaacattcaaattttggggggcaaaaggattagtccacaccagacaaatgattatcatccttacaagggtcctgtactctgcagaaccctgagcatacaaacggcagattttgcagggttcttgaaccgtaggttaatattccctggtgtagtggaaattgttccataattacaagttgagtccagttttcagtcattcatcttatggtagtcttgtctttcatctcattatctggggttgtaaatacctgtttagcagagttgtagtgaacattaatgaaaaataaataaatgctctgaggaaaaaaattgtaaggcattatgtaagagttggtggttattatgttctaaaaaaaagtctatattttgacttctgtatatgacttctaacaattttgctaaagtaataaccaagaaacaaatcattttgtgaaattatattttatgattaaattgcttgtaaatgcatactatgttggtataatatactgtatattacatttttaaaatatgaatgacaaatgtaaaaaaaattagtttaataagcactcacacataatacaaaagaaagagacacagtagtttcttccccaagaagttaataat

SEQ ID NO: 64215 - DNA, 1648 bp, Homo sapiens
tttacacatgttcctgtgtctgtagttcaggctaaacttggatttcctaaaggtgaaagatttctacaatctaaagaaaaaccagagtattaatttcctaaagagaaggatatataatacacaactttctgaaattggacaacccaataaacaagatgtttgtgtgtatgtgtatgtccataccgtctatcttagtgtagttttatggctagttacaaagacatttgagcctaatgttcattttattcagtctccaaaacaatagagtccttcagaaactatatcatcacacatgttataacataactgtgtattgtgttgtattgatgcaatataatgatgatgatgaatgagcatgtcactaaaattaatatataataaaactctgacttactatgtaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatgtatgtacttcaaaagaaaaacggtccttgaaacagcatcagtttttctctcagtttatttaaattttcagttaagtgttaggtacttagttctaagatcatttgtaactttctggattataagattattgacgcagttgtaatgaacactgttcttagacctgtgcagtaaattagatggtaattatatcagaactctgagataagaagtaaaaaaaaatagtattcaatgttaggaaggaattatgatataattactaagtaaaaaattagggaatatattaaaaagtaaataatattttttaaaagctgagaaactttagaaaatttgatattcaatgcccaggaaaatgttttatttctacatgctcttccctctctccatttccaatgcaaacaacaattcccttgccatacccccttaaaaagtccttaatcaactgggaaagtcagagaaagaaaaagcgct

SEQ ID NO: 64216 - DNA, 1021 bp, Homo sapiens
aaggattaataatagctttagtgaaaaaagaggataaagtgaagttgatttgtttatgattttagatagggataggagccaatagagaaacaaagattggaaatccagagaagagagtaattggtaatgcagtgttcaacaggagtcaggagggagtggaattaggagtactggtttgaagaagagaggaattatcttctgagactggagagaagagagtaaatatttcattctcaaaaactccttgggataattgggttttttcttgtgcccactttttaagagtaacacttgaagtaaatctttttgtttagtaaggcactaagggaaaagtcaaattatgaaccttcagaggaaatagaatgatgacctaatcttgcatattcttaggggtagagaagatgaagtccatgtcacagcttgcagttttgtcaagacggtggaagccttcagagatgaagttggatcccttccaggaggttgtattggaaagcagtagtgtggacgaattgcgagagaaggtaagttcattttaaacaaaacatgtatcttatgttgtatatgtatatcataatattaataaaatatataatatataaacaatacattcttcctgtgttgcgtaagagaaaacctaggaagtagtaccaaacactggtgcagcaacctttctttttggtttctgtcacaccttgtggcacactctggttgttcaggctcctgattctttgaaaaattactttggctcctggccattcagaagtggatcctcactttctgttacttggaccaattttgtcctaagtagttagaattagttagaagttactagagtgaattgctttatgtctaaaaaaaaccaaatgaagtcgaattgtgtagagaatccagatgaaggtctgttttgcattttaagatgggatatctaaggatctctggggaaagggtgaattagtcaatctgtggtactagcacaatgagcattttgaaaaagatttatttccatacttcatactaaaca

SEQ ID NO: 64217 - DNA, 1001 bp, Homo sapiens
agtagctgggactacaagcacatgccaccacgcccggctaattctttgtatttttagttgagacggggtttcaccatgtgcgaggatattcatggaagtatacagtagagctttgtaacttggaaaaactgaaaacagtctcagtgtccatcagtaggagataaaatgtatattgttcggttattgaagagaatgtggtcactttgtatcctattcctctaggaacagaattattatatagagatattaatctgattttacatgttttagaaacgtgggtgtagtttgtgtatgcataggaaaaggtctggaaggaatatactaacttggtatttctgggacatggtatttgcagggtggccgctttctgctttttcttaatttttttacatgaaacattttttaaactgagctatttctgtttgtggggtaaaaggaaaataacttttctaagcaagttaattttttaaatgaactcaaataaaatgttttattttacagcttagtgaaatcagtgggattcctttggatgatattgaatttgctaaggtaaagccctgagaatgttgcatctgtgtattgtgcatgataaacacagctagtggcatgatttattcattcattctttttctttttagggtagaggaacatttccctgtgatatttctgtccttgatattcatcaggatttagactggaatcctaaagtttctaccctgaatgtctggcctctttatatctgtgatgatggtgcggtcatattttataggtaacattcacaatgtttttgttgctgttagtaatacatttttggcgtgcatacatatcttattttccataaatatctttactgtttttatgatatggagcggcactaaccggtagaaatacagtgacagccaaacatgattataatttgaagttttctagtagccacattaaaaacaataaaaagaaacaggtgaaattaattttaaaaatattgtaaacccaatatatcc

SEQ ID NO: 64218 - DNA, 2030 bp, Homo sapiens
aaactagctttctgatttacctagctcctcatctataaaattgcaacaatgatgtctaccttgcaggattttatgagaattagagctgttgcatgtaaaataactggcacagtgcctattatagatgttcaataatgatagctgttactactgctaataacatggaagttattctccgccacttttagaagtaagcaatatgttcctgtgattaacaccttagaaatctgggacatctcagtatataaaataatattacttcaccagtaacagatttcattatcttgctgaggagcatcatagcattcaagcatacattaatagaggtggagggctctactggactaatatgtgattaatattttatatgtagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctc

SEQ ID NO: 64219 - DNA, 1049 bp, Homo sapiens
cagcatcgtctttacagagacacggagctctttttctgaatagaaagcgataaagactagtttactatcaagggaatgcaggggactgtgctttgtcaccactgtctcattctatcattttgcaatttaatgatttttacggttggctctgaaatgcattacacactgcagaaactttctctcagagggaagagggagatttgccatggcaaaggacaaatcatatgctgtgtaaaccttaaaatactatacacaggagctaaattttcaggctttaaaatttccagatgaattcaattaaaagtaatcaccacacaccctatactttcctttcttcaaatgctggaatgtgtattaatatgtatggtaacccaaggaggctcacagaaagttacagagagtaacactatatgcctgtctagaaattgcacgcagtatgtgcaaggccctggtctgtttttacactcaaatgtgaaaggggaaaaggacaccgcagcatgttattgcacctgagcacatcggctgatggggatgtggtctgacgtctttgttgtgaggcttttgtgctgcacttgccgcctgccccacttcacaggtcagtggcagacgcactgatgctgtgctgcttttgtgctgggggtgaggaggaaagcagcatgtagaagctagagcatgggcaagccattgtgcattaataggacacttttatttatggaactgtgtccccacataggaagagtctggcccaattagccaaggcacccttttgatggcacacatcctctttaaaatccaactcgcagctacaaggcttagcatgtcctgcatgtgttgtctttccggtttcacattagaatttgatgttaaaaagtgagctggtttgtatctaggtgaacacacctagtttgaagctgtaagttcaatcatgtacaagcaactccaagatactggccaagacttctggaaggctgggtacagtggcccacacctgtagtcccagcactttggagggctgaggtgggaggatcacttgaagacaggagttcaag

SEQ ID NO: 64220 - DNA, 1023 bp, Homo sapiens
gatttcacagaaagaaaacctgggcacaggtcgggggatgacctggttggagtcactggtctcctaactcccagaccagaggtggctcaactgcacttcatcttcccaaagatgtgctggcttcggatgcacacgcctgctgaggagtggccagtagggaaagtgtgccttttttatgaagaccgcaggaagccagcccccctgtatccagatggcttctgcatcctcagccttcccagggcactgaggattttccccacgtcttttggtctgatggctggaagggaaccagtgtatggatgacagttaggaaggtggtgttgtcttggttagtagctgatggattttttcccttgtttttggcacagtgctcaaatgtcgggagctggccgacttttacagcaggctgggggtccagttggctgtgtgcaatggtagtgacccaccattcaagggagcctgggggtggggggaggaactgtgcagtgaagtggaaagggcactggctgtggagtctagaagccccactttgtcacctaccagctagggcacctcagtttccccatcttcaagtgaggtaacaatgtccatcatctctcccagccctggcagcacagaagcctctgaaacgaagacaaggttaactaaggcagggatggaagagaggccagcttccaaaggtgggaagagacagaagaaagcgaaacaaaaaccagccagccataggatatgatcatggtcctagagggaagtggtttagagtgttccagatctcaggctgtgtttggggtttgatgaaggattgaggcctgagcagagttgtagaatgaaaagggcaggggaagcagaactcacagggttgtgaattaggaaaaaagcctttgttctcaagtcaaaaaaaaaacttaatctatcattgcacagtggtacagccgtgctctggggagggcagcagccgtgcctgtgagcacatctgcacctgctggaggaccaggatacatgaggctgccacatgtgcatccc

SEQ ID NO: 64221 - DNA, 1093 bp, Homo sapiens
gtcaataagggaagggtataaaggctgagccccaggcacttccaggtatagaggacaggaagatgaggaggagcagcaagggtgcctgagcaactgcagggcaggagagagtcaagaaagtaggtcaactgtttcaaaggctgccctgactgcctctctacctctagtttcttttctctcttcttaccatctttgttattgctctggaaccaattgtcctaaagtagcacctccatcctattctaagctcataaaatccaaaggggaggaataaagtccaaactcttcagtctgccatccaagtccctccacgatctggctctttctttctctttctctctttctttctctactctcctggtttcaccttccccaccaacccctgaccctcacttcactggccactgccctgcaaaccacctccctctttctcagcatgccatttgttttctttctgcaaatcttcagcctcaattctccattcatggtctatctcctggagggatcctttcttgactgaagtcactaatctgtttcttctctaaattcctaaagtagtcagaggtaataccaaacaatccagcattcattgtatctgtttttcttcttctctagttcccagccaatttcctgaggtttgggaacatgagcctgtaatccccagagccatctcaccagtcctttacatatcttagatgctctgccacataacacttatggaaacctggaaggattaatataggattgggattttgagtatgggctcagaggctaggttcttcccctggttctattaccatggccaagtcatttaaccttcctgagctccagttttcctatctgccaaatggctatgaacatgcctaattcagggtgattgtaagaacgatgcaggatgcatttcttatagtatgcttagcacacttcatgtacattataagcaggcaataagcggtagctttgttttcattattgctattattaatactattattattcttggtcttcccaacagagatgcacaggcaacaacaaagatgggactgtgttgacctgttcactccatactttcagatctcaagtgaggtgttcg

SEQ ID NO: 64222 - DNA, 1052 bp, Homo sapiens
aggcagtgctgagaatataactgacctccctgcctttcctcccacaaagcccaggaagtcctttgtatcctatagcccctatctgaggggccaagctgggggccccagcaggggatggaacatcaggcaaacaatggcttattgtcctgagctgatacacctgaacctttcttggaagcaggggctaaatttcttggcatttgtggcctcctggaaatggcagacagtatgcttagaagcagaatcctaatccctcccaggttgggccagagtagaggccagggtggaagggggagccaggcctgacagctgctcccaagaagtggcaggcttggtaaactctgatgaggtcccatctgtctaagttcaagggatcagacacccccagcaagcctgcatccatgtcctctgcaggccccaaagccacacacatggtctggagtgaccattccaaaggtgctgtaatgttgggcttcctaatcagaaagggagcaaggagctcctgggctttgtttgcaccagtctgccaggcactcctttccctgctcagccctatttagtgcctgtgctttcgctggaagccagtgagttagccttaggccctgaggatgggcactgctaccaggaataggggagctgtggtgagcccgtcatctgctttgcagttccctggactccctgctttatgtttgaggctttctcttatcagtttagatgtgacctcccaagggcagtcttgggttttgatggaagtcatcatttcacccacacacaagttactgttatttggtgtggtgatggatatcaacccctgcccagaggccctgcagcctccattgctgctctctctggccacatctcccagaggctgggttcagaagctggggaggacctagagcttccctcactctacgatcctgggatcaggagcagtgtttctagaatctcatgctatgtgtatttacctcccacaagaagagactgcagcgataccagggtgggcttccagagcaggcttccagagctgggggtgaggggtgaaggggagagca

SEQ ID NO: 64223 - DNA, 1108 bp, Homo sapiens
cttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaa

SEQ ID NO: 64224 - DNA, 1109 bp, Homo sapiens
ggcatagctgagcttgccttggccacccgcagccgcctcatcctgctaggccaccctggactccaccactctctcccctcatccccaagcccagtcatagcagtgcctttaacccaaagctgctattgcatggaagtcagatctccctccccttctgcctcttccatgcctcactcttacatgctttgtcttatcacgtagatatttgtgaacatgccttatctcccttgtgagacagaaagagatccttgaaggcagggattgtggtggcaggttcatccccaaacccctagcacaggcctggatctgaggaggacacagcatctattggaaatacaagcatttgggcacacagctcataggcacacaagaagcaaggcatggagctgggtctttgccacagtcattctatgtaataagcctccccagtctcagtggcatatggcacctattttcttgctcaggagtctgtgggttgactgagtagctctgcttcaggctgtaggtctaagggcgagggaggccccaagggattgactgggttggctccaggctatagcttggctccaggtctgttccatgtgccctcaatcagggaccctgactgaaggggtagtggccacctgcgacaagttcttttcatgtaacctagcaggaacatgagtgacagccaactggcaggcccacttaaagcctctgctcacgtcccatccacgagttaccacaggtcaaagcaagccttgccgccaagcctcacgtccatggggcagggctatacaccccaccaactccagcaggaaggactgcaaagtcacagcgtaaagcgcaactctagtatagggagggagaaaagaactgggggcactttccagccaaaactcccagcacaaaggtcatgcgcaacagtgtccattcatggttctgttgtgctcacagacacgcagactgatccccgtcctctgacagaatacatgaccttgtgctggtgtcgtaacctctctgtgcttgagttttctcagcaggaaaatgggggtaataacaacgcttttctgagaggatcgggtgagatttaatagacttaatacatgtcaaatgctcaaacaattatt

SEQ ID NO: 64225 - DNA, 1025 bp, Homo sapiens
tgaggatactagtttacactggggttgcttgtccattgaatcagaatcataaacgaaatgaaactcctttctccaaaagggaagagctctgcaaaggagctataatatgcccaatatctgattataaaatcaaaataaaattctttttacaattaacgtaaaatttttcctactttgctttgggttgggaaattactactatagttgagtagtgactcttttttcctcattttctttctcacctgtctcttgaaaaatattgctcacacatgttaaagaatttatattaaaagtgaattccaataaaaggcctattaaattagcctgattcattaactctttttgaaaataatgtgcatgtttaggacagtagtatctttcagtttttatttcatgagataaatgtgttgggaaatggagagagtacaaatagatgtgaatgtcattttatctaattgaagatgaatgctgaatttgggagctgtagaatttagtttaacttgccttgaaagagatttatgatcatgggatatgatgctttgtctcccaatggctctgccgttaaccgttcacctcttgtctttgtgaatccaaagaggtaacttgcaaggtggatggggcaagaaacaaggatgttgaagtttgtttggcaagtcaacagaaccaaaccaaaccaaaaaataactgcttatctgggcctgtgcaagttaaagtaatttgacaaagaaccacgttctgtcatgtgtacgttatttaggctcttgcgtcatttttttctgtatcaagattttcgagaatattttaaaaagtggagagctgttctagcacagttggtgctgcattgttgaagccaggcatagccattgtatttgaacctgttttctatcatgacctctgaaaatccattcccagaaaactgattgcttaggtcctgtggttacacccaaaggagatggtggctagaaatgagggctctgtcgtagccgtggtactgaaagatgcttccttgatggaatgttgccaga

SEQ ID NO: 64226 - DNA, 1150 bp, Homo sapiens
actcctgctaggagtgcacacgtgcattcgtgagcagaggaggcacgcttctcttagtagtcttggtacggatgattgctttctgccccttactgactgaagtattccatttcaccagagctggcaggtcaccactgtgttgcagataatctcctgcatatgtcccctgggaacactgagaatgccatctgtggcccttttgctcgcacttttctggtagtttataggcaagtggatgagtaggaatggtgggctctcatgcccccttcctgcctctgctctgagctcctctatccaaacccccacctagtgggggccatgccctggtctagtgggcttgagaccctgtagaccatgatataacaagaggggtaagaccttcctgaacctcaaggcacgtgtagccaaccagggaagagaaaagttggagccagttagcaaaatgaaatgacagtcatgggaactgttacgaaagaggtacaaggaagagtctgtgaggactgaggaggtgataccacttctgtcttgggggaggaacagtttgatggagacagtggggctcaaccataaggaccaggtagggctttggtgtatggagactgggagagaagtgtgtgcatgccagacagaatgacagcatgagcaaaagtccccccggggaagaatggggaccctgtctcatgactccttccagactcgttatctattgactctagccaacaaaggtcaactcctgttctcatttattaccaccttgtcctaagcccctggtcaactgagacctgggggaggacctctagcaaggctggtgtccccctggggctctctctttggcaaggccactccagccttcctaatgccattaggaatggactcttcttgttctgtgggcagatgatgagcaccctgcttctgggaggacagacacagtgagaaagttccgaccatcattttgcttccactttcttcaaccacttaatatgaaacttcctggttacagattggaagtacttctgctattttagaattgggatatttctttcccttgggacagataattttcccaatataaatcaatctatgggaatattttggaatataggtgatatttttatgcaattattaagttgctgaatgtgaaactaacaga

SEQ ID NO: 64227 - DNA, 1922 bp, Homo sapiens
ggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgccgcctgcacgcgcacacacgcacacaccctcgggcgccttggacggggtgcgctggggagccagaagttcggagcgagcgcgggcgggcagagccgccgcctcggagcccggagccggcctgcacccccctgctttcgccgccgccccccggcgccgggtacccccgaggccggcccgggtctgcgcagacttgtgccgctggcggggggttcgctccttcttctcaaagatgaaaaagggcacggtcgtctttgccgcttctccaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtaggaaatactgggggatttgtttgttgattggaagagaaatgatccccgggggggagaaaatctgggtacacttctagtctttgttcgtaacagcaacacttgttttcaaaagtccagagtcccgctttaaagaaagtttaacttctgtgacttttcttctttttaaaaaaataacttttgtatttttaaaaaatcaaagcaatatttttaatgagtcgaaaacaatgaggactcacacctcccctctcatgaaaataaatgaaatccagatcagaattttctttgcttttaaattgccttttttaaaagatttatttaaagttggatagtgtcactatataaaaatatttatgaaacaatgaaataccagccaccagcgtttctcaggaggcttgttaacttcttagaagcaagtggcttcctgtgatttgcagaaatgaaaattgacctcagtgagccctggaaacttagagacagatgatgttccaggagcagggaatgtaaaaaggccatgtttaaaaacagtgcgttggaaggagcccaggtcttgggatagaaaggtctgttaagcctgccacatttcaaaatagtaaaaagaaatactaaaaacactacacgtattgcaaaggagcagaaccttatcagttcacaacaaccacagatttctttctccccgctttccaccttggttgtttttggaagttcaggtggtctgatggcttggggtgcgctggttgcctgcaatggttacctgagtagacatatccctcccttcagggagatgtgatccactgtgtagtcacagccgggagtgggctcctttctctgcaggctgcagtgaatcttgctggtcttctacggataggggcttctctgaggcacagattggggaacagtcttcaggctacgcccggtgcttcaccctttcactgttgggtttgtgccccgcttctgtaaacagcagggtcttcgggtccaagcatatctgaatgcttacaaggactagacttaaatccaacttccttaggaatcttttcctctttagaaggaaatagtagaactaatt

SEQ ID NO: 64228 - DNA, 3149 bp, Homo sapiens
agtagtgaggttttgaattgttgaatttttggggaaaggcttatttttctaatctcactgtttccataaatggtcacagatatttttctttagtgtttctttgtgcaactctatgttgaactctcaggtttcaggttttaaacagttaacaattcttttatttattgttggtataaaaaatgaactgatgataagctatatccattacgggttcttgctgatggtatcaaaatgccaaggtagactattttatttttactttaatggtaaatattatttgatctgcagttttaggggaatattagaacttttttttttaaaaacgagcttgaaacaaaaccagtatgacactttgctttgacaatatgggtaaagaaaattatagggaagaatctgtaaattcctcctctgtgtgatcctttataaagtaatgaactgcggggaacatgcctgagagagattattggagggttggagggttttttttcttttcttttcccaaaacaaaaaccaggactcaccatgacatatacttaattaaatttaatttaaagggggaggacatcccaatttagtttgagccagactgataggaatttctcactgagaggcttttccttgccttgtggtacaatgtgtgcccaggccccagcagcaaactaattacacataagggcgggtttgggagggcagcctggggggagtcggcttcctcctccctttcccatttcctctctccccccacttactttatacagcaggaattatatattagtatactcacttgggagactggagtccccttttatttagaaaaaggaacaaataagtcataaggaaaaaaatgttcgagtttttttccctgcttgagcttcagcagtttataaacaattttgtgttttgttggttcttagaatacagagcaacaattatgagggcatttcttaacgggaacgtttgggaagaatatacttttatcatcggtgtttagatcatatttgtccttacattttcagcagaaaagtatataatacgaacagtttaaagcatgtagatcccaaatattaaatagacttttgaagaaatgagctgtgacattaacaatattttaaggttggttgcttcagaaatggattgatctctcatacgtggtggtcatacaagagcctgggcatttgtgggattacttttctctctaatctcatgtgttatgtgttaattgtgagcataattatgctgcctgcaaatgaaaattgtgtcttatcactcaaggttggtgcaaataactgtatgtatgatctggtggacttaaaaatgaccatattcacatacagacagtaggtggataacacttttaagctccattttaggcacttgtacccagtagagagattgtgaaagggaaaataaataaatatgaaagctgtgtttagaggtcgaatctgtttagtggtaaaactttagggtctgttttctccaaagactgaagaatgtggccaaaagaagtgtccagatttctctgtagaactgcaagaaaatgcaagccaaccttgttaaatgcgagcgttacagctgcccctttggagtttagtgactggaactgcaaactgctaatgtccaacttttggactcagccagaaaaatatattgtaagcttattcccctttgacaaacctaggctgtgctgctgctgggctgcttggggacagattgatggctggcacaatcttttatagctgcatggtgctttttcttattttataataaggcatagattaccttgtggtatttaagttgcatctagagttgtgtttgaaccacatcagtgatacattttattctttcatattcataaaagtgataaaatcaggtaattcaggtccatcctacgcacttcatattcatggttgagctttttgacagacaccttatttagaccttgttgtattgcaattactttgtacctctgaaatcagggaagttctggggcttccctcttcttgggatagtttgtggagtgctagtatatttggatctaaatacttggagtgtttttctgtgggtttttattttttgtttcaaagctgtgaactcttgagtgtcctcaatctgtaagattctcattatgagcttcgtggtccatatttgaatttggaattgaaatttgaccattttttcaaatacattccagttttgtagtggtacagaatagggtagctttgaaatatgtgttttattttagtcaaagtaaaaatgggatgccctggtgggtgggttttcaggatgatgtttcttacaagggtaggttactcttagcttttaaattctcctttggtccactgattttttgcatagttgagaggattctcaaaaaaatagtttccaatagtccgggagtcttggctaactgtgaaactcactcgtttcctcttcttgattggataatggtagtagtggtggtggtggtggggagtagggggaaggtcctcgtaaaaacctatcttttttctacctttgtggcaggccaagggaagggtgtgttacatgcactacacccaccccgccttgtttaaaactggtctttactatcctaatgcaatgctttctatcctttttcgtgattcacatttgttttgaaggctctgtcctaggatttcattagcagttttaatttgcaggcatgggaccctggaaaatgggcttaaaagaaaaagctggcttattgatgaacaagttaagcatccgtcatctctaatgggaaattctggttgcttttaggcatctgacaggtttagatgtatgtgtaaagtgactgaaacactcttgactgggaatatacaacactgttgttcttactgatacataaactgaaaaactgctgctaatggtgggaaatgttaattatgtgagaacatattgaacttatattctctggcatgaacttttttaaaaaaatgcatcaactgtgctgcttttttttttaataggcacagctttctaattatcataattcagttcagctctgctcttggatggtgttcaagtgcaatctcaatttaacttgaaaggggatttttttttttaaacttggaatgtttaagaaaatttgaaaagttcatccaagaatgttgtctgcttaggtgtgagta

SEQ ID NO: 64229 - DNA, 1474 bp, Homo sapiens
aatcaggttaaatttggccacttcaaattctgaatgtgattttcttccctcaatatttgtgaggcagtgtacctaggaacataggctgaatctttatggaattcactaagatgttcttcattggttttaaagataagcctgcacaaaactaaggtctcacctttcgatccaggggaagcaataaaatgaaccagaaccaccttctctgctcggcattcatttacctcgtgggagtgtagcagttgtttccagatgtgattgtagaggtgtgtgtcacggttactggtgaggggcttgagaatggagttctgtctggctgcttatagaggttttgctttctgagtagcagggatgctcctagaggtcgttgggtggtatgcctggtgttgggaaatgaggggtaggaagggtaatcctgacggctttctggagatgaactgtggataaaccaccctgttgttcattttttccttccttgtctcttcccttcaccttgggcactttgaaatccagatgctcctggttttcacggagctactgcttgccactgagcgtttaaacatttatgggtgctactgtgtgccagggatttagtaattaggaaaaggtggctaatgaacagcgatcagtaaaactcccctgcccggcagagtttacagattagcaaggaaaacaggcatgtacagaggtcatggcaatccagtgggaaagttgtgtgtatggtatttcgtgagttccaaggtaacacatttttaacatgcttgaacatttttgaaattgggatgtgtttgacaatcatggctggccaggtggtggtaatgacccttgatgttgcatgcgctcaccaaagcctgtggagtgaatgcagcggagaggaaaaaaatcccagagtcagtagtgagcattcctaagaatactcttgttgttacagagggtggtagtgtatggacactgatcactctgagaagttactttagcttatgttacccgatttatttagcttgtattttcctttttatgtaggcataagattgatagagagtaaaaagtttcaatatgtataaaataatatttctaagtgataagcattgtgacatcatttgtttcacagtagtacgtctgaaataaaatcctgctgcatcttatcggcagtcatgtcttagggttagtgaaatgttgaaacaacacgtttgcatctctagtcctaaggatctgggaggttatacattgtggatgggtgttgccttgagggttgctttgagggagtggggttttttacacgtttatattttttaggagcatggatttccttatgtaacatcagaataaaggggaaacacactcactggggtaagccctcatgatacatccgaagagctgtgttgccctgtggtaggaactgaggagggctttgcggaggaagtgatgttggagttgggctttgaaggaacagggggattttttccagatgcca

SEQ ID NO: 64230 - DNA, 1680 bp, Homo sapiens
tctgcaagcctcggtgtccccatctataaatttcagttgtgcccactatataccagacacatggtgtggtgaatgctcagtaaatagcaacttcaaatgtcatgttgcataatagatctttaaggattttctgccaagtcaccctggacagtgacccttgaggaacacccaaggctgaggcatttacttagaatctgagccggattcctggtctcaggcaaacagatagaaatctaggagaggctgaggcaagcccataaagcccttgaccattaatcgctttgaaccacacgtcccttattcataaagtggaggaaatccatcagtaaatacgtaatatttgaggtcattccttacccagtatgaattaaatggaaatgcttcaaaaactggatagcatggtgcaacttcatctgtctaaaagaaaaccttttccttagcttcttgcttgaaagccacactcctaacattggggttgggttgtaaaagttcttttgtaagtggttgaatggaactcatcttttcatagcaaaacaatgcttagggtcttcggccttcttgtaaaaccattgcataatcccccctggggtgcagagggcattcagcttcaggtgcggagaagaaaggtacttttgctgccctcattgcacctcttaatacctgctttgggctagctgcttagcttctctgtgcccgcagtttccccatctggaaaatggggatgatgttatctacttggaagagttggagtaaagtttagattaggtaagtgctggctcggtaggctagagctgtaggtgtggctgctgttaaaacctaggccatttgtttctctcagtactgcaagctccagagataaatctttgcccctctcctaagactcgcttcctctgggccttaaatgtcactcaaataataattcacactcatgtgaatgaatggttgcccatctctttagccagtgtatttgcatgtttaagaggatggttgtgaattccagtgcctaactccaggtacttcctgggtagatgagctgagttccttctggaagctggtgatagaaccttgtgttttcgaagtcagctggcttaagctggtcctgctctgctcacattcccagctacacttctgggtgtgtcaatgtccctgtgtttttagatctgggccactcctggtgactggtctgagcagttaagattgctttgtgtgagcctgggccagggaccacctgcattttattgacatcttttccttttgtctcttaagcagtgtatagacatgtgtgctaattaatctggtttcccagttctttaaaaaaattaaaatgaagacttattgagggaggagagtagtctggttgaggagagagacttagattcaggcaggctgacagtggatgaggggagaaaatatatttaaaagcacttattcacaaccctgggagtctactaaaattactgaattacatacttcaaaagggtgaactttatggtatgtgaatcatatctcataaagaaataaaaccctggatctagtcaccacacagaacagcatcttgtcatgctcaccatggtatccccagcactctggctgtcatgtttttcggtgatcgagtgattaaaaactgataatcagacctaataagaagagtttctaccagttggttttagagaggagcca

SEQ ID NO: 64231 - DNA, 3415 bp, Homo sapiens
gcacctaaatagataagccagagaacattgagtggaattttagaaattttaaaagaaattttagtacttttagaactttgcctaaaaccaaaagtaattggaatgacactgctcagttcctggtggttcttttgacaccactgtttagttattttgtgatgtgccttaggcagtgacttcgggcaggagtggaggtgttcagtccagtgtttcagctctgaccaaaacaatggcgtctagactttgttgttgagaactctggtggagaactgttaccttgttggggtggttcactgggagaaggcatttgagggtcctccaagtgctgggtcttggtctctccacttctagctcgtgtggaaggaagtcctggttgggaatcctctgctatggctcttcctgtgaccttaggtaaatcatttgaaaatctttggtttatctttctgggaagatgatgctgtactgcctcttgcccctctagctgttttttgtgctgtgcttttgattaaagagagaaaatgtgtgagcccttaggcagaaaggtcctggaaaacttatcttatcataccatccataaccctcaaagacaggttttgtggaggaggagcagtactgctgagttcacttttagttgtgctcattcctgggcttcttggataggaagggaaggctgacaggccaggttctgtctcaagcccatataagagttgagttgcaattgtagttgaagaaggtgaagctcagagaagtttagtgacctacccaacatcacacagctgcactttaaaaccagttctttatctgtgtgactccacagctgtcaggctaacaaaggactgcacatcaagtcacctatccggttttcttgtggcatttgaagggagttaagatagattgtgacattgaaacaaaggtaggcttctcatttagtgtatttgcccagaaaaatgaggacacaatacttgtgttttcttggtggcccattttactccctcttacaaacatatggctaaggtcttgaaaagttgggtgtgtctcagttgagcctttcagagattacttatcctgccccattcacctctcccctgtggtttcagtcctccaggactgtggggaccagtacccctcacccccgtgactggttatactcaccgttgagagagagggggcaggactcctccgggccaggctaatccaaactattctctaggtgggtgtagtgggtagggggactgctgtagtttggaagtttggaactggacctgccagtttatctggttttgctttggaatgtgctgtgttggcaggcaggcagaataagttagccccctccatcaccctgtaggcctggatatggaaatggcctcatgctggggatagggtttaggcagatgaccttgacttcactttttgagaatgggagtgcttgggaacctgctgagatggggtgaatttctctcttcccacccaggtgaccagcttagcctgtgataggtgatgggcagtgatgggggcagctggcagaagagagttaactgtgcttgcccagagcccttcataatcaggactctgaaaaagacactgggtctttgaaatggggttgtttacagggttgatacccctctttgacaccttggttggtttttggtgggaggcagtggggctggttgatacaatcttttcctcctgtctacctgtttctggtgtctctcagctaaaaggtgtgtgatcactgattgccagtttttaggactctgtgctcatgactttccccgcttcccaacttgcttgtaccttcttagtcttcatgcatttcttaaattcttcctaggtggttctgttggctgttttggtgttgtcctaactgtgcagttcttactagtgcttggtgtattcagtaaggtagccggaaagcatggcttggaggtcagatcttggttgcagccccagttctgcctattggctgtgtgattttgagtaagtgattaactctatctcggcttcttgtttcctcctctgcaaaatggagaaaataatagtacttctccacatgtgagtttaaatgaaatatagcgaatgacccactgtcagcctctctgttggttcccccaacccattgagaagtctcttgcttcctccactctccagtttctcagttcagggtcctgaggttttcctcccgaataacataggctggtctgactgggggtcatttatttgccttttcgtcttcctcctttgggtttagttttaagctttgccccagcttcccctcttgctggatttcctgctttgttgtttttctgtttttttttttgttgttgtttatttgtttgttttgtttttaaatttttagtttgacaggctatttcccttttgttttcatattttctgttgtctctccctcctccctggaaaacacatccacccttcctgcctccacttttcaccctttctcctctgctcttatcactttaagatctcagagactctaccctgcagttcactacatttcaccaaaaatggtcatcagaaaagcaccacttctgctctctttaacactggattgaatctgttggcttatagagttcccagcactcttgatagttgttactattttggaataacataactcattctcatccgcattatgcttatgaacttgtggaatgacacaggtttccttcacttatctgtttgaccttgggcaacctctttatccttctgaagcacagtttcctaacccctgaaatggacatagaagtgccttccttatgggttatagtgcaggttcagtgagggtgagcacagtgctgactcgcggagaagtgtctcataaatgttagctgctgctgctaattatgattgtgactaccatcatccagcagctgtgaagtagagtgccaagtacctcttctgtagcatctgtctctctttttgaaggagggggtcaggagcagaatcttatttttattttagattttcagtgtctttgctttgggaaagtttagtacagtagagggcaattgaacccctgtgcacccattatcacccagcagcaatcatcacctcatggctattcttgtaaactcctggctcctctcccaccagattatttggaagcaatcctagttgtcataccgtttcatctgtaaattagtacatattttaaaaatatgactctttttaaaaaaaaacaaccaactattgataccgtgatcacaccagcactgtaataactccttaatgttggccgggcacggtggctcactcctgtaatcccagcactttgggaggccgaggtgggcggatcatgaggtcaggagatcgagaccatcctggctaacatagtgaaaccccgtctctactaaaaaatacaaaaaattagccaggcgtggtggcggccgcctgtagt

SEQ ID NO: 64232 - DNA, 7100 bp, Homo sapiens
acacaatgtacagtgtcactttttctgtgatgttagtgccattgattgatgatctctgcctgtatctattatttcatgtagtttttgcaaactggtggttctctgatactctagttctgtttttggagacaggtctcactcactgtgtcacccaagctagagtgcagtgatgcgatcccggcttgccgtagccttgacttcccgggctcaggtgatcctctgacctcagcctcctaaatagctgggactgtcagtgcgccaccatgcctggctagttttttagttttttgtagagacagggtttcatcactcaggctggtctgaaactcctgggctcaagcgatctgctcacctcggcttcccaaattgctgagattacaggcgtgagccatctcacccaacccattcctctttttatggagaaggtttctcttagcaactatatggttaacctagcatatagtttgtaaaggaaagatagtttttttttgttttgcatatcattaggcaatcactgattttaaattattgaatgcgtttcagtccattgcagttcctcctcttactgatgctcaaattgtttcatctttggccagtgggaatttctttagttggctcctgtggccttttgatgtgaccctattaatagtcttttatagtttccttgctgtccaacctcttgtgtattctgggagatagaatgaaccatttctgcagagtttgggttccttttagtgagaaatggagtttctaggctatgatgtgtgtgctaggttctctgctttttttctcctcccactccttcagttgaataatctgctcacctttggaaatggatcctgcctgccatgtcaactctaatcgtggtaaaagctttccttgcacacttgctcatgcctggcctctttggctctcatttgccactttcatgcttgtgcttgtcatcttgtcctttcctcccttaagaaaaagaccaaactgaagaattaccatggatggtttgtggtttgacttgcctcctgaaggccaaagctcatgttaatgtaggcttcacagaagtctttagtcattgccttcatcatgtctgcctgatagtttgttctattccttgtatacataaccaggacatgagagattccttatcttattaccaccgtgagccattcaggctgcaagctgtatttcgatggtattgttgggtacgtttgtactcatctgtttcaataaatattgattgaattaagctttgtacttcttctccaaagtgtttaaaatagaatgtatttaatgtcctagtcatttaaagaatttatcactagtctattatttttataagcttaaataagttaaagatttgtagttttagatagatttatgcattggatccctagttgtaacatagctattgttttagtgctgcgggcctatagtagtaggcctgcaagtctaagatgagtgttttttatttaacaagtctgctattaaacttatttttagtattataatttctgtctttgcttcttggaaattgttttatgcccatgttggtgcatcatagactatgcacttaggccaaccaccccccagtccccccagcaaagcagggctcattttaaagacacgctctaatgctttcttcagagtttccattcagacctacagttttagcttcagtaatacttttttgttttgttggtgaaacaaagctgtatgcgttcacagtgcagccaacacagtctcatgacggcacaagtgaatagtcctgaaattatcatcattctccacaccactgagaagttaaccagcatcctggcctgggaaattttggatacacatttaatgcccctcacccaccaccccggcttttttttctttttaaagccgcaagcttaatgtaatggttcctctgtattaaaggaaagtacagtattgtaggggtttatttcccccccgcccccgctttcctccgtgggcactgagagtagggggaagagccccgtaattcacaaggcaggcttctgtgccccgcggtaaactcagtttcacaaagggaattttcattatggtcctgtggctccctaacatagtggaggcttcaggaggcaagtggtaaaagctaccaaagaaaaagctggactggagccactgacgtcatgtcagtaaatctgctggaggagcccagccatgcagcgcctgccagccggcccctgcactttggccttgcctggtcaactgttcttactgcttcctccacccccaccccacagaacagcctgtgttttttgtgttcttttcccccttttccttctgtgcaactgggctgtgttgaaacccataaaggcttttgaaaaccacccctactggtcctgtgcttaatgtcttgtgtggggatagtggggagaacccaacaatccatgaatgagggaggctttaaaagttttttctagtggggacctctttgtgatgaataaatccacagggaacatcatggaaagcagccagaggtgcgagcccctggtgcttagtacttttaaagaacttcgcttttaagtcctgggctgtgtgcacatgtgtgtgtgcgtgtgtgcatgcgcacagtaaaggacagagaaggccagtcagcacatgggtggaaatacagaatttcagccttctagcagaggatgatttaagagaatgagttccaatgcgagtcctttattacccattaatcattggtctgctcactctgaactctggtttgcaactggaacagttaaatcttaagctacatgcttctgtacatcctggatatttagagtcacaaccccagatgggcctgaattaaaatattgctgtgctaaatctatttttacatctaggggaatgacatctaaaaataaaccttatcccacctgttatccacttttgggaagttgaaacgctgttaagtcgcagcccatggattaagctttgatgacggcttcccatgtgatgcctgcattccacttttcctgccactggcatgatgttttcattgtttcggtaaccgttgtcctcctgtttattttgctgtgaatattcatttgcaaataagagtgaagcataggttcagactggttttgattttcctgaatcttagggtcagaaacatattaaaagcagtatcttatccatgaatcatgagatgagtcagttcctgaaaccactacaagcctcatagttcttggctacaagcaaaggcaggaaatccaggcttcaataacttcctttcccagtcctggctatagccgcgttggtggttaggttctgctgcctgcctttgtaagcggtaggaagatgtatgtctgaggaacaaaggcacttgagtcaatttactgaaactgtttataatttgtggtcttgatctgaatgtcaggctgcgttggcacaccctgctctgctgtgcggcccggcacaactcagccaggaaaggcggcaggctgagtccggggaagtgccccagcaaacacatggcaaatgtttcaaggggctttagtgttccagtgaatcctaaaactaggggacatgcaagccgacactaggcagaaagctctggattccatatgtatagttgaagtatcgactctttgtttgttcttcacttgagagaaaggagagaaaaaagagagagaggggagagagacgagagaacaaactaacacactcgccagcctgccaagctctggcctgtctcttgcttttacttgcagtttacttccttatatacagggtcctctttttttttttttccttttgcagtgtttcacgccagtcttcctgacttcagaatcagttttataactgttttattaaatattttaaagagtaagggagaaacacgaagttgtctcccaatgttgggtctgctgtgactcgtatttatttttctcctttatgagcagtgcccactttgtgtacgtacccaagtcagagcagagttgggttggtgtttctgtgtgaagttgggactcactgttgctttgtgctttacttgtgaatttatgagctttttcaatcttgagaaaaattaaaattgagtgtgactcattttcatttaccaactcttaccttctttttctacgctaattggtgttagctagcgtgggatttgagaaaatgggactgaaatgagacccttctcccccctactgtaggtttatatggagtcattggaagttctgatagaagtctaaaaatagcatgggtagacaaaccctgtgaaaagacactgaggaagatggaaaaaaatttgagatgatgagcagttagatattgatgctaccttttaaattgagcttgtttccaattcatagctggcaatagctcagaaaggtcaaattctatttcagcctttgtaaagaataaaataaaagcaaatgcaaaagtttgcctggctttttaatcaagtgtggctaattcagcgcacagccaggctggcgagggccacttcgttcttacttgtcgtttgtattttgtgtttgggtaattttctgttcaacttcaggcctcactaaaaggctctgataagctgttgagaaagtcgggctcattttgattttagaggcttgactgagagtcataatttctggctgtggttctccagatttcaggctggtacaaaaactccttagtcttaggtgagtttctttggaaatcactgtgaaaatatattactctcattaacatgtaaatagtcactgtctaaacttggaggagatttttccttatgttaagagaggtacaaatccagttatttttatttgtccttcattgatctgacagttaacttctttttcatgtagatttcaggctgggattagagactgaatcttgaattgcttatcgtctctagaccaagttgttcggggccagggattgattaattaattaaaatcaatgtaaatggatttgtaagcctcctgtaacagattatcctattagcaaccacacagagcacagcccatgatctgtgaggaatgtttgttgccttaagtgaaatggacccagactgatggactctttggggttactttatgaaaaacccagtggcttttgtaaggaaggggcctcacttaacctttacactgaacagatatttcctatagatggcagattattttattttctgagcctgccccagaaggcttgagttctgtttgtgtgttgtgtgagtttctactgtgcctgtgtctccccaacccttgcattcatgccgtccaagaccttgccatattttagccaggttctgccccctttcaggtgagattcctgctaagaactcttctctgaagaaaaaaggaggaaccagaaatacattcctatttgatagcaacaaagtggttttttcctccaacccaggcaaccaacaagcaagcaagctacaaagaagacagttgcttgttatttgaggctctgactgtacagctgtgcctccttagagtggttaagaagacaagatgatactttaggaaaactttgtggatttaacaaaggtcggagttcattcagtggctgtcatgtacattgtgtgtgtttttttgttttgtttttgtttcgtaattgtgttggacaggtagatactttctatagtaggaccagctcacccaccttttcttggatcaaagtggggctatctgagccaagttgagttaaactctgtctcctgcctcttttgggattgagatagcaatcccagtttgtctttgatgctcacactgtagttcagggagaccctaactggggagtagatgtttgacccatgggtatagagaagtgtggaataaagccactttgcagagagacaaggaaacacagttgtgctgaggacgagacaagagaccaagggaatagtctcatttcctgatggttttctatttcctggtttccatctcttgtgagggttggctgcagtttctgattcaggggtcttcagatggacgccttggccttataatgaactcgtattcccttaccgttttttcctaccttaggttagtgggagtgggtttctgttaattgaaaccaaatggtgtttggccgactagtttgttgggaaatacaccctgcgtgctgtcctagggaggccccgttcagcaaagggagctccatttggttacatgtgccttctgcttggtcagccatgcagggctgctcccctcagcagatagagctgtcctggaccctgtgctctcctgtgtattgggtttgagggaactgactccggttcctggactgtctagctaactggggaacaagaagggctacccacttccaccctgtctcagactggaacatttcaaggcttgacttagtcctttctgctgcctggtgtgccctgtggatttaggctgtgtggtgctaggttcaagcatggcaggtgaggaattttcccagtcgtgcctgggggcactgaagagttctggttggctgagcacggggaaagcaagccaggtgtgtcattagacctgagtgtcctgcctggtggtaccacccctccctgcccgcccatccctgagcaatgtggaaggcatgctgtcagtggcctttggcaagtgcttccctgtgataaatctgaaaaataaaaagtgcacaggtgagtacttcctctgttagggaatctcgaaaatcagaggattttattagcaaatggattatatagcaaatgcctttctcaaggagaccagtatggttggggacccaaaggggtggtgtcagaataaaagcctgcccagaagggggtgcggtggcagtgtcaataagcagggaggaaatttagatgagacttgagaattttagataacagagtaaaaattattttagaggatagatttttttggggaggaaaacccctacaagtacattagcagatgtacatacatgcaatattagtttgttggcatcttctacaaatttgaagccatttttacttgaggctcaatataacatgttttacttgttttgttggtgaagtttggtttgtatatttaggaagtggaaatatggaaactctgtgctttaaattgagaggggtacagtgaaagaaggggggtatgtagaaagttctcagaatagagggctgg

SEQ ID NO: 64233 - DNA, 1187 bp, Homo sapiens
catacatgttttattatccacatgttgaattaattactgtagctctataatgtgtatacctacctatttctcattactcttcttttaaagatttttttttccctagcttttctcatcggtttatttaatgaattgtagaaaccgcttgtctggttaaaaaaattccagaagctgtttttactggagttgtattacatttgtagaatagtttacctcattctgttttttaaatagttttaccttttctaaattatatacaccaatagtacttcagagcatttttcagttagagtcatgccagcctttgcaatggaattttgaaacttatatcttctgtggggttattcatagagactttccacttattctgtatcactgcatcctgtttatttctctcaataaaactagtgtatctgatttactcactagattataagcctcacaagggaagtttccatgtctctttatttaccagtgtaattgctcagtgtctagaaaacctctggtacatagatgcccaatacatatttgttgaatgaatgaaatttcggtaaccagagactctagcattgcagttgaagatcgatgacatgtcgaattgtttggatttggatcccagtttgaattcagtgcaccttttgagattattgtgcagtcttttgggggaagtgttccttctctgccattgaattgaggatggacctgggaatgttttggtctatgagacttgacagttggtgtgaattcattgtgaaagtggagactgatgacccagcacaggcgttgtcaacccacacattatttgggaaataatgctgtgaatcaaatcccacaactttgattcaacagcatctcccttttaggtcattctggtattaatttttcttttaattaggaaaaataaaatatttctgcaaagaactttgtacctttttttctataattagagatcccttagataaattagcatcacccatttaagcccttttgttttaggcacaaatacccaacctgtgtgctacttatggacaggaatggaatcttcattcatttttataactcttaacaactttggactttttcttccataactagagatcccttagataaattagcatcatccatttaaacccttttgttttaggtacaaatacccaacctgtgtgcactttatggacaggaataga

SEQ ID NO: 64234 - DNA, 1832 bp, Homo sapiens
ttttctttctttaaataaaggcttcctctggttatcagctttaaaactattgaaagtcagccaaaaaagttggttgaagggaaaaggcactattctggagtgtcttaaattttagtcactatatgttgggggtgattagggcttttacttttccagaacctgtagcaaacaacaaaacaaaaacttagacgtcaagcctaaattttgcctttcttttgatcttggaaattggagttttggaaaaccaagcagggtaggcttaattaaaggagatgctgttatcttgaagtcttacctgagtgaaggggaaagttgagtaatcggaagggtcatgccggtgggttttcactgtctttagtttccaaaagatgctatgaaatttcagttcattgtttgcgagtgtctgtgttgggtggtggggattcagagaagaaaaactgcaggctagtgggaaaagggagttgtgttaaggggaccattccagtctaaaatggtgagtgatgtacgggaggtgtggggctcaccagataagagactttaagagacttagagctgggagtcctgagttccttttgaagctaaaataaataaaaattatatagggaatagaagctgctggtcattatgatctcctggactacactgggcataaaaaagatgactttctataagaaattctatccaaagagtggcaggattatgcaggaaatgtcatttggttatagccgaaggcaaactgatgcagagctgcctgccacagcactcgcaggctgcttgtctcatccccagccctctctggctggctccagggccctttgatctgctcacagactgtgtaaatggagagctgaaggagatagagccaactgatgttacttttctgtgtactccctttatccatggtgtgcccagaaatggtcagtttccctctcagcactcaggggccgccccttgaaccagatcctctctgcattcaacccttggtgccatggcaggctcaggtgtcagtggtcctaggctggtatcaggccacagcggtgcagggtaagaatgttggaaattgaccctgcgtgttactatctgagaacatcgtggacaacgttaagtggagtttgtctctctggctcactgtccagaccagtccctcgacaccactccctctttatagcttcatgacttccatctgtagaatgctttatgtcttaaatgtaccgtagccaagttcatggtcttatttgagcctcaggacaatgccgagagtagaaggataagaatcgttagccccattttagagatagaagaattgaggctcagagaaatgcacctgggtgtgcatttctgtcttcactgagtgcttttgtggctgagcggctcctccagcagcactgcctttcttcaggctgcaggcttccgtgaaacatttccctttcccttccatgttctcccaaatcagttacttccttcccattccctggaagctacttccgtccttctctcgcccggattactctggcagcctctcaggtaatcttccaatgccattgtgtctcagcaggttaattaatttgctgcatcatcatcaccatcattatccgataatgcacttacatagccattcttgtgaactggcactgttcttattgctttgtgattcatttaattttcacaataattctgtgaaggaggtagtaatatcagcctcatttaatgaggaactggaggcacagagaagttaagtaccttgtccaaaactgcacagttcttaggagccacagctgggattcaagcccaggcctgccggctccaggttacttgttctgagccactacatc

SEQ ID NO: 64235 - DNA, 1045 bp, Homo sapiens
agggtattgctacactgtcaaaaataaaatacagtgaaatttatgctaatgaaaacatacaccgtgtgtatgcccaactctgtgctttgcaaagtagacattcaatggctatctctggaatgactggattaatgaatgagtgagtggatgattgaatggaaagagactccatcctctgggaaggaaagaagaatggaatgggcttgacagccatactactcttaaagctgaacttgttgcttggctggaaggagggatgaggcaggagctaagctgacagaagcactcagggaattcgcatatcctctttcttgtgatttctgttttagggaaccaacaggtctttggtaccatctcccatttttccagaccacaagcttttatcttgttcttcagaatcctagaattttgccaccaagtttcagcctaaaggaaaatacacttgtagcatgcaagttctcacctcaaaacctgcgtgaaaatagtcggtgtcattgtagagtgatgcagtgcagaaaggggcctgggatgcttcacccggagaatgaaagtcccaaatctggatcccatttgctcttaccatccaccttgataggagtgtgggtgtggcacctgtcaccattctgcttgcatttgtgtgagtttatgccaggcaaacatgagtaaaaccaattccttccaacacttgacacatagataagtgaagaaaattttatcttacattgtgaacacaatggcaggtaagattgcaggaatgatggtttgtgtacaagctattaataaaagttgtgtgttgcatatacaaactttgctttattgtagatggccttttagttcggtgctatacatgtaatattcaaagtgtacattatattaccatgttgtctttttacttttatgagttatttgtaatgtggataataattcttagttcacatcacattttgctgaccactcaaggaaaagttgaactacaaatatttcaaatgaggtgataaattactgttgggttcttaattgtctgacaaagaaactccattgttct

SEQ ID NO: 64236 - DNA, 1037 bp, Homo sapiens
tttatgaaaataatgtgacagatatcattgggcatctactgtgtgccagggatacaaggatgaataagatgtggctcctgttattcagagttcacagtgaagtcaggagtatagttataccagtaaatgatggttaaactgggtgataagtgcaaatagagggcggtacagtacacacagtgagaatagagtggtgctggtaattcatttatttaataaagagggagcatctttattataatttatttaatcaagagcaagcactggccagacactgttgtaggcactgggatgacactgttgtaggcactgggacagcagtgaacaagcaggtaaggtcctgttctcatggagcttctgttcagcaagagagagaaatagacatgtcatgaagagcgtgaccggtgtgaagatgaagaggaggataatggcaggtgggttgttgtgacacgtgagttagggagagtagctcttcaggaggaggaatgatggtatgtagaggaggagagagtgagtgctagcgtctcctggaaggggatggaagagatggagatggcattgcaggcagagggcccagctggtacaaaggcacagacataggatatctgggaggcccccgccattttgggtttacagcaagttggggatggtgtttttaggactgtactgtgaataccatgtttaggagcttggattgatctgttggtgactggctggcctgctggactttaaattgggaagagatatgattggactggtggtttaggaagttccctctgactctgagactggattgaaagagaaagacgagagtcagggtagtcactggggaggccactgcagcggctcgggaagaggtgatcaggccgtggaagagaggtggaatgaagaaattagaatgtgcaggactgggtgattataagccatagaaatcctggctagagcaggagttggaagagattgaggtagtaatgacataattcatatttgttcatttaaatccaggtttgtctaatgccactttaagatgttctctt

SEQ ID NO: 64237 - DNA, 1274 bp, Homo sapiens
acaagttaacagctgtagcaatgaagcaagtgtggggtccctcaggaggttctgctcctcttacaaagtcactgtcctgattgctggtccctgactcttggttaggctgtatcaagcttcctgatctcatcttttatttctcagggttgaatgtgcagagcctgcctctctcttctctactcctcttctccaggtcctctgcacctctttcttcatgaaagctcctcagtccagtcctaggcactcagggagtgtccatttctgggcccacttggataatttgcatcttttgagggacattctccataacagtccccaaccttatggggcagtctttttgaagtatttcttcatggagtcacccttgtcctcaaatatctccctcttctctgtccgtctgcccgtccatccatccatccatccaataatttgagcttcttattggagcaaatcactgttcttagtactcaggatataaaaataaattgccaagggactctcagttttcttcctaccactctgactatggcctctggaatctttgctggcattgcctcttcctgtgagaaccactgacattttatgtgcacctacacagcttcacctgctatctgtgtgctgctgtcggtgcatgatgaccgccatcccagctctgcaatttaccttgctgtgtggcttcaggcatgttccctaaactctgttgctgccctcagttggtaaaatggaaatgatagtgtacttatttgaaaagttgctttgcagattaagttaaataatgcatgtgaagtgcttggcacattggctggaacagattaagtacttaaatgttattaccaccaccgccatcactactgttagtattgctgctatcactaccattctttctgcccttgggaaatatatcaatcacgtgagaataatagggagtaaaatgagagaccagacttttatctgggtgagaataaatcaaatccagtatctttgggattgatatgcaagcattatggggcaattttgaattgacaattgagaggggagcctgtgggaagacttcattagggataagtgagtcttaaatagtacttgggcctgaattgataaagaagaggcatcaagtttagacccaagctaagttggaaaggtctttagccttctgtctagtaggagggttctcgggttggtgaccaggtacttctcaggtgaacacggtggggcctgtgcatttgtttgtttgtttatttatttattttgagatagtctttctccattgcctg

SEQ ID NO: 64238 - DNA, 1459 bp, Homo sapiens
aacctcagcctcccaagtagctgggactacaggcatgtgcaaccatgcctggctaatatttttattttttgtagagatgaggtcttgtcatgttgcccaggatagtctcaaacacttggactcaagtggttttcctgcctcagcctcccaaagtgctgggattataggcatgagccattgtgcctgtcctggggctgtgcatttaatgtgaggctcctcaaacccgtgcccacattggggattgtctctagatttatttaatatgctgcatgtttataattatgcctgagtgttttcagatgtctaaaatgcaaatctattcaaaacattactaaacattgtattagtttgttggctcttagtcattagatattaaaagtaggacttctattacatgggtggcctgtagaacattttggtgttagaaggggttcccaaacttgaaaaagtcaggaaccacagaatttgcctgataaaaccagaagcagatcctggcagcattctagctggagggtacaacccaattaaaatggctgtgtaataaagcgatcttatatctcataggacaaaaagtccagaggtacagtgatgctagggttagttagagcagcgtctcagtgacctcataggacctggttgttcgccttttccactccgccgtcctttgcgtgtcagctctctcctctcatgttcagcaaatggctgcagcagctcccggcatcacatctccatactaatgtcccaatatatttgttcctggcctcacttctctcagtaaggaaagctttccaattactggccagccttcagacttttccctcatgcctcactttgatgaatggcctaacttgcacattcctagatgaaatagggcctagggagtggaattcccacacacaggtcagggatcccagtggaagagggaacgtgtagattgaatcaggattctgccttcaagaaaggtggggtggagtatttgggtaggcaagaatatctgggcaggcaggaactcgggaggctgccaggcagttcatcagggcggtagctgggagaaggttcccaagcagtcacatccagggctgctctttggctaaggggcagaagcctcccaagcagtggccccagggagtctcctggcacaaggagaagtggaaaggtcttagagtgggatgataggatctgcaccctgtctttgtccccagcagctctgggccatttatcctctgtatagtgctctggggagagactgcaaatgcttcttttggcttttcttttttttgagacggggtctcattctgttgcccaggctggagtgcggtggtggaccacacctggctaatttttgtagtttttatagagacaaggtttcaccatgttgttttggctttgttaaatgagagcccactgtgtcctggcctaggcactgaagatatagtgaaagacaaataggcatggactc

SEQ ID NO: 64239 - DNA, 1631 bp, Homo sapiens
gaacagatctgggatctcatcctgtctccacatctcctaaacctggtcatctcctcagtaaatggatgctgttcctacaggggagggaagaagaacgcaagaggggaagactccttcctgagtgcacaccatgcactgagccaggtgcttctacactcgctgttcctcaagaaacctcatgcaggcagccttgaataggtcatccggtaacatccctttcctcatcagcctgccttgctaggtgggtaatgctgagagatatggttggaaagacccaggcagagtataggatagagactctagggctaggttttggtccatgctaaaaaataacatacaaattggtttcccaaattcctgatggattatttgaatgtgagttgagtcgctgcatatataccctgtgatttctctctctttctttttttttttttttcacaaaaatacactataaccgcaaaaaagacagtcaaacaaaagagggaaaaaattcatccagaactagctcagtaccctaacacaactgttttcattttaacttttagcccttgtctgtatgcaggcatgtttctctgtatctgtaatcatatgtaggctcaattttgtattctgctcttttcagtaaaccttaagtaaatgctttccaaatggttatgtagtcttcaagatgatttttaatgatcttacaatctatcatcccacaggctgaatttacttaaccattcatctactgttggacatctagatttttttttttctgtagttctgtgctattataagtaatactttgggatatggccttgtgcttattgtggattttttccttagggtgaattcccaggagcaggatttctgggttaaagggcacaattatttttttggctctcaatggatattgctaaattgctttccaaaagggttgtaccagtttatgatgccaccagcagtgcgtgaaggtaccaatttcagcatcttggcttgcactagatagtataatttttacaaaagtttggctcaatggtgcacatcgtttaattgatatttcttggattatgacaaggttgagtatggctttacttactatgttttgagattttacttagtatttttgttttcttacagtcaggacctagctgtggttgaggtcagattttctgtgtagagcttttcagactcttgaattttacagcgaaaaaacaaaccaaactaacaaaaaccaaacccagaattcatctgtaaaataaatactttggacatattttgtggttggattaactgttcgtgattttaacttccttataggtcataagttaatagggcggtatttggagagtagcggggcttttcctcttctccttagattctcctttgttctttccctctaccatccccccatttcctgtttccctcctcccctgtaagccctgttgttgtctttttggagataaaacataaaaggatcagcttttagtcatgctccttcaacttataaaatgtaggttgcctaaattatgtagtacagagtgaggataaagaaaatcacagtattgtaacacattgcctgtaactgctttgcaaaagcaaacgtctcccacgaaatcttagaaaggtgtgtttgagggtgtaatctt

SEQ ID NO: 64240 - DNA, 1803 bp, Homo sapiens
cagagcaacttccagttctgcaagcttcatttatgggaagtgccctatgcaggtgtaccattttaatcttttataccatatttttactgtaccttttctatgtgtagctatgtttagatacacaaatacttaccattgagttacaattgcctacagtattcagtatagtaatatgccgtacagatctgtattctagaaacaataggctataactgtaccaaatagcctagatgtgtagtaggatataccatgtaggtttgtgtaactgtgctctgtgatgttgatgtacgatgacgaaattgactgacaacacattttgttaagcaacatgtgactgcacataaacacctgtgcattcataggcaatcacaactgcatatactgaaacacacaaacacaccgccatatatatttttaaagaatttgaaagatctaagatgatattaaatgtagtttagtttacttttgtgttgatcaagtgttactaagctgtaattaatttagtaaaggaaattaaaatggggatgtggggaaaatgtgactctgcctaattgacaagaatctggggccgtccagaaaagcattagggccaggcagaagttgaaacctttgggaagtctggcccaggactttaaaaatgttttttccgggttagaaatactgagggtttccattctaaaggatgaaaaggatcttctcctttctccttagctagccagtagattctgtcttcctcttatgtcctccagttcctttttggttcattcactctgagtctcgtctgaataagcattaggggaagggcttcctggaggattcgagaagggcaaggaagaagtggaaaaaaagaaatcttatcccactgctgtggttctttgtcatccctggtccctgtccttggcagaatcacacagctacaaagtggtggaatgtgtattccaaccagacctctgtgtcatgctccctaccaaactcccaactctttgggctgatctctgcccgccctccttgtcgcctttcctggttcgattttttttttttttttttgggtgcttactgtgtgctatgcactgttctggattccggggttatagctgtgaccaaggcagacgtatgcttgacatatgttaaccatgaggcatgtatcccctggtcccaccaccactctgctccccatgatttctatacatatatctttctatcacaacagttactgggttgcattagagttatctcttggtgtatctgcctctctcactggactgtgaaatctttgagggaggagttagttacttttcttcatctctccatcacagaaccctgcctgaagttggctgcatgcttgtttaaggctaattgaacaaatgcttgcatgccttttatgacacacaactaaattgtgagcaatccaggtacctaccacttctgtgtctcagttggtccgacagaactagtacataataggccatgttttatcctccagctagacatctagagaagtaaataagccttcaagtgcttcatcactatgtgtgaattgtgaagaaaaacttttattaaaacgttaatatgattgtgacaattgtttactctggcaagtagtttgcctcttggattcctctctgtgaatctgcccataatgtcctgaaattccaaatgggtccttttctcttcctctcatttactatttctattcaaaactggaatatgtggacatgtgtacagccttttaagaccaaaggctttacgttttctagctttttgttttgttttgtttttgtcattgccctacctagaacaaac

SEQ ID NO: 64241 - DNA, 1930 bp, Homo sapiens
aattgctcagttacattattgttgtatcttatcttacctagcccaagttaaaacttctcagagtcagactgtgtgtttatacatccctatctttgcagttcacataagtccttaataaggatggtatgactaaaatcaatgaaagactaagcaaaaaaaaaaaaaagtaatcatctcaggtcctcagatatcttttacctgtgatatttcttggtgaatgagtaagactcaagaccttaggtttgtgcaaggactttgcttactgatggagaattcccagacagctcacaagcaagtgtgtgtcctctacttacaactgtcccttgtcatttcagcattacctgtttggagctgttccgcattgggtttgccctaaagctaaatttaagtcatgttggcagtcttttgtgcttttcagttgcagctctatattctggcagcttacagcttgtggggctcaagtctggatgtgcctagcttatgcatgccttttagtgtcactcttaccatttgcttggtaattggagggaaaaaaagaggaaacattttgctcagtagcaaatcaaaaattcttttctcctatgtgaaacataaaccaagagtaagggtggaggtgtatatagagaagcatcgtaagggtgatgtattagtccatttttacgctgctgataaaggcatacctgagactgggtaacttacaaagaaaaagaggtttaatggactcacagttccatgtggttggggaagcctcacagtcatgtcagaagacaaagggcagcatggcggcaggctagagagaatgagagccaagcaaaaggggaaaccccttatataaaaccgtcggatctcatgagacattcactaccacaagaacagtatgggggaaattgcccccatgattcacttatctccatctgggtccctcccacaacatgtgggaattatgggagctacgattcaagatgagatttgggtgggtacacagccaaaccatatcagatggttaagtaatttatatggcagaaatacatagaataagaaatactgtgcatgtaccagctgccttaaagcatggaaaatggagtaggggaagaaaatcaattactgccccgtaccttctgagctgacccctaagtattgataaaaatttagcatcaataaatatttagcagccttgaagaatgttttctaattttagcccaaagaataggtgtctgacaaattgatcaaattgcaatttaaacttctgttcctgtaaagaagaaaatactcctttgatatcaagagaatttgaagaggtggcgtgtctcagcccttgcatcatgtttgacacctgaatcttagccccgggataccagaaggcaggcacagaactttaactctgtacatgtgtagattctgcaaatcaccttgtccacatataggatctccctttttctagtagaggatgtggcaagaatcttcctgggactcatctgtagttggatgcttttcctttcagtttcagatgaaaaaatctttgaattttctgtatttacttgccttgctaatcactccttaagacagcctggcatgtgggctctgaaaatcagagcagtattccagcccctcccttttcatcagttaattaattaattctatatttattaaaggtgatgtgtgccaagccaggtcctaaagacacactccagtaagacaaggttgctgccttcatggagtttgacactggggagatagacttgttgatgggcagttggcagaggtgctctgatataagggcatggtgctgtggaaacaggcacagggcaactcagcctgacataggtatccaggaaggctccatggaggaagtgatagctctgttgaaatgagaagatggttggaaagatacaaggggtgactctgtgtatgtgtgaagcatctgttggaa

SEQ ID NO: 64242 - DNA, 1325 bp, Homo sapiens
tattaatattacaggtaaaccaatacgagggtggcctgggcatagggtaggcaggacctaactcttctcttatccccagactttagtatttcagtatttttgatgagaatctgattaatgatctgaaagttcctcaaagtctcctgtgatttaagcagatagcttttatccttggggaaccaatataattagtattagaactaggttcatgaatcttaagattatggagttcatctttgtccagcccatctcactatgctttgtagagaataacttagcagaaacagccccctgctaggcatcttggtaattgcttcctaataactgttaatttttggtttcacaactaaaatattagggagtctggtgaatttaagaaatagtgttgaagtgatggcaattgagattttaaaagttgcctgtatgacaaatgaaacagatttaaggtgggggagaaggttacccatgaacggggtggtattgaaaatatttaacagccagtccagaagggcattggcacagtagaaactacactgcaggccccttgatttgccggacacctatccttgttgaatagtgaggagaccttgggacactacgaaggggacagagcattcactggggctttggagcactgactctttacacgctgttatggaagtatttcagtattttaaacaaccagtatagttgtaccagtcgggtactggaggtggtgtgggagagtgtctgaaactggcaggtgttcagaggtgttgatagattcttcacttgtcatctttaattcattgctgagaaaactttagttgcgctaggccagattatccccaaaggcgtttggacagtgtcacattagaatttagggctatttagaaagcactgagacatgtcctttttttcagaaaatactgtgtatacagtgtgagaggcgcacagcctctgtcttcatgaggtccccagtctatcggtggccttgaaatttttctgctctttgactgtaggctaggaatctgtccttgagaaatgattacaaggatgtttgctacaacagtgaaaagttgggcaaaatctaaatgtccaagcatgagaaaagagctaaataatagcatatccaccccccagaatattatgtacctcttaaaaatcacagacacagagaagttttcaggactcaggaactatttctgactgtgaaatgttaggtgggcaataaaaacctaaagctgtaaggaataattagtgtaagaaaggacatcaaaatgcatgggtagcactgattattatttgatggtggaatatgggtaaagttaattttctttgtggat

SEQ ID NO: 64243 - DNA, 1049 bp, Homo sapiens
atcaataccctcctaactccctacagtgattgaagttaactttatttgaaatatccaggctgggccagagcacatcaagctagcagcattcttgcacgagagtagcacgggaatgaactttgatttcattttagggaagaagaaaaaataatgaataaatgctttttattagccttttccctccccttgaagtcctacctcttctacataaacctaattagcttcgacatgtttggatttagttttgagaaaattaaagctgagtaatattaggaatttgttcagtgggaatacttgttaaaaccttcattgacccaaatctgacttataaatggtattaaataagcaaactaaagaaaacttcatccccgtcttgtcctaaaataatatttttaaaagcatatttagagttaagtataatataaatatgttaccctgattaggtactaaatgaggtactgaagaagctgtagtggcggtattgagtgtagttatgaatttaatgttcttttcttaaaaaccaagtcctctttgacacatgttcaaaggtcttccttttttttcttctcctgagctgctctttctcacctctggggcacttccctcctacacttggcccgcatgcgtggtttaggcaggcccactgttatttttgtggtaacctgacactgggcccagcgcagccccctggctcttgtgggaggtgaactggctgagagccaggctgcgttctcccaggatgagctgctgctgaagcaggctgggctgagggctgtgggcaggctgcagcaggggctgggatgccacagaccaggcgggctgggggttcaccagtgaagacctcagactgtgcggctcagcaggtggcaggtcctgcctgaggttaaagaaaggtggagttggttgttgaggccacagaccaggtagtcagggtgtttggaaacctgaggaaggttttgaggccagtgagtctcttttatctcactctgtggttctagtctaaggtatgcctgaggctgtccttgtaattccttagacaaggatgaatt

SEQ ID NO: 64244 - DNA, 1049 bp, Homo sapiens
actgaaaatacttttgatttaaaagttcagattccagatatataacattctctgttcttcaccctttatcttcccaagtagacagacagacagacagacacacacacgtacaccttcaggagttgctcacacactcctggtgtttctggtgttttcgtgctttttgtatgaaacagtccacctttcgtcatggcctatgaggccccctgtgattgactcagcttacattttcagcctctgctctagcctttctactttcttgcttggctctctcttccccacatctcctccactaatacttggcctgtgagtctggattagcctttcagaccagcctaaatgccacctccctgagaaactctcattgatccgagagacagaataaactcctccatcagcaccctattgattcctccattgcatcaggtgacatatttattcacctgttcatattcacccattgactcattatttccggcaaccattcagtcctgttttttggggagcagttgccatgtgctaggcattctgctgaatgccaaacatagaaaaatgactgggctgggtgaggtggttcatgcctgtagtcccagcacttcgggaagctgaggcaggagaatcgcttgaggccagcagtttgaaatgagcctgggcaacatagtgaggccaaaaaaccgaaataattagctgggcatggtagcatgtgcctgtagtcccagctacttgggaggctgaggcaggaggatggcttgagccctggaggctgaggctgcagtgagctgtgatcatgccactgtatgtactccaacctgactcaaaaaaaaaaaaaaaaaaggaaaaattactaaaggcatgggcccaaaccttaaagatctcacaaatcctcaaaggtgagagacgcataaacaaatcattcctatgcggtgagtgagttcagttcatttgtactggctggcaaaggtgctacctgtgggaacacagaggagtggggaaaggccaggtcaggcttcccagtggaggggcttgaagtcttgcaggtatgtgtactt

SEQ ID NO: 64245 - DNA, 1047 bp, Homo sapiens
tgcttgttgaggacagggaatgtggtatctttatctccatatccagtgcttgggacatatggctgaagggacaggggtgggaggggctctcagtaaatgcttttaccacattaaattgaaacagataattagaaaacagaaactttccctttcatatttataccctatcatgtttcagaatcattttaaggcagcatgcaagactgtaaaatagcataaatagaaggtgggagaaagaatggagaaaaagaagaggatagaggtgaagactaaatgtggacttaggaatgaaaccaaacttgccgaccaaaaccacctctgagcactctctgaggggcctgccagtgtggctcagtgcactttggtggctactgagtaaaggaaaggccaatggcttgaccacgaggtaaaaaacacattgtgttttgtttgctgtagaactttcctttgggatctttgtaaagatcagtctgtgtgacgtgatgagcagcgtcttccacatccttgcattcactctagagacaaatcccattggctgtttcttctaataacccttcatatgctgatggcagcacatcaaagcataattcaaaaaaggcaaatgtattcagagctcctggaataatctttctctaaggtaactggaatcagaaaggcactgaaacagggcagttttttttttttttttttttcatttctttctttttttttaaaataatttttattgaagtccaacttacatacagaaaagggcacacacatcatcaatattgagtcccttgtgtttttccatttgaatgcattggcatccagagccattgatctattgatctgcactgacatgaccagaacctcctaagcctccccacgctgccttccagtcagtactcccaaccctaaagggtggttgctaccctgacttctaataacgtagatgaatttcgttagtgtttgaacttggtatgaacggacgcagacagtatagtatatatttctttgtatcttttttttcctcaatattgcgttggtacaattcacccatgttgt

SEQ ID NO: 64246 - DNA, 2070 bp, Homo sapiens
tatcaggtctttgctttggaatggtcagataggatagattgcctgaaactgggtctgtggccttgtccttttgaaggagtccactgataaagaacaacaatgatcagcttgactggtggtagtgacgggagaaaggaaggggcaggatttctgttctcaatggctaacagattcattaaggggatggggtgggctattcccctaaaggctggtaatgcagagtggtcccatcagagctgcatagcatgaaatcaatcagagcttttcttgagctgtcacctgggcaagtacttagggctgatggagcggagaattaatcagggattctcaggagggtaatgctaagtcctctaatgggatgcttagcattggggcttggtgaagagatattggcttgttgatgggattctgttgacacggaagtgatttttgaaaacgagaaggagtaattatccactcctccctgctgaaattagagggaacctgttggcattggcaccaaggctcactggctgctgctgtcgttgtggcacatgttgcctcagttctcagcatcagcattcccattccctgagaattctgccctgtctctgacaatgacatactttctgtgcttccatctcttctgtggttgcctacaaaatccaggctgccaatcttcacttgtatttttctcaggccacttgttagcaaggttggctagtgtcttaaatggtaggaaaataataacacaacccactttacatatgcaaaagcaattaaccattattagtgtctgacattcctctcagctgcccacagcggtgagtcaggatcatcactattcattaggaattaattagactgtccttgatgatatcagtcatctacagagctaagaattcagcactgcctacatcctactgtctagtgagggtatagtgtatttgatattcccatagaatgtgcattctgtttggaaaatgactcctagattgaatctctgttaagtataggactttggacaacttatttaggtctctgaacctcacaaggtggggataatactaaagggggaagtgcagcgattaaataagatcctctaggcagaaactgctggcattatgcctgacacctagttctgggagaaggctgaatttggttttgaggtaccagttcactttggaagtaaagcaccttttttccccccagtctttttgttggaggggagcttttctcctatgagagaaatttggactttgactaagattacagtgaccttcaagccatcaaatgtttggttgagttgtccactataaataccattccaaccatgtgattctctttctagaaaccctgaagtggccctcacttctactgacttctctctcctcctgggctattagaaatcttttctcttagtgctcgtcccgttgccactgtctgtatgctgccctttgctcacctgctcactcaagtttgctttaccatttgtcacctcttcgaatttcttccttggccacctccttggcttctggtctttacaccctggctgctccgcctcccatatctctttccctgtagctgtcaccttttggtaattttcttctccagtcatcaaaagggaaagggaaatggagaaggtaaaatatattgtctcaaaagttaccattctcctcaaaataagatttactgatgataaaagattacctcttaaaggactcaaatcttatttgtccctctaacacagaaggactattagttgccaataattgtgattaagaaattggatcagccacccaactcttcgttatttacactgtgcctggcttacagtctgtctccttgtgtcctcctaatttggcgattttctctgggtctcttactactcattggaaccttggccagagtcaggaatgtgaaagtagctgaaacacttccttttcttgtggaaactttgggtgttaatctcagtcatgttgttatcaaagaatatttgtgttttctggttgttggttcattctttttttattttttatttattaatttttttgagacagagtcttgttctgtcactcagactggagtgca

SEQ ID NO: 64247 - DNA, 1019 bp, Homo sapiens
agtcccttcagccatcccccactgtcctagatcccattccctgctatcctgactgagcactgggcataactactatttatcttaaagtgtggctcctcggagtaaattcatactgctgtgaactgcccagagctcaaggactggcctgtggttttgtgcatgtgtgttgttttggtttgtttttgtctttttttgttgttgtttggtgggtatggtggagaggaagaaggtgggctagccactgctcaaagaattcattcttattctcataatttatctaataaactactttggagcgagaacagactctagagtatagttcagtttgaatttcataagactcttagatcgtaacgaaaaagataatagtttgaattcaaaaggcccacaccgcaggcatagtcaagttcatctggaggtcagtcacaaaatgctttcttgtggcgtaatttataccttcacatttggcaattttgaaagtcctgtgtaaatgtacatatgttggtaagaggtagtaaatattttgctgacaagttctttgaatgatggctcagtagcagcatttaaaggcagacaatcagagggttttttgtgtattttttttttaaatccaggtgctgccaagtctacaaagctggaagggaagaagccaaaagtgcccactagttatagttataccattaattatataatattcatgtgcctcagagtttctgcacctggcatctgttgatatacacaggtgggggaggacaggggcacaggatacagttgggagagagcagggaggaagacagggtgcttgctgtcaggtaacggccctggaatatggagcagtccctggtgccaggtgtggccaccagcacctgcttccctcctgggtgtccgtgttgtaatactgcctggatttgatggggtgagaaggggaggaactgtggccacatgaaaccctccctactcaggcccttggcctcctcttttcgatcaatcctttctctctcatttttgggaggcctttg

SEQ ID NO: 64248 - DNA, 2178 bp, Homo sapiens
gcactcagtaaatggttttcgtatgaatcactgcaaacttgcaactccgagtgagtaccattcttccatataaatttcctctcgtctgtgaagattatccagcttctgcccaccattgcatttctgtgtgggtgcttaatatgatacttagataataaagccacttggatctcaaaattccatattctccagtaggagttatccaagcaaagctggtgactgaaccaaaatcaccactaaagaacttaaccgtgtaacccaaaaccatgtgtatccccaaaaagactgaaataataaaatgaaatgaaaaaagctggtgactgaagaacttgcactagagctagcaagagcattatgtttgtggttaccacatccttatactgtttttggttttctcttctaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaagtggcctggaacactcctttgaaatactacaacctgcagttgtggtaggggatagattgtagctggtcttccagcaagagctgttcattgtatggggttgagtgatatttgtagaattttagtgggtcatccaaaggactcaccctaaactaaaaaggagagtcaataaaggacctttgggaaaaagaaaaggacccctgggcttttcttcttctacatgtgtagtggcattacatcagaagctccaggggtccaggcaggaacataaatagttgcagtggcatgtacagacaccagatggtggggaggaggtcttctgaacacagaccagatcacaaggaaatactgccacttacctctaggtaactgatgtcactaggaatgggggcctggtgctcccgaatcccttgattgcccccagcccccttgaggaagagccagcattctagatgcttatatgaaatctactctttttaaaaagccagcacttttttttttttaaaacaactctgtacaggccagagaaaacatgtatgtgcatgggcttgatcagcctctgaaccaccaatttgctactttgctgccagtttgcagttgaatggtcagacaaggcattagcaccctgggtcactgtcaccatctccccttctttgggggttgccttgaaaggcattctgaaggaaacaccaagagtgccaaggagagagagacctgttaactatttggctctggatgcctagggcagcagcaaggatccacctgccggtctggggcttgcttgctgggtttgggcaccccctaacttccttccataaatgcttccagctgcagacctgtactttttggctgcttaccttttgggaagcagatggcaggtgtagttgcttgaacattctgcttgtctaattgagcacgttgagttgacagagttcgcactgtagctgagtctaaaaagatgcaaacacaaataacctaacctcaaagagaactggctcagtattttacctgaggttgttaacttctcatgggagtgattatttctgaacaattggaagtcttttttgtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcctcttcgtatctggtgaaatggactggggatgaaatatctcagctactatgggaagagtgtttcagggccctagattttctctatgtctggatctttcctggtctcttcatctcagcctggctatttgctttgtgggtcttattttcatacctgaaaat

SEQ ID NO: 64249 - DNA, 1216 bp, Homo sapiens
agagaaaagcattttaatctttgaagcttctttgaagatgattttattatgggtagtgaagggtagccttgggacactaccttgtacaactctcatttgcttacccaaaaatggtttcaatttaaaacaaaggcatagtattagaaatcccaatggggcataaccactgcacttcatttcccacaggaaatactgggaaaggtcctgtcctttcaggaataaggttttggggctgagaacataattcaaagcacaagttaacttttgtcaactccaattttgtattgttctccattgagattttagtttatagacagcagccctggtggatttaaccaatttgcctataattcaattatataaatatttttatgtgaaaataattgtataagagctcttgttggtaattgggtctcagaggcagcaggctaagaagaacaaagagaagctttggatgtgagtagctgtatcaacaatgaacttgaagattttacccttggtcttggtctcagttttcttctgtgtaaaataagatagtaaagtagttgatgatgtccatgggtcctttggactcttccattttgtgatgctatggttttgtttcttgtcactgagcaagagggtcagttttgacaaatgtggtgctgcttgggagcctagcctgtcttgggtacccagtgtaacttaaattctgagtgcttcctgagtgtgcatggttttgatgtatggattcttttctccttaactcagcagcacatttagtgaccgtgttggtggctaacctgatttaaaatgggacagtccttttgagcaagcagcattaggaattttaactcatttggaagaacaatcttactggttgtgggtttttcagcaagtggagtatacagcctgggagagtgtgtatcctaattggggctcagaagatgcgttggatgcactgtcctgcagccacccccacctccaggcagctgccttggggaggaaacatcccccctgaactccctgtctctggtcgacatgaggagctttgcttctactgctaccttggaagggaaccatggtggttaatgggactattggtggtggagactggaccccttaagaggaactgccctggttgactgggagctgcctctgacctgcctgtgacttggaggatgagagacagttgacttgggagtctccctgttgaggccccagccactcgagaact

SEQ ID NO: 64250 - DNA, 6562 bp, Homo sapiens
tttttgtttttacacagctacgtgtgactcttttcctggtagatcatgggagaggagatagatagcaggaggacaagatgagagggaagttcttgatcaacaaacttatccagaattggatttcagaggagcaggctgtagtttaaaacaaaacaaaatagatagcaaaccacgggaacacctgaatttgttacttttgcaactgaaaatcccagtcagatagaccccataatcaaatagggcagggacaggaactaaccttcactggttgcttgctgtagaggcagagaagtatataacacttaacagtctggactctataaataatatgaatcctggccctgcacttctagatatcagatttttatcgagttaccttacttctctgtctcaatttcctcaactgaaaaggaggattagatagatcttactgtgtaggattattagaagaattaaatgaactaattgttatctggaacaccaccaccccctgcaatgtttgaactgtatctagcatatagtgagaggtatgtaagtgcttatgaactgaaaacaaagaagtgctctctgccaagcactatgctaaaggctccacatacaattctgtctaatgctcttaacaatgctttgaagctggtattatcatcctcactgtatagacaggaagctgagtctgagaggggtaaaatggcttgcacatggccaatataaatggtatagctagcaggtttcaaattcagggctgtctgactctacatcttggacttttctactgagcttttgttccttccttggtagagaccgttatacataaatccagtgaatcagtattgagccccagcgcagctgtattccagccctgtgctaggggttgtcagggatactgtagtgaaccagacagacatggtccctgccctcatggagctatctcaagttcatttgcaggaaactgacctgaggtcaggactgtgtgccaaagctttctgagaagtttgagagccctttgaagatggtcaccttccacttagccttttgaagcctattcttggctaccaaggtcgagggcacctggcctgttgctggcaggaagaaatcatctcaaataacatagcggagaggatcccagatcacaagcctggcctcggtagtggccaggaggatgtctggaagattctagtgccctaggatcctataagcagtctgggcagagctgttgcttccagacatcttcctggccactattgactttctccttttgcaagcagatgtcttcaggatccttgcttaggtcagctccaaggaaggaccctttcttactgggataccaggactactggtcagccccagagacctgaattgtgaggaccagcgaagatgagggggagggtgtctctagtcagtcctcccccgctgctgacctgtgccctgcccaccaggacagcataggacttaggattgcatctttctttacttcataggagcagaagtcagaagaggaaagagggctttttaaatgaggtagtggcagaactgacaagggggtatcagaatgagagtgcacacaagtaagtgggagtatgtattgattagtcagtacagcaaagagactgaaacctgtggtcgctacactcctctggatgcagaggactggtcaaaaaattgcagaatcatccttttataagatagtatgttctcataacagctctttgaggatcagggaggtaggctttgtcagtggaggccccagagccctggtgtggaaatggccatagactcccagccctggagggtctccaggccttggcaaagtgttcttctcggagctccatatgaacatcatgtggcatctttgatttcctctttcggacctctgattcagggtgttatttcaagttaattggttagaagcgtgaaacaaacagctatgtggtagaacaggctagaagctcccaaagccgggaccccaccgatcacaggatgtatttcaaggcctggaatatagaaggtgtcagtaatgtttgctgaataaatgcttatgggagatgaattatggttcaaacagagaacgtaggtgattaagcctgtaagccctgagggcctctcctgtgggaggaagtggctagaaaaaaagaaggaaaaaaagaggaagatgtttatttaatgatcttagattgagaaagaagaagccctattttttatgttggcaaatgttagttgaagagatagaaaagatttctgcacaaaatatggacaatagcagagcaagggttaattctggaatgctcagaacagatgagtaatggggaatttttgaaatagtttggttcctgtgagaatagcagggccagcgtcatcagcattttgattgggaagcttaatgtgtggggggtatgcaaaagtgtatgcacaaggtgtgagctcatgtgcaatccgggtacaaagtagctaattaaagatggctcaagaattggtcataagggaggtagaaggaaaagaacatgaaagtattaccaagttatgctttccaacagcttttctgtggcagtggatgagccctgggattcaggaagatgtggattcataaatcatttattgagggcctgcactgtgctttgaatgtgatggggacaacagacataaaataacttaaaaagctgacctgtgtgagcagttaacataccaggcactttcccattgctataggatgtgcgatcttgattattcctcaaaaacaacccaataatataggtactgtaattatgcccattttgctgctgaggaaagtgaggtccagcaaggtcaagttatttgcttgaggtcacatagtaaataagctgtggagctgacatttacaaccaagccagtcaatacaaatgactccaatattgatatggaaggaagtatattctgtactagagatatacctggtttagtagtggagcagcacaaagtgtgatcatttatgattggggaattgacttgtatatgtttgagaatgaaagagagcatgagacagacagacttagctaactttgaactttgggaaaaagatcatgtagcggtttttaaacttattttggattatagattattttggatttccaccccttggagaatctgtggaaagctatggaccctttcccccagaaaaatcacatatttgtatgtagttttaggactgttgcatgtaacttcaggcaagttctggagcacaggttcagacttgccccattggggaaaaggagaagggaagggcattctggctgaaggaacatgtgataaaggcatggaggcctggaagggcacagccctgatgtgcttagaaatgaaaatatctcctgggggaggggtacaggagccagcattgtgtcgttgcgggtccgagtgccatgccaaggtgcctggcactcatcctgggggcagacggaagccattacatttttttcaggagagatgacatgtctcagcctgtgtttgacaaaactagatctgaaggcgtgaagacaagttagatggctgttacagtagtccggtaggagagcctgaggcctgcactaggatgcaggcggtgctggtaggaggagggagtttcagagataaaaccaacagaattggctgatgggatgagatttgtgaaaaagaaggagtttgatttcaggttccacttctggctcattgggaggatggtggtactgttaagcgagatggggagtggaggcaggagaagcaggtttgtagagaagagaggaatgaggagttaagttttgtcatatgcttgatgtactggatgaccatccagatggagatgacctgtaaggagttggaaattcctgcctagagctcagtcagattgaagttgcaggggtagtttggagcctcatcatcagagaagtgatctgataatggcctgtgatgcccaggctcacaatttatcaagggcaaaactggcatggatattaaatggaatgtctgtagcactgggagagtaaagtgattgcctttttcagaaaagggaagacagattagtggttcccaaggctcactatcaacagaaacactcaaagagcttaaaagacaaaacaactactgactaagaatatctgggagtatggcctgggaaactgtatttctaaatgctccctgagtcatttgggtgatcagccaggtttgagagctgctgggctagctgcagtctgggtccaagaagacaggaccacatttttagagtgataaacaagtgagcagagaatgaggctaacatttgaagcagtctttatgaggttttggtgcaggaaatgaatgacgctagtttcattcttcagtttatgttcactttctacctagagggaacattaccatgaccaggtcttcagagagtttgaccatgcatggaaggagacacggtatcctgaagggcagaacaaattaagagaagactttttctaggacaggggagacacttggccatttggttagttggggaaaagaatttatgagttgaggatgtatttgatggagcaaaacccagaagagactttaaagggaaaggagcctcttttcctctgatgcagaatggaggaggatggggggagggccgagagggggcctcattgcttctctcaaatgaaggttattgtgggcttttgaaaagtagagcaagcttagtacagatgtacagtatagatgttatcattgacagacagggatgattaaaagaactactcagcagtgagtattagcagagagtattactttcttttttatttgaaatttttgttgagatactgtagattcacatgcaatggtaagaaataatacccaaagggatcctttatgcatgttgcccatttccccccaatatggttacattttgcaaaactggagtgtaatattgcaacaagcgggatattggcatccacacaacccagtgatacgactcagattttcccagttttacttgaactcgtttgtgtgtgcgtactaagttgtgtacactacttgttgtgtgttagtcttgtgcaggttcatgtctccaccgccacaatcagaatacagaacagctccaacaccacaggacccgggttgcccttctccctaactgctggcaaccaccgatctgtcctctgtttataaaattttgtcatttcaaacatgttatataaatggaatcagactacatgaaccttttgggattggctttttttcaactcagcttaattcccgggagattcatccaggttgtgtgtatcaagtttgttcctttttatcattgagtagtattctgtggtgtgtatgtaccacagtttgtttaaccattctgctgttcaagggcatctgggctgattccagtgttcaggcatttcaaatccactgtgaacatacacgtataggtctttgtatgaaactaagtattcacttacatgggataaatgcccacgagtgtcatttgctggctcatatggtatttgtacattcagtatttttttcttttaaactgcccaagtgttttccagagtagttgtaccactttacattctcacctgcaatctagtttctctgcatcctcaccagcatttggtgtcatcaccattgtttattttcattgtgataggtgtgtaattgatacctcatgtggttttaatttgcatttccttaaagactaacgatgttgaacatcttttcatgtgcttatttgccatctgtatatcctcttcagtgaaatgtctgttcatgtcttttgttcgttttctaattggagggtttatgttgttactgttgtgtttttggaattcttttttctagatacaactcccttttttggatatgtggtttgcaaagattttctccttatctgtagcttatcttttcatcttttctcatgggcaaagcaaaagaacttttagcagagcaaaacttttaacagcgaaagttttaattttgatgaggtcttatttattagtttttccttttgtgagtcatgcttttggtgttgagtctgagaactcattgcctagccctaggtcctgaaaattttctcctgtgtcttgttctaagagtttatagttgtatgttttaaatgtaggtctgtgatgcatattacttgtgagggaacccattgtcatgattctgtgattttctttacaagaaggttattgggtttattcatattttgacagttgttatggcttggtcgtaggagtctaagttgggaaagtgacagggtgaagctggaggggctggtaggccatgaggcatgctgttcagaggctctggtgcatgtaggagaggaggcaggacaggaggctctggtcatgcatgggagaggcagcactgagattagagatggaaagatttcaggggatgagtttcgaggtgtggccacaaatacggtcaactgatgtgaatgtgggcgatggacatgggagatgaggaagcaaggcactgtgaagctcatccacagtgacttgattaatcacttagatgctgaacttcacagtggtaaagtgtgcatttttaaagaaggtaccgaagtaaaccaggtgctgagggatttctttgagga

SEQ ID NO: 64251 - DNA, 1231 bp, Homo sapiens
aaatgatcattattgatggtagtgttctgttggtctctcactaaaggtgctattttagagactgttcaacttgataaatctaaatatagaagtgtgttcgttgggaggatcctagaaaaaaatctggaggaatttacagtctactaatagtggttgccacagggagatgggattataggagactcggtttctattatgtttctgtattaatgggattttttcaatcgcaaacatatgttacttttggaatcagaagaaaaaagataattgtgtcaagtttattttttcctctggttctgagtaaaggatattcattaaagaaaaatgtggaaaatagcaagagttagaaagcaaaccatattgcctgggtccactgtggtgtggtgtttactggcggcggggggttcacccggggaagttacggcagggtcacagtgggcagggaggggtgcaggggtgtttggagagcatctctcccttccacttgtgggtggctgaggtatcaagctcaggggacaggtggtcagagagtggcagtgctagggcgggggaggagaacagggcattcttattataggttttaggacattggtccgggacttcaacaggtgccctggccacttgagtgtgtcagtcagctggcccagctcagagacgcataattccaacattcatgtattatggtaagatggtgatgggagagagaaaggaagacgtccacatccattccttgaatgtgcataggctcacaccgcaaatagaatgaacgggatccacatctctgctgagtatttttcgttcagcttgtacatgagagtagacgtggtttattcctagagggttgggggcttctctctgccagtaatgtttttgatggccatgttatcctttgtaatagattcctggcaagtaatcttgtatttgtgctgcctttggacagaggtgggtagattttagagaacaaaaacactgggtactttacagtgtgctacagattctcatttaattataatttttaattataataaaataaacttgcaatccgaatgtgtttgatcggcttgatagtgacctgctatgcataccctgcagataattctgtctgcctaccttccctttcctcatgtttcagttctagctaaataataaaatcaaatttgttcttcaaagcccatttggatatttattattattattattattattattattattattattattatcatta

SEQ ID NO: 64252 - DNA, 1949 bp, Homo sapiens
ctttgggggaaatatttgtcaccccaaagttttacagcttctggggtaatatttaacatatgttaataagctgagtttttttggccatttacaaaggtcccaattgctcactgtatgcctaccctcttccctgggtctgcctctgtgctctgtgacttgcccgatattttgttgagacgggctttggcaactgtctcttagatgaatggttctattacaaacacagtagcttccatgaccgcttagaagagattgttgtttatgacagcttttattgagagaggtttggtgcatgataatgtcctgataaggacatttgtacctataaagtagccacagccttaaacatatttgattgtcagtaaaatattggggatgatgacatgccagatgtgaggtatcggattgcatgtttattcaactgttactgcaatctctgtactaagatgtgcccttgtattttctgtctcacagcaacacacaaaatgcaatggtgatatgatcctgattatgaaagatgctatttaggttacttggattgtaaaccatgtgtattaggaagcattctctcagtccccatatgtccttagacagcaaccacaaacagttgttaggtgaagggaattgtcaagtgggttgaacatacgcattgtgatagggaccttttgaaatgtatgaatcttagtaaggcctggactgaccagggcaggtgatgtgacagtcaaaataataataatgaatatttgttcttgcaatgaatttttgcaataatgaatatttatgcttgcaatgtgccaggtactgttctgaacacttagcattaacccatttaaaccttctaacaagtcttatgaatagctactattatcttacattacagatgaggaaaccatggcctagagaggtttagtaagttgccctgggtcagattctcatttgattgtaatcgttgattatatttaatcatgaaagtagtggttaagagctcaggctctggggttcctatcctggctccagtcctggatgttcttactgctgcctggctagggtggaagagagttttggttccaggtaaacaatagaaaagaaagaatgggctttcctggtgtctgggataccgttcatcctgttttttgctttgtaaactcctactggtcgttaaaaaacactccatcctctctgaagccttccttaatctccacaggcagagctaatttttccctctcttatgtttccaaagcacatgacttttaactgtccattaaaggcctcatcagactctttttttttttttttttttttaaactgtagtaagcactgtcaggctctgtttctgtgggtctgtacccactgagaactcttcaagggccagtgctgctcagcctccagtatggtccctggcacacattaggcccccaaaaaatgtttgaattagtgaaagttgttggtaataaaattccatcttgtgcctctcaagagttttctttcctacattcttggcatttttatgacatttacaacattttaatgaaacaacaagggcaagaattttgatttcataaataagaaactgaagcacagagaccaggatgttttctgttagattgttttatcttgagaaaccacctggtgaaacaaaacttaggagaattaagtcatttgcaagaccccactcccctgtttacacttttccatcataaccatattgatcttacacctgagatgttgtgaactagagtaatttgttcacagtagtaaagcataatcctagaaaagttagtctttgaccatttcttttccctggtgtatactggacataatatgtttgtaagcttatttgagatgtttctaagtggtaggggtgtgtgtgtgtgtaaatgttacttttttcagatcgactgtgggtttagttttagttgtctgaaaatcacttccaccactgattattc

SEQ ID NO: 64253 - DNA, 1460 bp, Homo sapiens
tggggaacgtgtgggcctgcatgtgctctgggtaagtgggggtaggagagtaggacaagtaacttcccagctgctctcttagacacagagctggagggatctggagagatcagcccagcctcctcagttttcagattggaagctgctgcccagagatgcccttttcccggttccagttctgagggcgagttggcccagcttggttgcagctgctcctgcatggctctttcctcctgtcccacaggtcctgggttccagggcacagaggttgttcccagtttggctggtgcctataatgaccatatcatttaatgttcagactacgacacttcagagaataaatgggggcaatgttaacaatgacaccaggaaaacagaaataaaccttaggcaaaccaggatatataatcttccttcctgtgccttcacttttggctcaattcttattcctatgccaggtgatattccctcatcccctaccgtcctggtcctatggcccacatgactttaggttccgggaacttacagatcttggtctttggaggtttggtctgtggatcttggtatctagaggttagaaacctcagggatctcccatgttggagggtccaggagatggaaaacctgggaataacatcgtgagcatatctctgacaatccatgactattcagaacctagatccaggaactttgattttcagtagctagggtgggtatgtcataatttactaacttagtttttttttccaacatacatttgtctcttgcacgtagcgtaagatggcatgctggtaacatacaaatcacgagagcagcatcctactctgcaaacctgtagccccagatagagctcagcaactcagccatgcaatcttctgccttggaggtggaggggagccaaggccctgggctcctgacaggtgtgtgacggagcagggcatagttacttgtctcccaggtgtccacagtcacagcacagggtgggaggggacatgagcagctgggctttgctgagaccaagccaaatggggatttaggcagagaaggtgttctttatttgagagtagagcaggtggagatgaatgctctgcctggtagctttctcggactgcactggcttgtttttctatctaaagctggcagaacccagaccaccatggatcctcaatgacaaaggccagaggagaggaaatggttcttcactgggtcttctggctgtgtccttggacctctgcctctcccagctgaccagagtggtctggatttgcccattctctcactggagttaggagtaggattgccggacctggcaaatagaagtacgggaggcccagttaaattggaattgcagataaacaaaaagttattttttagtatgagtatatcccatgccgtggttatattttatatagcaactctacttagtaaggactggcctgattttgcttacctctggggca

SEQ ID NO: 64254 - DNA, 3179 bp, Homo sapiens
tgccctacagcccaggacctgcccagggggctcagcgtaacagacccaccttggtggggggctgctgcttccagctgctttgcagcttctgtcaggccagggctgcttgagtccttgctctgctatttaaatctatcactcgttggtgacagctttctgcttaagcagtggcagcatgtatgctacaggtttcagctcattacctctgtagggctgttcctggactgctggctgggggaaaggccagccatacagactgaggcaccagccccaaactctgtattggatgttgctgagcctgggtggagagtggggccgtgctacctacagtgcctgctacctgtccttcagaggacctgtctgcagcagggccagagcctaaggttttgttttctcccagcctgatgggactgtgatacttggacatggacatcaaggagatgtgggctttgccactctgcttaagtgggcctgggcaagtcattttacctcttggggttcattttctctgttaataggtggtgaacttttcaagggtgattaacatgtcatctttatctccatatcccttggacacagtaggtactcagtaaatgatagcttaaatttgtaaaatgggaatgataggacccttatccctaatttgtactgggcagagacaatgaatataattctattaaactttgacaaatgggaataaagtgaaggaacccttgtatttccccaggttcatctcccatatccccagtattaaagaatctcagatgaatggggacttaaaaagttcatttgtgtatctttatttactgattcaaacttttactacctttgccagttgatctaaatagacatctctgtttaagcatcttctgtataaagaaggtgtataaatagtcaagaagcacatgaaaagatacttaacattagccattagggaaatgcaaattaaaaccccagtgagttaccacttcataccctcaggtgactatggtcagaaagacaataacaagtgttggtgaggggggtgaaaaatgggaagacttatgcattgctgatggtaatgtaaaatggtgcagcctctttggaaagcagcctggcagttcctcaaaatgttaaacgtagagcaattctatttctaggtatttacccaagagaaatgaaaacatatgtccacgcaaagacttgtatgcacatattcacattagcattatttttatatgtgcatctgaatgccctcatctccgttatggattggatgttaggacaccctatagaggagatttccagggatagctactcttgtgtttgtcttcttatatggggttcatgcataggaaatgccaagcttttggcctctctcatttataacttccagataacagcctaagtttggtctatgtttaaggaaattcaggagtcttttgcagggcttctgtagaaacctttatcaagtaaaagtatctggtgtttcccaggctttgctctcctgcattccttgtagtcagcagggaaggaccccttgttatgatgtgagttactctcaacatttcaggcttttgaagattaattcctgatctgagggaagattctggcagaactgggatatctctagaatgcactgataagggccttgtcagtttctggggtgggcaggtccttcttatagacggttttgtgactaagatacctgatcagtaggctttttttcctggctgtaactagtgatgggttgcaggtgggtgcgtgtggggatggaacatcttagagttgtctacaaagttaggcatcagagagcatgggtatcatggagagaactttttgattgagatttggggccaatttaagtcagttctctaatattttcttgcatttgagttataagctgttcctataagtaagtgataagggagtagtgggaaaatgcatccttaattaataggcagaataaagctaggtggccataggaaggccataaaaagcccaaggaagcagccctatttatttgtagaacataggtgaaatgtttattatatgcaaaacaagttaaaccaaaacatctaaatgcaccatagtatatgattacagaaacctgaaagatccaggagtaacaataacaaaggaacaaatgaactacacatgaacactaatcttccctggaactaaggataggtgggcacttagaagtgcttctgggatgggaggtcaggctgcagggtgatggacattgggcatgtgcttgggacactccttgaggcacatggagactatttgagatcacctctctgatcagaaagttgtttggtgagtaccaaaataagacaaaaatgagtaagtgtttttaagggagatttccctcaagctgtgtttggtagataactaataactctctgttctgggatattttctctctaggccactgtcattgacctctcaaatgcttgggggtgagaagggtaaagataatataaaaatatcaagaaaaggaaagtaaagggaaaatagtaaaaaaaaaaaaaaaaaaagtcctatatagtcctatgaagaaagttttgacctagatataaaaatataggcaagtctgaaatcttgttgcttttctctttagtttgccttcgttgatataagtctgtttattcatgtctgtatgctaaccgctgacacttaaatgtgaaattgttctcaggactctgctgcattgtcctactagtagaagtcctggttttagaacataaggtctggatatgtacagcctagcttttggatgagcaactctgtgcaagttccccaacctctgttcaacttcaaaataagggcagttatactgaacgcctgtatgggtgctatgaggattacatgagatatatagtaaagctagccaaaaaacattggttatgggccaggtcccaaaatgttacaaaatgagctgggcatggtgactcatacctgtaatcccagtggtttgggcagctgagacaagaggattgtttgatgccaagagtttgagaccagcctgggcaacatagcaagaccccatctctacaaaaaattaaaaaattagccgggaatgatggctcatgactgtagtcagctactcagaggctgaggcaggaggattgcttgagccaggagtttggggctgtagtatgccatgctcacacctgtatagccacctcattcca

SEQ ID NO: 64255 - DNA, 2192 bp, Homo sapiens
tttttacctttcccatagttgcctcctgcacacatgctctgtggttggcccccgttgctgactgctgattggagatgacgtgtacccatcctctagacagtctgtgcttttcctgtctttggagcttccagttccacccccatcagtttttttctgaccactccatcttgccttatttctctctctttccttttgactggaagagtactcatcttttctaacatcttttcataaactgttttgatttcacttatattgatttttaacgtataatgtgctggtgttctatttcctcagttagatcagaaggcccctaaagacagggctccattggtgttaaactgccatcttcaaggtctgggacttgatttctctttttttacctccacaacaaggcactcctctgcacccagtcggaattcagtgcctgtggtcaagtaaatgcatgaaggaagttggaacccgtggtgggtatgtttatttaaatgtgtaaaccaagaatgccttatggtgtgtatgccagaagtgaagttctcatctgtaattaccaatgaagaaaacaccttgtatttacggttgagtttggcaccaaatcagcactggtctttccttccatggtacaaatgttgtaaaactctgaatgctgcgtttccataaaaggagcatgcatttctgtggaggtggtgattgatgttggatgcctttaggcggtgccatcctactcatgagggaagcagtgctgttctaggctcagtccacgaattggtttgccttttctcctttcccaactctgccacctggaaaacaaaacaaaagcaacaacaaaaccccccccaggcattctgcctgctggcaccctgttagaataaaaagattagaacacttggtatctgttcactcactcaggtgaagtttgagatgtcctactgggcttttctatctgtagacccatgaaaatctcattgaagaggtgttgtggaaacatgagaaatacatgtttatcatcatttgtttgtttatttacctacctgtctaccaaattagaaaagttccaggcgtttatctcagtgttttacaaatattaacttgtttaatttaaatttcataaccaccctgagaattgagtggtatgttttcattatcccacttcacagataaggaatctgggcacagagcactgaaggcgcttgttaatagtcacatgcaatctttttcctatttcttggcttccagtaatttttcaggtaactaaatgcctgtgattcccaattaggtgtcgagttctatggcttttatttctataaatcattctggtttctttttatggtcatggctgtacttgtgtttccctctgaaattggcagaagatgagtgtgtgtgtgtcagcgtttttaacacccactaaaaataaatctcctacagtgctttacagtttataattgctttttcagatattatcttccttagtccagcaatgctggtaagaagagttattatttatttccatttaacaaatgaagtaagtggcttagagaggttaagagactgaacatatccttaatgtgattagtaccttggaatttgaacccaagtcctcttaatcctttgctcttccaagctgttacgctgcttgtaaattgggaaaccctatagtctgtttttcttgaagttctttgtttttctaacctccgtcaaaataatgtagtgttttgcttttttttaaacttatatcccaagcctgtatggtagaagatgtgaaagtaggggggttgagaatgcagtttttttgaaagagaggagtttatcagatgccacaagaaatacttttttctgtttttctttgatagcaaaagagtaaaaattttgcaaggcttttcttgatatttttggagtccaggggaataagtgcataatggtaataattaaatacagtttccagtaagggagttttctcaggtttagctgcacaggcttagaaagttgggtgagagaaggctttgaggagagattagaagttggagagcccatctgtcgtgccagtatacaaaaatgtccgtggatgatgactgcttgcacctccagagctagtctcctctaggaaaaatcaacagtcaccagtgcaggagaatgaatgagtcagagctctgggtcctgagccggttttacctcttagctttgtgatcttgcataaa

SEQ ID NO: 64256 - DNA, 1032 bp, Homo sapiens
aattatatattgtggatgtctaattccttttcaaacctagaagtaaagatcatgtaacatatcctagccaatattaaagcaatattattataaaaatgatctctgatgtagaaccactagaattagggccttaggtctacccatattgagtttgccctttttatttgcaaaatgcttgatcccagattgctatgagagatagacataatagtgatctttctgcttttgatagttaggtatcatagttttaagacagcccatggagttttagaaattgtgtctgtgtctacagaatcatgtgtgtgattagataaagattagtaggtacagaaactagctgaagcattgattgatacaccttgtaccttccaaagaattgatctgtttaaatcaagttagttttacagctccgtttgttgcttctctagattgattaggtggttttatgatgtttcttttatttttttcactaggaattttgctgagtatttttaatacctgaattgacagactggtttatcggtgttgggggtctgtgtgagcttctcattagtccatttacaatggcagcactttcatgtttaaatgtagacaaacctgtccctaatatttatggagcctgaggcaaagagtgtcagtggaagctcatgtactctatgttgaaatatttaaaggaaaattcgagttaatacactgttaaataacattttctcacctcctactttgacaaatttactttaataataacttggaacccaggttcaaatttagaggcctgcccccttctcttcccactccagctgtatgttgtaacatgttcatatggatgctgcagattgcacaagcaaaccttcttctccttcctcctgctaacagctgttcccaggccactccttgcagtgaagcatactcacacctgtgacacaatctgcccttttgagaacagattcagggaagtggcctacacagaccttggaagtggaaaagggttattggcttgagagttccaaagtcttgggtccttggtcgatg

SEQ ID NO: 64257 - DNA, 1042 bp, Homo sapiens
tgttaggtgaagtgtcctcttgatcctcaaaggctcctcaccctgggaggaggaggaagatggccagaagaagaccagagcaagaccctctaaagtctagggcccaagttgggccctctggccgaggtctaaggactgtacagaatatggataaaagcatgactaacttccaactgcctttcatacttcagagcttgaaaccgagtagtttcaaccaagtagttgggttggcctaagtagctttgccatttaacctcgtaaatgatctaaacatcaacatagtctgagagttgaataaaaaataagtgaagtagttgttcattgtcaggtcaggtttgaattctctcatacttgaaatccctgcaactgtgaaattgcctgtaggaattgcaggttgtgctaaacaatcaaacgaattggtaggttggctcccataggcaaaatcttgaggctgtttggggcaaaaaaaattacaaaatataactagtaataagtgggatgcaataagaatcaaatgtgatccaattttctggggaagcaaattgcattgcactttgttttattttaaaaaatgatgtgaaaatacagagcatcacagcacagacaaatatcttacaccagttttcacaataaaatccccaaatgtgaaagctctccctttttgcaaaggcactttggaagcaataatgtttgtgtgcatagttgagtttatcagagtatactgattttttatcccatgaggttttcaaggaaagtgcagctggtcaacctttagtgttttctttgccacagggtatagttctgtttctgtccgctcaaatacagtctttcaggaaacgaattctctgtaggataccttaaaatgtctttgtgttgtaacacagggtagggggcagtatgtttaataggttagtgtggatacgtgggtcctgaaatcacagtcctgctttttgctcctggctctgccacttctagttacttgtgtaaccttgagcaagttacttaaccttctctaagtttcagttttctcatcagtaaagtg

SEQ ID NO: 64258 - DNA, 2762 bp, Homo sapiens
tcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaagggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagacatgttaggaagcttgtcacaccgtaagcaagacagccaggaattctgatctcaagtccagccacccctgaccatcgcagagctctgtgtgtgtgtgtgtgtgtgtgtgtgtgtgtgtgtgtgtgtgtgtgtgtgtgtgtgtgtgtgtccccgtccgtcccgagctgtgtgtgtgtgtctgtgtgtgtgtgcacgcgtcccggagcgcacgcacccatcagtgaatgctgcctccacgtgggcaaggcatatgcgtttttctttcattattctcagaaacaggcatccagtgcagaacgggcctgtaatggttgctgactaagtgcttaatggagatgtttctgctgataagcctcagttgaaaagggaaagacgcaggcaagctggccaacatcaaagccgggctttgtttatagataagggtaggtttcattctgtgggttccagagcccctgtccccaaatctcagagggggtgagttttaaacagaaactgtgtttatctcccgcagtgggctggaagacaggcctgctgggactcagaagcttccctccctcccatcctcccttccttcctttttccctttcttcttccctccctcccttcccagatagctagccactgccctcatttataacataacataaataatgctctctctgccccagctgtttccgtttggtttttgttcttcacatattttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagtatagaaattcaacagttttaagggcatttgtgatatatgtgtatgtgttacttatgtgttcttcaggacacagatggggccaaaggacaaattttctgtgttttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttgggcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgccccaggagccccttttcttctgcacgctctttttccaggggatttcagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgactctccagtgctagggacagggatctcaagatgagtaagacctggttcctgctcttaagatgctcatggtttagtggaggggacaaagtgggacacaggtgatgatggcattacaatgagaatgtagagaacctacaactgctgcacccctccctgttcttcaagatgccttctctggccatcagggcagcatgtgcagaggcccgctggtttggaatagtgtttctttccatgtgtgatgcagcgttccctcaaagccgaggcgaggtttatgcacactgcccaattg

SEQ ID NO: 64259 - DNA, 1562 bp, Homo sapiens
catgcgtagcttgaaataattcttctaacacctagaaattagccaattttacttttgaaggagatgagaataaacatttagtggtcagccagacggagaataaatggccagcatttgagattttcctgctcctgtttatggagagagactggcatgtacctaattcccaacttgttgatctgttgtaccctattttaattattttgccagatgtaaacattttcccttttttgtgaacggagtgtttacaccatctatcacatttaatgtattcggtgcctgtgagtgccgacctcttcaaaatttgtcgacttcatcatccgtgtgctgtccagaaatgagatcttgatgccccccaaatgaattatgaaaagcttttcatagtaatataattgatccactgttggccacacttataaaaaaatcaatgttaacgtgttaatatttcatgagtacccacgttgccagctccttgcaatgggaccaaactataaagaatgagaattgtttcacagtagcccagcacatggacagagtgccaagaaagggagttcagggttgacttgaaagtttgaagcgcaacagggccattgaaacacagtcctctgactcatgtcagattgttataattatttaatgcccacaatgcagctttgtccccacggatttatactggagaggtttcttacccacacattgtggttattagctgcaaagaaagcggcgtttgtttataatgacatggggtatatctggatggcaaagaaaacactgcagattctgtcttcttaggaaggaggcaggaatttggcagataacctataggaaattgggagacatgctgtcattacttttcatatatgtgggtggttgcagccaataaccattagacaccttttagttttcacctttgtcccaaactcttgagagaatggaattgcatgcttacttttcatctatatgacgttatacagctggtatgcccagagtgtatctcaacttaatctttttaaatgtgtctcccaaaatccctttctcaaggttctacatcctgcctccatgaaatttggtgtcaccaacattgtcttacagaaccactgttactatttttataaagagtttataaatatgttttgaaaagttctcatgtggctagatctcatcaagggattttttttcagacttgaaaaataaagttaaagaagtaaggctttggggcctccctggggacatgtctggtttggagatcagtggtggtgctaatggccctgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgtgaaattgtccgcaggtacttacaagctggggtgtgcagatgcaatttataattgcaccggaaatacttgta

SEQ ID NO: 64260 - DNA, 1220 bp, Homo sapiens
gctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccaccaagcccggccggtaacaaagtcttaaaagcggtcttattctgtaatacgttggccagttttaaaccatttgcagtaatgcatttaaaagatgttatttcatagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcgttctccttctcacccaaaccatgatctcagatcttaggagttacaggtcagacatgtcacggagcctgtttgagatcagttgtctacgttggtgatgaaattataacaccctaaaagaagactttggagtaggaacttgccagggtcatcagacatggttgggttgagagaggaaatgcgattatacaaaaaacgtagaatacaaagtagtgcttattctgtgatcatggctactgtttcaggggacaggactag

SEQ ID NO: 64261 - DNA, 1751 bp, Homo sapiens
aagtgaacttaaaaagcaattcaaagctagctctaatttaatttataatttttacatctcaagacaacatttttagtagataattgtccagtatttggttttgtttttttgttttttacatatgtcaatttttacttgtcttgcagtttccattcccccagcacatctcatctttgctcatagcagcgaagaagagagagcatctgtcctggttctccttcaccttgctaatcaggctatccccctcagctcttcagggaatgtataatgacaaattagaccttgtaggacttgtgcatggagcttcagggtcttttctaaatggcaaaccaaagtggccaacacttgctagctgtgtgatcttgagtaagttacttgacttctgagctctgatttcttgcctttaaaatgttcccacttcataggtagtggttgattcacaaggttgccatgaatcaacaacgtacctcagtgaggtacctacctgtgagaagtgcctagtccctgaaggcgtttggaagtcatttcccagggcaggtcagatactgaggcttcccaggctgctgtacaggtgggcatgctggggaccttctcagacaccctggcctctttttctttccatctggcacaagagatgctttttctagttgggacatgcaggaggaaagagagagcaggtgcttccttgatgtgaataatttatttttccttcagatcattctgataatgcaccaacctttggatgggaaaaggtgcaaagctgggatatgcactagtgttacatcactggagttatgttggggatatgtccagtgtcagatttttttgtccaaaatcccattagcagaggaaaggaagaagatacatttccttggcaactattatgtcccaggcacagagattacagaggcaggagtgacagttgttgagggatacagtgggtatgagagggagggatgtaaactgaagagttcccatcataaaatgtggtagaatgttcacaaaggctcacctaccctaccccagggagacatttattctaattttgggggagactaagtgattggggctattcacttctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagccgttgtctgcagacttgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagataagagactgttgtgtgaaaattgctgagtgagagctcccactggaggctccttgtcttccaggccattaccagtttactcctagct

SEQ ID NO: 64262 - DNA, 6362 bp, Homo sapiens
tattgctaaatgagagttatcccatgttcatggattggaagactcaatattgttaaatcttcctaaaatgatttgtagattcagtgcaatccttatacaattttagtatgcatctttttaaaaaaaattgtcaagctgtttctaacagtatagaaatgtagatgacctagaataaacaaaacaattcggaaagggaagaaaaaaagattaggggtcttatatttcttagtttcaaaacttactacaaagctatactattcaaatcagtgtgttactggtgtaaggatagacagtggtgtaagcatagataatggtacagaattgagagtctagaaataaaccattacattattgtcaattgatttctctacagaggtaccaaagcaattcaaaagcaattcaattcaatagtcttttcaatgaatagtgctaggacaattggatatccacatgcaaaaaaggtaaatttaaattcttaccgcacacggtacatagaatttaactcaaaatggatcctaggctaaagtgtagaaggttaagctaaatcttttagcacaacataataaaaagtcttcatgaccttgagttaggcaaagagttcttagatattaaactggaagcacagcatgtcaaattacttttcgagaaggtttgctagctcattcagtgggtgaaaatgggtgaaaagtgagcacattatttaactatattctcttgttcctagttaggttgaacatatttttacttaccactcaaaaatattaccactttctgggctcttgtaggtctctgtcacatcttcgaactcaccaaacctttcaggagaaaatagttccttggagaagtacataaagttgtgggactttgtaccttggattacactttccctgtcaactctgggtcctccatagtggggaatccatagtggtttttgtcctgcaaataaaacagtgtgactaagtaattttccagaaatgaacagcagagtgggaaatagacataagtgagagtaatataacaatcacggtgtgataaattagcatgggatttgaaatcaacctgtttgggttcaaatcatggttcacctcttaccggttttgcaaaccttgggtcagttacttaactccatcaaatccttcacttcatctgcaaaatagagataagaaaattccttttctcttagtgttgctttgagcatcaaatgaaaaaatgtgtgtaaatgtttagtgctttgtacctagcatataggaacccattattaagtaatattacagtttggatttcagacctgtgagcttagggctcagactctagaggttcctgaactaggttttcctaggcattgcatgtagagtcttatcttaaaaaagttttaattgaaagattggcagcaaattcttcttgtcacttcagacatgatttcctttggggctcttgtactcccatggtttgaattcatagagtaactcaagggcaatagggaattcctctcaactctctgtctccaagaatacctctgggtgctggagagatgccacttatcaattctgttgttattgtttttagggctgtaagccttctggatagaactcagtggattttcctgagtagtgaagaattaagtgagatgagggaaaagcattgagagtaattatcagcagtggactatgcctgagtttttgttagccctgaacttacatatcctgactttactagtccatgagttcttcatagtcaggaactgtaccttttaattctctgcatctcctaggggctttctcagtgctaagcaaatagtaaatattcatgagatactgggattgtgcccagcattttctgagttttcaaatagatgaagttatagaatcatattcatatcaaaggaagttcctgtgtataatctcatttcattctgtcaacaaccctaggcttggggtgggtgtgttggtgtggatgagaacacttagtatccctattttacaagtaggaaaagtaagacccagataagttaatgacttgctaaaaatgatacagctcttgagagacagcagacatttgaatcccatctactgattctaggtcctatggtcattcctttgctttatgttgcctgttttgcagactgtcaaacgcatcagacacttccagtggtttttcagtgggtttttgtcctagtgacagtccacacatcctgctctcctattatcacatttgcaggaggaagtgagacatcttttgacactggtgatatgggagaaggagaaaaatcctagaatcaaagatacttactccttgcttccctctactcatactctctggaaagaaacgtttagggacttcttgtgttgtgcctgttgtgccaggacagctcaaatggatgcttttgtcacagcccctccacctttagcagaagttgttgtattcctagccaatgcaaaaataaacaagtgagggaaaatgacatttcctggtaatggaaagtagcagttggtgagactttagacaagaagcgggtgttccagccaatgagcagtgaccacagtggagctagttgtcggtttacttggctgaagaatatgtttgcctgcatcctgattgtcaataaagacgtttaaaaaccccagcttgactctggcgggctgagggtgctgccgtgccactgctgcaggatggagctctcttcctggtggagacttgattcacaaggacgctaattattcattcttcctccgtgcagcccgctgaaacaattgctgtgcttgttcggtgcacagtgtggcgtcggacagtcaggcctttttatgtaactgatggcgctgtatgttcatattgttctttatgtacttattttatagcttatgcagcagacattcgagtcaattagcttcttgtcttgcaaactgggcactgctgttctagaaccaagttagaagggtgtgttgagggcgacccgggcagacctctctcctttctttttgtgctgtgtgggttggtttcaagttacagcatttttattggctcttgtttgctgaaccttggtttcaaaagctgatgtttgagttgaatttcttaaagatacagcttttgttttcacaaaactgaagtcaggcaatatgcatagcccttgggagtgtgggttttttttttttttaactgagtgattttttttttttttaaatggtacctattaaccaaaaaatctaagcgaatggtttcctaactcacttttccttaactggcgtcagcatggagtccttgtttcttattgatttgcatttttttttttttctgtatagccttactcctgactcttttgtcctgaattttttttttttttaccccgtatttcttgaaacctgcctgttttggggacaagttggagtttaaataaattagttaaattctgttgtgtatatttctgcagatgataatgtttatgaagcatagattcactgttttgtgaggatttttaaatatcggaaagaaaatttcctgcttcctctttccatctccttttctgtggttttagccccctcgcccttaagagccatcggtttgttattgctgattgaggtagtggtggtggaagcagaggctctgatccagagaaactccccaagacggaagtgcagcaggcaggatttttatccagcggattttgacccagtagaccctaaagaaggtgcatgacagagactcatatttaccataccattgaattctcagagctttccgtggtggctggcccaaggcaattgttcaaaacatacgtgagagaatgaatgaacaaatgaccttgcctaccaaacgtctccctccctctgtgtaagcatcccttaaactctcccaacccaggtggccttgacatatcccatgctcacccaggaccctgaagtatgcctcggagcaactggtttctcctgaccagttagtgtcaactgagactaatgcagaaaacattgcttaccctaatgtttgcctttagaagtaaaatccaaactgaaggaaaggaccttgaatttgttttttattcttgctgacttggaacattgataatgctcatactgatcctctggctaaacatttttcttcctttatccatgtatttattgagctctccactgttagcatgaaaggtggagaagcaggaatacatggtgtgtgcttctgctagccttttactgtccagttgtagagagtaggcccagtgaactcagtcaggtgtttataagattgagcaattgagcagttgctgtatcctgaagactgtatctggtgctttactcttgtataattcttgagacaggaatacctgggtgttggcatcaaggggctgttgaggccatctttatttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagcccccgagccattgggaaatagaggagcttagccttgctaagaggagagaattcagagagccatgaggtgattgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacacgcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttcagttccactgaagcaactgctttggcagacgaagctctctctgcctgaaatttcttactttcttccttctttggttcccatttcaccactccatggttcctcctccaggaagccttccttgtctggttttcttccttctaactctccccagccctgtctaaatcttacccttcttcagagcccatctcaaattttgtttcttccatgaattctttcctatagagcttgtccttctcctgccccctctgccagctgagggctttcttctttccctgaattcccccagtgccctgagctgatcttagatctgccttgtttgccattaattgaggagtacatattccccccaaactccttgagggcagatgctctgccttattgtctttgtgtcttaaaaatcttgctcttgtatagtcaagaaattattgtttgaaatggtttttaaaaatagggttctagaggtgtttttgttgttgttgttgtgttttttgtttgtttgttttaccaaaggaaaatattccacctggctgatatagtgagaccttatctctacaaacaattttaaaaattagccaagtgtggtgacgtgtgcctgtagtcccagctactcaggaggctgaggtgggaggattacttgagcctgggtggcagaggttgcaacaagccgagatcatcatgctgctgtactctagcctggtgacagagtgagacgctgtctcaaaaaaaaaaaaaaaatgtagagtctcagtttgcctataatatttatattgcacaataatacatttacttattttttacttattgaaatatgccacttg

SEQ ID NO: 64263 - DNA, 1100 bp, Homo sapiens
acacacaaaatatattaggttacaggttttttgtttacaattctaagcttctaagctctgttcatttgtatcttcataatttgggggcctatgaaggattgtttatccctaaattgaaagcaagcaaactaacaaaaaatgagatcaaacattgtcagagacggttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacattcttggtaagaccttatttttctcctctttccattaagtttaaggtttccttctgcttcttgcactaatcattaataactatactgttgtcacagctcaaaactttcctattgacacttcagtcatttttaaagatcttgaatgttcaacctctatgaagctaaccttttgcactctattaaaatttaagaaccatttgattctcagtgaatgccccagctactggatcatgaaagcattaccttgtgccaagggcatgatgcagaacactcattcctttttaacaaataagaagaagtttgacttttcatttacacatcctgccaattgctaacaagtttccatctcgttcaaacaccagattgatcctaagaaattgaaaatattgatttaaccctctgtctgatttgtactgcaggcacctgctagtgcagtcttagcacattacaattgcttggctgtaattcctcaggggaccactaataactaccacatctgtcttttcatcttccgaaattatgctagcagttgtccaagtcaattgtgattcatttgatactgctctccttcaagacatattgcaaccaaatagacttgctcaccagtaatatatctgatgacatagttagttcttgttaattgacagaatgattcaggcttttatggatggcattaattggtcccttgtgtccatgcaataattgaccagacagagaaggcagcattttctttcaccaagtcaggagagttttgaggtgagataaatgtagtaagga

SEQ ID NO: 64264 - DNA, 1244 bp, Homo sapiens
gacaattcccaaatattcttttttctcaaaacaatatttttcattccaatttacttattaaaaaaaaaaactgggagccgggcatggtggcttacgcctataatcttagcactttgggaggcagaggccagtggatcacctgaggtcaggagtttgagaccagcctggctaacatagtgaaacaccgtctctactaaaaatacaaaaattagccgggtgtggtaatgcacgcctgtagtcccagctgctcgggaggctgagacaggagaattgcttgaacctgggaagtggaggctgcagtgagtcaagagcgtgacactgtactccagcctcggtgacagagtgagattctgtctcaaaacaaaacaaacaaacaaaaaacaaagctctttttgaagatcacgagcttcagaaagaaatactgcatccactctgtccacatgtttctggcctgtccattcagttaacagttattatgtcccaggtgctaggctgtgtcctggggactgaggtaacagaaattacaggataaagctcctgccgtgtagtagtactttagggagtagtagagatgttggttgggaaagaagtgatgccagaatgtggcgggggttatcagagcaggttcagaacgtaaggagcacgaccagggaatcactaacttcgcgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcggtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaaaaagaccagaaacgaaatcgggccaag

SEQ ID NO: 64265 - DNA, 1051 bp, Homo sapiens
acaaggtctttatggtagtgccgccattgtttttaagaagacaaattttaatccaaggttaaaaacttcacatttgcttatctctttttcctcttaagaactaagagtccagagattagagtaaaatcaccttttcctcatagttttttctttcaacgtgttagaaattcctgtttgaaaaggaaagccagttcctccccctttttatgtttgaggggatgatggtaaaatcacattattcagtcagtttccacatgtgatttgttgcctatattttttaatccagggattaaattgttgccaccaccagcatcaaatcattggggggcaggggtggggaaggtgcgagacagttggttatagacatccaaatatgacgacagaaaaatctccacagcaatatggcagtggagcatttgctgacttcagagtgccagatcaaccccaatatttttttcagggatgctaaacctcttgtaactgctaaattggatttgttactgaatgaagtatcagctgctgttggacaagaccataaaagccagccggctggccctttgtaggcagggcttacccaacgattgatatgttttagcacttttgggattattgtgattaagaggaaaccattctgaatgagtgagcaaagggggtaaggacacacagcccacagctggtgagcagcatgtgttggctccaaggaagtcaccattatggctttctcctggttcctgccctgattgacgtgtatgaaatcttttttttttttttttttttttttggagacagggtctcgcctgtcgcccaggctaaagtgcagtggcgcaatcttggctcactgcaacctctgcctcctggattcaagcaattctctgcctcagcctcctgagtagctgggactacaggcacccactaccatgcccggctaatttttgtatttttagtagacacggggtttcaccatcttggccaggctgttgttgaactcctgacctcaagtgatccaccctcggcctctgaaattgctgggattacaggcatgagccactgt

SEQ ID NO: 64266 - DNA, 1049 bp, Homo sapiens
aaagaggccggcttgccaggtcctgcggagcgcctttccaagcctgtgaaaggcacgaatcatccagcagccgagcatgcttacagctggccctttgctagctttgatctgcgaatcaggccacaccatgaatgcacttattgtcatgttatgtgtacacagtgtgtgaattattgaaaatagggaggcctgagcctcatctggtagagattacagtgcaggcatgctgggcgaaggtctgtaattgaaaatccccagatgctgtttatttggcctttgtcacatgacctgctgcaggaagattgtctgaacaaaatgttgcctgcatggagagtggagcccgccctcccccaccccccagagcctccacaggctcagtctgtgcacagcttaaacacctgcccaaaggatttttaaaggcttaaaatagattcactcatagcatttaaatagagggcatcttgcttgttggtttaaactgcttaagcggttgttgacttgtggaaccttctatccacacaagggtttgctggataatttcactctgagatatctttacaaagcaacattcagggcccgagccacataagtagtttgggctctgcctttttttttttagaagtcaaacttctgtgtggtgaatgagcttgcagataaagctgtgttgactgtatatattccttctgtctgtagaaaatattgtgggtactgagaataaggccctgagttagcatgtctgacttccgtttgtccagttcattcttacctattctgcctataaacaagttgaggtgtttcttagaaaatttgtttttctcaattaaatgctgaatgttatgctctctgtcagtggtggattgaagtaggatactaaatctgaaattgatgaagatcacaagaattaaaaacagggaagattgagctaattttgaagtaagaagggctttaagctttccaggttcattctgttagggaacaaaacagccacatgtcctctttcattgccagtctgtctcagctgtgcttgtggcttcctctttgatttcttg

SEQ ID NO: 64267 - DNA, 1064 bp, Homo sapiens
acaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaaggaaatagcacccaacatgacaggaataaggatttttagagacagaagtgtgtgtagagagtggcaggagaaaagacaaaaactgatttgcccatgtaacgttttaattttttacggatagaatgtgttcatgtgttacctagatcattagaaatttattttattttattttagtttttagagacgggtcttgctctgttggccaggttgttcttgaactcctggcctcaagcagtcctcctgtcttggcctcccaaggtgctaggattataggcgtcagccactgtgcccagcctagaaatttaaaaggagaagaaaaaccaagcagctgtcctgaatctaagctcaactgaggaaggtgattttcttggtttgcttggtcatcatctccagtgggaaccctatatcataggccactgctttctctgtcgtgactagctggtatggggttacctctggctgcttctagttttgagataggtctgatgtggctagggcagtggggtcagtgagccagagcatggcaaccctaggaggaaacatctctgggcacctgtctcaggcccttcctgagtacatctatccatctaatcgttccgtctttgattaccattgtttggcttctagcctcatttctcttcctagaccataaactccttgagggcagagagtgtgtattattccagcgtgtttctcttctagagcctagcctaattccttttgtacagaaaatattctataaattttattgaatgggagaggaaagtgccttggggccagattatgtaggccttggatgcttagagagttgaggctttattcttctgtattgtggatgagaaattagagaactttaaagtgatgtgtgt

SEQ ID NO: 64268 - DNA, 1047 bp, Homo sapiens
catgcctataatcccagcactttcggaggccgaggcgtgtgtatcacctgaggtcaggagttcgagcccagcatgaccagcgtggggaaactctgtctctactaaataacaaacaattagcctggcgtggtggctcatgcctgtaatcccagctactcaggaggctgaggcaggagaacagcttgaacccgggaggcggaggctgcagtgagccaaggtcgtgccattgctctccagcctgggcaacaggagtgaaactccatctcaaaaagagttgaaggaccattttagagccccagaaggtgccagagccttcccattttctgttactaatgcatacagcagccctctagagtaggaactgttatttccattttacaggtaaggaaatagaggtctagagaagttgagcaagtttcccaagttcacacagctcataagtccagtttcctcagaagaatctaggcagtcatacctttgagtcaaaaaaccagaaatcggcagcattgcatcattaaagattcttcattataaactagcggtgtttagcacttcaaatgtgtggatttcacacttctctaaggccaaataattaataaatagagtgcttttagcaaaccttttcattaataagactttcttgggttaatgttaagattagctttttttggaccaggtctctatggctgtggcttggggaagtggcagggacatgggtatagggcatgaagaagcaatgagcatgcattggtcataagagacgagaacaaaggtctgaaaaattgtgccacttctcactgaaatagttgcaactttaaaaggatttacagatttcaggtgatattggcagtgctgtctaattttcataatctttttctagatcttttcttcggattttctttatacaaaagaggtgagctccttcattcatttattaaaaccatttattgagcgagacacggaaagaaaaaaactatttcatgatctcacttatacgtggaatcttaaaaaaaagtcatacatatacagagtagagaaaaaacaaca

SEQ ID NO: 64269 - DNA, 1915 bp, Homo sapiens
ttcatacactccatgtctagcacatgtttcaggcacgtttcaggtgaggtttcttggaggggacatctgagctggacctggaaagattttccttggtggtcttaagggttattgcagctataataccttagcatggcagggtgggttcagggaactggaagcttggtaggtattttgatggtggtaaaatgaattgtggtggtggtcgtggtggtggtgtgtcatgaaaaatagttaggggccagatggtggggacaacactgaacaccatactaaagcagtttattcctttagatgtgggcagtaggagccttggaaggtcttataactgagaactgtgttttaggtagctgtgtagaggatggattagaaagaaaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacagtgttctatggagttgtcacatgataatgttatcagctgccgttgactgatacaaactcctgagaaggtgggacttgagttatcgccagacactcactggcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaagtagtaccagcccctgacaaccctgaatgggcggcctggctgtttctggtgattttccacattggtgctgatttctggtcaatgatttatattgaggattaactgagaacttcctcgttggatatgctgtgggactggttcagaggctgtttttcatgagcctgtccttacacctaatcttagcctgtgccccttctccctccctggctctccatccctctcactctgtcatttactccatcagtctgtagccactgaggacctgctgtgttctcagcactggatgcacagtgatgagcaaaacccagtttatgctctgggctcctgtggacttctctgtctggtagtagaggggtaggcacatgttcatcttatagtctcattcagataaatggaacacagtagctgtgctgtgtgctgtgaccgagaggcgtaggttcctgtgagagcacatgttagggtgatctgaccagttctcatgggttggagttcttccaaacaagacataagcacctccaaggcagagatggcgtgttttctttttctttctttttttagacagggtctcactctgttgtccaggctggagtacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgttccatccacacacagtccatgtgtgaccagtggatgactggccagcttccgtaggcctcctt

SEQ ID NO: 64270 - DNA, 1837 bp, Homo sapiens
agatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactctcctgcctcagccccccgagtagctgggattacaggcatgtgccaccacgcccagcttatttttgtatttttagtagagatggggtttcaccatattggccaggatggtcttgatctcctgactgcgtgatccacctgccttggcctcccaaagtgctgggattacaggcatgagccattgcgcctgaccaggttgttggctttcatatcctaaaatatttttttccttttgatgaaccccagctgatgaaaacagacttcatgggctaagcacagtagttcacgcctgtaatcccagcactttgggaggccaaggcaggaggatcacttgaggctaggagttcgagactagcctgggcagcatagtgagacctctgtctctacaaaaaaaaaatttaagaattagccaggtgtggtgtacctgcctgtggtcccagctacttgggaggctgaggtgggaggatcacttgagcccgggagatcaaggctacagtgagccatgatcatgccactgcactccagcctgggcaacagagctagaccttgtcttaaaaaaaaaaaaaaaggagtggtgggggcatatgactagaaggcagtttagcactgtcttgtagaatcttgcctgagaaatttctttgtaaaccactctccccatgctttgtgctgatgccggcatggggtctcctgtggaagacatctttctttgcttctttccactgggttatcttcttcctttttttttttttttaactttatgttcatgatctggtgccaaattgggactacagggatgtaggagcctcttttctgacctgaagaatgactcggtccataaatgttgagccacctgagaaagggaggcggagaagagatccatgtcattggttcttgttgccaaggactttatgacttggttgcaatcatgacatgtgctgaaatgatatcacataaggcagaaaaaaatacaagttaccagcaaagaagcccaggtcaaaggctgtgaatgtttagggaaaggggaggcctccaccagctggtaggttcatgaaggatgaggccttgggaaggtaggcagattccagacatgcagaaatgggcaaggacagtacaggccatgacagcagttgtgcacccaggtacaaagttcaaggtgttcacaggaaacattcgataatctagtagtactactgggctgagcggggtggggggatatgtagaagacccttgtttgatgtagctttggtctagcagtcaagggaaatgagttttctttctgattttccttgttttaatatggaagaacggggtggagaatcctcacacatccttcccagtgaagggaaagggccagcagatgtttccttagagaagccaagctagagcttcctaggcccagggcagtccagtccttcatgggtgtgagtttgccttaggactggccacggccagggaagagaagcattgcatttgttgcttctttcttggtggctccctgactccattcaattacaaagtggctcttacactgttaaagcttgagtgtctctgggctacaatttctagccacagaccttcatttgctgtgcctcaa

SEQ ID NO: 64271 - DNA, 1059 bp, Homo sapiens
taagttggcatatattgataatttattgtgctccttaaaaatttaatgcagtgtttggctgcattaacagaggtagagtatttaggatgagagaggtaataaactgactctgatgctatagcaggagcactgccacagttctggactccaagctttgaaaggaagacagacaaaggatggtcacaggatggtgtgtgggagtgttccaaagcttgtcagataacaaagtaacacaggaggtttagcttgtgtacaactccaagaggaccccagagctgctgttaatatctgaaaggcagttaaataaataagggactggacttcttgttaagaggaacaggaaggatctggggatgaaagttaaagcagacccccaaaaggagggtcttcttattcttaaatatgttctaagatagaatgggctacttcctcaattttagaagtgctgactaaggcttatgaggactttcaggaatgcgaatggatgacctaggggtactttctagcccccagatttcatgattcctttgccttccagtgatgaccatgtcctgcacagtcccagcactggcaggtggtggacagagccatgactctaggacattctaggcagtgatgagagagtcttcgcaattctcagacaagatttccctaaggacattttgatgttcgtcttcatcagtgtttccagttctttactctgctagggaagatctgggggatatggtcacttcctttcagcagaggctgtgttatttcctcattcattcttttctctgtgcccagcagtgtgctaggtgctagggggacattgaggaagaagacagagttcttcccctcttcaagtatgcagtatatctgggaggaagtaagacaacaaacacaaattttacaactaactataaagttataaatacagttacagtttgggtacatcctaggaagaagtacagtttttgccaccatgggggtgtagaacaaggcaaccaaacctagttgggcaattagagaagacttccccaagggagtgacatccaagtgaggccttgaaggagaaat

SEQ ID NO: 64272 - DNA, 3557 bp, Homo sapiens
tcccagcacttaaggaggccaaggcgggtggatcacctgaggtcgggggttcgagaccagcctgaccaacatggagaaaccctgtctctactaaaaatacaaaattagctgggcgtgatggcgcacgcctgtaatcccagctacttgggatgctgaggcaggagaatcacttgaacctgggaggcagaggttgccatgagccaagatcgtgccattgcactccagcctgggcaacaagagtgaaactctgtcttttttttttttttttttttttaaaaaaaaggataaatttctattcttagatgctggtctaagttcaaatttaaatgcctttcatcttaatttttcctagtaaacatttttgcagacaattgtgctgttttatttttctagtattagtaaacacatagttgtaattttaaaattcttgattctgaattttgttttttgctttcaagggctttgttggtttggtgttttggtaacccacctcatggtaaattcttctttctttcaggtaggaatgaattgatagccagatacatcaaactcaggacaggcaagacgaggaccagaaaacaggtaaaataacccacctggaaattgtgcatgtcagcgaatggcccaaaaaggcattttggctgcagtggctggctatgctttggctcctaggagcccccaatttgagttccctgtaaggacgtcagtgttggaggtattttaaattggctcagttttcactgttcatcatttcagtgaccctttattatgtggtcttacaagttccttttatactcacatgggaaaatgtcactgctaaggacggtgtatgaaccgctcctgtactgtatttcaaagctgacatttctttcccaaaatgtgcacctgtgaacactgcaaaaactgcaagtgcaaatgcacttgcaggtcatgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgagccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagaggtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaatcaccacacagtctgagtcgctgaacttttaaatggaaagttctacatttcggaaaccagtggatctaatcatctacattctgacagtgcgggacctgggctgtctgctggtctgtgagctctggtcatttgcccggtgaccccttcactgagggactcttctaaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtatgaaaagcttagagcagcgctgggggcttgtgtctggctgggactgtgtattcctaactgcagagctttgttgagatgcaaataaccaccccccaaccccaccccaaaaccctcccaaagagtagcgattttatatttgatttccttttttgttttgttttgttttgttttgttttgttttgttttgtttcccctcataaacccgaacaatgtaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactggtgaatgcctggtgctgggattctcgtaacctagtttccttgcatgtgagagctgtttacatttctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgattttttttttttaaccttcagatgtccaccaagcagccatgggctaggaaagcttaaaaaaagaaaagtccagagatgcaaaattgagt

SEQ ID NO: 64273 - DNA, 2747 bp, Homo sapiens
tgataatttttcatatacaacttctttctgctttttccctttataaaatttataataaaacatacctgacttttatttttctgtaatgccctattttagaaatgcaaagagattatagtttgcaaggaggagctttcgtttataataaaaattgattttggcacatattgatggctttcccatgtgcctttttcggttctgttctgatatttttctatacagtaattaaatttgtggttttgttctgaactaaaaaacagtgtagtctcacaacacttgagtggtgagcactgggactcttcccaaagtccttcgacttttttttatgcaaacaaggctggctgtggaataggacaagtgattaggaaggagcatttggtgtgccctctgcagtgggcagcatgctggctcgctcgcacgtgtggctgatggtggctggcttttagctgcactggctgagcagttggaagactaagataactttgtagatcctgctttttaaccaaaggtgcaatactctctatatggatgtaactaccccagtttttgctcaagttctgactctgtttctagtttctctgagctaatgaattaatgatgtacaaagaagtttacagataacaatgttgtttccatctgtgatgatatgaattgctctatttctgcactgtctgtgtggttcctgtggactcaccagggcacacagccttagactgaaagccctataagtgaggaataaagctcttctgttcagaagggattcccatgtgatataggaagcactctttttctcacttggtgaattttagagttttcttccatagaaacaatttttctgttgctttatacatgtacatatgtaaaaatacacagcggtatttatgtttgtttctaaaaaaaaattaacaataataaaaaagaaacattcccctgactttcagccctgggccactctcttttggggcaggcacaaggaagagacagaaacagaagcagtaggatagcaactggctcagcatttaagctccaagaaccacctccgtcttcttgtagtttcttccgttctttcctaccatattgttcttggaaaaatggagtcctttgtttttccatctgctaataccaactgagtgttccaggcatggtgcttgctcactgtgatgggcagttaacagccaatatcctgttcagggagctggccatgtaaatgggaatgtaaactagaggagcactttgggtaatagcgggagcagccaaaatgaaatgtggggtgcatcccggggatgagcttcgtggagagtatactgttaagtttggcaattgaaagaggaaaggcagcctaatgcgtgctccctcatttaagctcactatgaagtgacttacagtattctgcttttggggcatgatactgaggaaactggggctgagagagtataattgactagtcacaaagccttcctagtaagtggtgaagccaggatttgaactcagatctttttgcaccctaaacgaatcattgttttagataaaattttatctagtgaaggtgggagaatgttttcaagcagagggcttcacaccagcacactgtacctaaactgtcacccctcacagtctttggggctgggcattcagcctttgctaccagcccttcacttggcatccacattttaactttgagcccttggtcaaaacgtggacttaatttgggttggtgctgtgagggtcatcagtaactgggggaatgacatggtcctggagacagagctgcttggcaccactctgagggcattaggacagtcgcagagagtgaggctgtctgtcacctgcttgcaggagttggtgctgctttctttcactccctccatgagcattttatctcaaaggcagtatacttaaccttcctaaccagccattaccaggatatgggctcaactctgttgatgtcccagctccatccatacccccttgttcagctctggaatctaatagcacatttgtgaggaggcagggacaagcatctttaccgaggtcatcatggggtcaggctgatagccatggtcttcttggcctcccacactagctagtgagataaactcgctacagataattgaggtcatcccaaaagacaacaaggatagcttctgggtgggtggggagcagaggggagtggcaggaagtatccaagcttaaaagagacactgtgctttgcctgggaagatgtaggaaggcctcctggagcaggtggctggtggctgaccatcccagtaactatccttgcagacactgccctagccaggttggttaccacttctccacaaactcagacgtcgaaggggtagacaaaggtctatggtcctcatgtgaagaccgaaaccagacttgcatttgtctgtccctctgtggagttggaaaagtggcttacccgcaatggaggccactgccagatgtgtcttcctggtgagtcttcttgcttataagcttctctttactttccagggaagggtgtggcagagttctttgggctggtgttttccagcctttttaaagtagcaaaactcatgttttgaattgaagcttactccctcaaatccttagtaatggcctcttaggctattccattgaatcaggtttgaaaagccccctgttttaggcagaaggaaaaggaggtgtctacctcttatgctgtcccttccagcctttacagagagctcctgtgtcccatttaaagcccatgtttttaaatt

SEQ ID NO: 64274 - DNA, 2263 bp, Homo sapiens
ttgagaacctaagtgtgttctaggtccttttgtagacgttgggcacatagaattgaatccagagtttctgttcttgaggaacattgaacttttctgttatttttccagtagatatccacagctagggggctctgcagtagaaattaaacaggatagtgcagaggctgcccaagtgaaaagaatgattcattctgggagtgagggaattaaagcttcatggagaagtgtcattagaactaaacatagttgaaggcagagaatttccataaagttgggactatctgggggaccatgaagagcatcatgtaattggggacatgcggtgggaggtaagactggaggagcctaagggaagggccctcgattatcccactgaggagaagggattcatctgtgggcctaggggcatacatggggttcattcaaatttaccctctggaaagacctcgccagccaggttttgcaggatagctaataagagggaggccaagctggagtcagggaggctaattcctgggctgctttaagagtggggaagagagtcacaggctgggaccaggggccaacccacaccccctggggctgctccgtggcacttagcactcatccttggctggctccctgctttggtgctctctgcctgctctgtagtctttcctactcattgtgtttaaagaataaattataagttctgtccttatgaagtctgaaaagtgttgtgtgccagaacttttcagaaagattttcaatagcagcatttaaaaatcaacttattaaaattgggttctcttaaagtaatggtaattgactaggagtgtgcatcaaaattatgaagtttttgttgcaaaatttaaacagtacagaaaatatattaaacactcatgtttatactatctggaattgatcattttcattatataagttttttttaatgaaaaatcaagtggcaaacattattctgtactttttcctctacccaccctccgtcttcaaccaaaattaatcttcctttctttcctaccacccacaatgtattttcttgccacttacttcccttagaaaatcaaatccagtgaaagctctctcttctcattttgctcctagatttttgcccattgtctttttctttttcttttttttttgagacagagtcttgctttgtcgcccgggcgggagtgcagtggcgccatctcggctcattgcaacctccgcctcccgggttcaagcgattctcctgcctcagcctcccaagtagctgggattacaggcgctcatcacgacactcagctaatttttgtatttttaatagagacggggtttcaccatgttggccaggctggtctcgaactcctgacctcaagtgatgcgcctgcctcagcctcccaaagtgctgggattacagacatgagccactgcgcccagccgatttttgcccaattatctaccatgaatttgtgcaatagccattggcaccaacatgagacttttcctctggaatttttagcagcttaagatagactcggccaacaatttggtgaccttggatacagaccctgactgcagaggagagatacgaggttcaggacatataggggatggttgaactagaaagggaataatgcgaggagacagtgaaccaggagcagagaagctgggagagtagagacaaagcgtcagtagactgaagctgagattcaagagctcggtaagatggaaaaaagaaaaaaaaaaaggcatttgtggccagagcacagtgattttggaaattaaatttatacattcagagttgtggggattttctcccccgccccccccggggttggggcattttcaaaatatctaggacaaggctgggcacggtggctcacgcctgtaatcctagcacttcgggaggccgagatgggcagattgcctgagctcaggagttagagaccagcctgggcaacacggtgaaaccccgtctctactaaaatacaaaaaattagccaggtatggcagtgtgcaccggcagttatagctacttgggaggctggggcaggagggttgcttgaacttgggaggtggaggttgcagtgagccgagattgtactgctgtaccccagcctgggcaacagagcgagactctgtctccaaaaaaaagaaaaagaaaaaatgtctaggacagaagctagagtacaaactgcaggcctagaagagagcttagctttgaaggagttgtttcttagtgatgggagtgctatgtgtttgtctcctactcagacaa

SEQ ID NO: 64275 - DNA, 1022 bp, Homo sapiens
tccagggatttattatcccagcatgtagaaagaatgcagaagcattctccatgtgttaagcagtctttttcctactcagagtttctttgtagagttccatgcaggagtctctttgcctgtatgttcagttgccctaagaagttgttcagaccctgctcagagtccttctttccccattagcagcaaaaaggcagtcctttcttgctgttttcagaagctcacggtagccacagccaaggtctgggaagcaccaccacactgtgggccatctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgctccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatataatctttcctggcatttcccaatcttcagggggagttcttttgcatttatgacat

SEQ ID NO: 64276 - DNA, 1101 bp, Homo sapiens
tgccctccatcctttttccaaaaccataatatagttctgtgatgtttatctgctcaaggggtatggctaataattgcagaggtcatgtggagccacatagtgcaagattagaaagaacatctgcaagattacttcttaggaaagtattttgtgttttgtctttttctgaaaaagtgattgtgcaagcaaattgctgtctttcctcccttgcactatattgctggttaaagcatatttgaagaaaaaccatttaataactatcaagagtttttgaatccatggtcgtttttttgactttactattttttctgacgtatttgatggacttctatatgaataaattacattggaatcctatctttaaattctgaaatcatggcccatgaataaactgtttggaatatattgattatgctgttcattaaaattccatatatggcagctatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccagccatgtgcatttgtgatattgctgtcctcctgtcatgtatattacatgtagatattttccaaacattgtgtccatttcaaccataaaaaggaggcaatcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggtagatgatgagacaggcatcccgagtctcaggtcagttggaccgtttgttcttagaacccatcctctttcccatcaaaagtccatagaccacccatagttcctgctccatgagtgttttctgcattgcaggtcatgggcttgggttggggttcag

SEQ ID NO: 64277 - DNA, 4136 bp, Homo sapiens
aatgaccttgagcatccatgaaaagctgttacttgaggctccttagtttttcagtcacagccagagtaatatataagacataaaaattaatgtggctgggcgtggtggcttacgcctgtaatcccagcactttgggaggccaaggcgggtggatcatctgaggtcgggagttcgagaccagcctggccaacatggtgaaaccccatctctactaaaaagacaaatacaaaaattagccgggcatggtggcatatgcctgtaatcccagctactcaggaggctgaggtaggagaatcacttgaacctgggaagcggaggttgcaatgagctgagatcatgccactgcactccagcccgggcaacaagagtgaaactccatctcaaaaaaaaaaaagaagaaattaatggaagtgttaggctccgttttctttttcccccctcccctccctttccttttttcctcccttcctccttccccttttctccctcccaccctccctttcttccttccttttctccttcattctttttttttctgatggagtcttgctctactgcccaggcttgagtgcagtggcttgatgaacacagctcattgcagccttgacctcccaggttcaaacagtcctcccacctcaggctcttgagtagctggaaccacagaagtacaccaccacacctggctaatttttttttttgtgtgtgtgtgtgtggagacagggtctctctatgtaacccaggctggtcttgaactcctgggcccaagtaatcctcccacctcagcctcacaaagtgctgggattataggtgtgagcagccacacctggtcttcccctttccctttttctttattggctctttttcaaaggttaatgtaagctttttggaaattcacattgtcttcctgacagttatagggcaaagtagtatctacaccctgggaacacctagcacatctttcttagaagcccttagcagttgttcatgagctttgattttttaaaaactcctttggccttgcttttgatgccttgatgtgtttttttcatcacctttggttatatcagtaagcattgaagcaccctctctgctggtacttggtgtcttagcctgaagctccctttgacgttccctggaggtggaaagcactctttttattttgatgtcaccattttgtttttgctttgatggcatttgggcctggaatatagaccctctattggcaccggtagcctttatatgcctacgaggctcaaagccctgcctgtgcccaccgggcctgtctcataccaggaggctatttctctgtctgtcctggggaagccacagaaccagtgcaaaggagttgaggggtagttttttattgttgctgttgttgggtgcccttctcaatcattgcctttctagatagccatctggatcaccttttcttcctaaaatgtgaaaaggcccacacccctatgcattttattgttcccaagtattatatgtttgtgtacatatatacatatgtatatatacacatatatatatgttttttttttaaccaaagaagaaaaaaaatccctttttatgcaatccttttaacaaattgtttattattgtatccaggtaacaagcatggtaagtattttcaccaaactgagtattctgtattttagctgtgcttggcagacttttttggctagctttgtgttgttagccttggctttcctagaaaagacccgttcaggaaaaggagaaaccacgtacctgtagcatcccctaggctcctggcttcagtacgaacccacgtagccttagccccacggcggggatacctgagaaagcatgcaccccgccagcatgctgcttggccctgttacccccaacccccgctgcttctgagcctctccagccaggtgtctgcagggcttccaggccttgcatgaccccagcagctcctgggaccatggccctgtgacagtcaggacacacagatagggctcctcgagctctgtggacggtcctaccccagtccacagctacatctcttctctcactcctcctcccatccgtttgcttaaaagcagggcctttatttttttttcttccttaaatgttttaagtaattggagaaatcttctggaagctgacaagctaaataaatacgttgtccactcttctgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccgggggtaagtcatgagctcagtccagtaatgacagctgctggggttggggttggcatgtgccagtgttaagcctcccacctccatttcttgtcatgtgggtcaggtatgtgagagggcaaaggctaccttgtcaactgataactgagtctaaagtggtgaaagtaaggagggaagggaggcagagagctagagagaaagggagggggaggagaaggaggaggagaggaagaaaagaaaaaaggaaaaggaagagggagaaaatcagaagaggaaggaattctgagtccctgaagacatggaattaaatgtgcctttctgggttgggctcaggcgtcttctctctttatctttttcctggcccttggtctctgtccctctgtcttcaggggcaactagcccctaaagggacaaggtattctattaacatttacattttgacacctaccaaaggctgagaagcattatgttataatctcaatcctccaggtaatcttaaatgctgcttattgtcattgccattttgcagatgaaaaagctgaggttattcagtagcaaaacaagagtttggatagctgggatcatagtggaatggatagtgatgtcaagaatcagccccagggttgcttgactcctgaggctgctctttccctcctctatgtcatgccccctttccagcccacaccaatcgcagcagggaagctcgctgcagagaagctgcctgcattgccgcttggagctcctggccttgttcaagctttgtcctctgccttgctgggtcttcactgctgttgacgcagaatattatgcagggaatgtttcagaatgaagggagggtacatggataaatcagtcagttcaaatattggtgagccccctgcagcacgcgcagatctttgcttaggtgtaaggaaaacaggagctgctgcctgcgtctgcccttgggggcattttcaggaaggaggcgctaaggggagctctgggttgccagtccaaggatataggttgtggtctcgtgcaagtggtgaccgcatttgcactctgggaaagcgattctgttgggtgatcgaacctgctgtcttttagcaggggttgtgatgcgtaggcatcctaaactgtgctttgaagtaaactcgtaattctgaggcctttgcattttgccttccagttctggccgggaatgattcaaacagggcagccaggatcctcacaagagtaagtctgaggaggggtgggcactgacaactacgggctggtcccagcccacgtggggagagctcttcctggaccatagtgtctcagggcctggaggagaaaggagcattacactgaggtcccagaaggcatcccctttttattgtgtacttaggcccctggcaggaaagagactggcttttcggatctgggagaggtggaagcaccccattcccaccttaagtattagcagtcatccagctggaagcaagaagtggacccctcttccttcatggtattgaaggctgagctgtggtcctccttgcctgagaaagggcggcacaggtgatcctctagcccatttcattctagccagccctgta

SEQ ID NO: 64278 - DNA, 1007 bp, Homo sapiens
agctccctcagtccctgcctggcaaggtcgctccattggcacaaccaagcttcgcctggtggaattttcagcttttctcgagcagcagcgagacccagactcggtgagtgtgcccagagaggtgtgtcttgaatccaggatttctttccctttactgtttacctccttgcttctctttctttcctcctttaccccgccccatgcctgacaaatatcctgtgtgaaaacgggcctaggaaagaatagccttttgattaagtaaaaagggattcctattggcagatttgtagaaaacagcagagcaggaggtgtattactgtcctggaccccaaggtgctgtggggaatacttgagtcagagagagggacgtttacaagctcttatgttttgtaaaatttaacaagaagtaacatttattgagccttgccatatgcctggtcccatgcagagttatttagatatatgatcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggccgaggcaggtggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccgtctcaaaaaaaaaaaaaaaagaagaagtaacaaaatggca

SEQ ID NO: 64279 - DNA, 1080 bp, Homo sapiens
tgctgtctgtgtgttgcctgccttaatgtcatttctattatcgggagacagtgtcaagaatgagctaagagcctgtggtagataaccgagatgctgaacaattggaggtgacctctcacgggagtgtttgcacttcagcttgagggaaggcctcccgtggggcagaggggcttgaccagtcatcaccagagtggagaacccacatgtggcccactcatgtctttgtccacaaatcatgaactttgggagctggtggaaaaatagagctgcttccaaattagggggaaaaatgagggaaggaatgtaaattgggcccatcaggacaggtacaagaaaatggggctattcagaccaggaaagagaagaaaaggccaactggatgactccttccaagcagctgagtggctaacaggaagagtgatggtgagggttaaatccgtctaggtggaaggcattaagacaaactgaaagatgccctgcgtgactctgtcctgctggttctttctgggaagcatacatagttctttggttgaaggctgggctttggcccagatgctgcttctgcctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaagtgacttaagattaaacagaaggaaacaggagcccaaatcttgtatttcattgtatccttttcactatcgtaaaagatcacctcccagttttgagggtctcttgaattgtctttttttttttttttttttgagacagcgtctcgctctgttgcccaggctggagtgcagtggtgtgatctccactcactgcaagctctgcctcccgggttcacgccattctcctgcctcagcctcccgagtagctgggactacaggcgcccgccactacgcctggctaattttttttgtatttttagtagagacggggtttcaccgtgttagccagggtggtctcgatctcctgacct

SEQ ID NO: 64280 - DNA, 1317 bp, Homo sapiens
gctgtgaaattattttgcctaacctcagtcactattgttggtgtcgcttctgatattcctatgttacaaacactcattcttcagttgaacacaaatgatttaatatatgcaaatgaatgtggaagtttttttgtttttttttttgtttgttttttttttttttggagacacagagtcttgctctgtcactcaggctggagtgcggtggcgcgatcttggctcactgcaagctccgcctcccaggttcactccattctcctgcctcagcctcccaagtagctgggactacaggcatccaccaccacgcccggctaattttttgtatttttagtgagacagggtttcaccgtgttagccaagatggtctcgatctcctgacctcgtgatctgcccgcctcggcctcccaaagtgctgggattacaggcgtgaaccaccgtgcccggccgcagattgttaataggatctatatttgattttagtggacatgtgagggcctgaaggttggttcttgtgctagagggaaaaagtggtggctgaccagttgaagtgatggagaattaataaaattatttaaagcatttgacagtatcttaagtaccagcctctcaagttatatactgtgtgctttattggacaaacacaacgtgctattacaatcaaggtataatggtacttcagggctaaggttacactgaaaaatttgtatcatgtagatagtttctttggctcttagagtttttgtgacttctcagactttaattttgctatagttttgttccaacaacagaaacattaaggccatctaagataaactcagctgatacattttaacaaatttgggcatacagtacttaaaatataacatccagcattaaccacattaatttgataagcgaacaaagtgaccaataattaaagggccctaagtaagttaaactttgcatttgaattctctagatgtttgttacagacagacatgtacatatgtttccccctacttctttgtaacggcttaggctcattagacccaaggggttataaaatatttttagtagagaagagaacttataggtagtgctggcaaaaaaagaaattatgtagccaggttccatgctatttgtcattagtgacttctttcatctttattgagctctgtgaggtaggttattctattcccttctacagaagaggcttggagagatgctgccttacagtagccagctttgcaccccagcctgcctgtagcatctcttaagacaagataagacatgattgctggctgggtgtgatggctcacgcctgtaatcccagcactt

SEQ ID NO: 64281 - DNA, 1006 bp, Homo sapiens
agaggaggaagcaggattgctaagaactgacttgatgataatgcttttgcctttcattctcaaaataagcttgttgaaatacctattagagacaggaaagctcagagagtttaagtaacttcatctgggacctggctaatagatggcagggttgactatttgaactttgtctgaatttcacagtgtatgagaaaatgacacttaccccactatctgggaaaatgggaagggcagggattgttctccattcacagatggacatttgatttgggctccaggacaggagagagttcctgaagggtcacctgggcttggtgatggcagcccctcagccagaaggaagggagttttgctgcctggtgttctggcccttatctttattccaaggggctggacctcctggacgtggatgtgggagttagcagtcttcatagtcagagggagcccaaggtctcccctctgggggactggcaggcctgtggttgagcccgcatggaaggtctgtaaatatatcctgcagataacatgattctttctcgtaaaggcagttggtcaaacgtgggcccaaggatgatttaatttcacatttttatacttctttcaatggcctaaatttacagatcaactaaaattccgttgtcagaacacagatcctttcttggtttggaaaatgtgaccaggacagctctaaggaaatatgacattaatgaggcctgtggaagaaagaagagggggatggctgtgcatgggggattaggttggagacacaagataaaaagcaaggtttcagccgggcgcagtggttcatgcctgtaaacccagcactttgggaggccaagcaaggcgtgtgggtcacctgaggtcaggcattcaagaccagcctggccaacatggtgaatcccccgcttctacaaaaatacaaaaattagctgggcatgatggtgggtgcctgtaatcccagctactcgggaggctgaggcaggagatttgcttgaacctgggaagc

SEQ ID NO: 64282 - DNA, 3235 bp, Homo sapiens
acccagatcccatctgacaccacagtccaggtgttcatcactcctcactgcaggctccctaagcagcaaagaacagcagggaccaggaaacaaagtgacccatagagcagctttgaaggaagacgaaagtcctttattaaccccccccgggtatctcagaagccctttgcaagtgaatggttgactttcgagggttgcattcacctttattattatttgcaactgctatgaagaataactggagggattatagcaaaacaaagagaaaatggacatttctccaagtcaaaatagaaatccacatattaagatggcatcaggtactgcgtggcatccttgatccaggtagggttttactggtgcaacatctttttggtgaaccctacctgcagacaagcgtcccagctcctgtccagctgtcctgagcgtttgagctgtaggaaagctttgcagtctgacccgagctcctttaaagcccaaggaacttgtggctaacacagagtaaacatcctgaagtaatgttttttgcttccttttatggttctttcccttcctcagaaaaactccataatctttcaagatagtttttgattggtggtttatttaataaaataattgtataagccagattgaagcacgtggcccataggaaaagcagtattctgctccttcatggctcctcaccttccagttctactttttggggaccattgcttgcagccttttcagccatttctttgtattaatatatttacctccacatttctaaataacatgcttatattgtatatctcattctattaattttaggcatcatctgttgacttcttaacatagaagactacgatttagttctctaaatttagtatatgcccccctccgtcttcctttcagtccccctatgtgcttttctctaaatttagtatatgcccccctccgtcttcctttcagtcaccctatgtgcttatatcacattaaaaaaaattagcattcagttaattttacaaacccatataaattttgcacacagcgtggttaatgttatatattggaaccatttccttaattgtaaaacgtttttttctggggtgtatggttgtcttcttaaaaaattgttcagttttacatagctacaccaattcaccctcaaagtttcgaggagaactcatactcttctccagatggtgagatataaatcaggtccgctctcttggtgacatccttccaggagtcctcagctccacggatccactctggactggttgctgacctggctggtttctttacctttcttctatgttaggccccatctctttttaaaacgtattccatccttttgtaggaacataccctcctatagctccctgggaacaagttgcaaggaaggtcagttttctgataccttaaatatctgaaagagtattctactttcatgtgtaatggataatttgatgttcattatggtttttgccttggacttgtgaaactttattcatgttttctaggtgatttccacatattttctccttgctaatgaacaatatgtttaatgctggagaataaggtcattcttataaaaagagcaggtaaatgctaatttagttcatgtgatatgtagaagtggtgttgactgtctttattatccccatcttctctgtaggaatttatgagaacatatatttatttgggaaagatagaattctaagtatcgaggtaataagcttgctctgtacagtcactctgtaggttctatgaagatgagcactttgttgttagctcatggattcctggtgtctagcacagtgcctggcatgtatgatggatgataggtgtgctggttcattctattaaaatctgtaaaacaggcagagtgagtaccttttccatcgttgaccttgagatgttgataatcagttgtgcctctactgagtgcctaggggactcttttggagaagtcaaaattagcctccgttttggatattgaggaaatcgagtcttgggccttgcatatgtgagtcattgacattcgccctttttctgctcatatcttgatcccaaatgccagttttctttcccaaatgccagttttctcttatgagtatttgttttgtgccccatagaatagaattgccctttttttgttttatgtgccaccttcacttttggggaaactaccactgctggagaagaaacgagatttatttgggaaggagagaagcaaataaataatccaccttggcccacttcccttataaggagaactggcaagactggaaatagagccttcaccaaagggtttttagaattcatttcattaaaacttgaacccaacatacagatttcttcctttcagccttctggatttggggacagagggattcctgacctacccaggttgaatgaaggggagagggtggtctgtttgtttcaatgctgtggtctccagggcaccttctgtagtactttgtattcttagaaacagagtcaccacctcttggcagcagtgaagccactcagatgccaatggtcagagtttggtttcaagtcaccagccttgtagagacagtgcccagtttcctttggcaaagacagcctgccccttctctattcatttcagccttgaacacagaggtaaattcctcaaaatagaaacctttgtggactctatctgatgcatttgtgaatcatgtttgtcactaattctaatttaacttcatagaagttttaaaacgctgtttagtttttttgctgttgttcctttcccaaatcaactttcaaaaaacgttggtttaacggtgttagaaaggcttagacattttcttttgggggacagtgtgattaatgtttgcagcaaacgcaagggctgtggtgttgacagatccaagttttattaactccaggactattcctggatgtgtgacctcaggcaagtcagttcatctctaagcttctatttcctcatctgtaaaatgatttaaattaaatccacctccagcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaa

SEQ ID NO: 64283 - DNA, 2426 bp, Homo sapiens
cacattaagttggtattaatgcctattcagtgggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaatgtggtttagagttttttgtttgttttttcatgaatgagtgacctgtgttctttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatgacatgagctaactgcacacagatttcttattgggctccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagttccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagcacagctggctttggatttacactgagtgcaccttcatgtgcttctgcacaattgccaagggagcacggactcacacctgtgaactgtcctcatgccggccttatgcatccacatggtgcacctgggtgacattctctgtccctgccaaagggcacaagggacaagcagcctctttggacttcacttaaattcccggagctgggatgaaaataaagttacatgcttcaagattttgtaagcatcagagaggaaacagaattgctttgcccagtgtatacttcatttgtgctttaaaatgacgggcaaagtcccctggctgctgcagctttgctgatgttccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaagtgtttgtgccccttagcatggcattaaaggccctaagcgacctggttccagggtagcttcctcttgtgtcctgccaaacccctgttgccccacctgtccagtctatgctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggtgtcccccttcctctgggctctgcctcagggggccttattcatatagtggcttccttttttattgaatgcttgctttgtgctaggagctgtgctgaatgctttacgtgcatttcatttcatcctccacgttttaggtggaatttgcctcagctccacctaggaaaaaaggctcgtagatcaccagagacaggcttgtaggttgggtacctggagcttgacatcagatctgtgtgactttaatgcctctgctctgtttcctcgttgcataatcccttgtggaccctgaccacaggatctgtcaacctaagcctctacgtatctctatacc

SEQ ID NO: 64284 - DNA, 1057 bp, Homo sapiens
gaggtcctcaataatttatttggtcctgtttgcagtatcgtacatgatcaccaaactgctgctagaatgctcacacctgttacggcaaattcaaaacccaggaaaggcgtctcctgggaatttacttgaggtcagggtcaggctgtctggtacatcaataatttatttacgagtgtaaaggggtcctgtgatcaaaaagtttgagagccactattttaaaggatgtaaaaaggggttgtttatccaagtgaatgaaaagctaattcggaattatagaatgttatgaagagaaaccattttcagtaatttcaaattcaacagtagtgtttttaaataaggtttctgataattagcatattgtttgaatataaagtagcatagagtgcgcttagaaagtcttttttggttttgcctccaaaattgcccttattttacccagtggatgattttaataaatgttttccatggtggggcccttcagtcatgaatcctcaaataacaaagtctagattgcagatgtttagagtatggtagctgttgggagatgtgcaaatttagaaacagttactccgagatcagatacttgtttattaagatttgcagaattaaaatggagaacttccatgaatatgatagaaaacatcactccttcagtagagttgttaggaatatttaacctttataaagaaattcagtcataactatgttaaaataaaggagggaaggcaatttaaattcggtttgcaatttgaaatgtcattggcttcctctaatgactcagtaagaatgaattacatttagaatatctatccttggatatcagtaggtgcttccagtgggtgtttccgaagtaggtttaacactcccttcgaaatatcttttagcaatatgcttagcagatgtgcttatttttgttacaacagagactctatacccagtccttttcttctctctttttcaaatggcctaaagtctctaggctgtcagtatcagcctgactcttacctgtttatttgatcgttcctgaatttggttttcagaatatctgctacgtcca

SEQ ID NO: 64285 - DNA, 1937 bp, Homo sapiens
gctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtacttattttctatctgaatgatagttattttatgtatcttccatatcagttgtaggcaaaacccgtacattgtctagcatgaacctttcatagtaggtgcttaataaaaatgtgttaaatgaatggcaacttaagtcattatttaacatctttgtaagccagtctttaataggaaccatttcccctccagatattctaatttttaagaaagtttctgtttgtacatatatgacaaatggctagtcagctgcagtctcttgttttttttaaaaaatatctctaaagatgagtgaacatgaatccaattaatatcctgctttctgtgcatatttcaaagaccttgtggatcttttattgcaagggtatagtagtattctgatactgaatgcaagaaagtaaaacaaaattgatacttgtagcatgtcatttcaagagaggactgcccaaattagcaaactctttaaaaaacgacagatgggtattgaacttgtttctagatgagcatcaccttcccaagccagccctcttcattcagccaagcagaggtcttaccctgaaagttactgctcggtgccatgactcctgggatgagagaataacccacacctccatttcctttccaacaggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagaggtaagttggcctctgtatactggaaacttcattcaagggcagactgttgccttcctttaaaccttccttggggcagagagttgtatttttggatgtctgcttcttaccttctgtattagtccattctcacactgctatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagttgagatttgggtggggatacaaccaaaccatatcaccctccttctttctcccacttctttttcc

SEQ ID NO: 64286 - DNA, 1056 bp, Homo sapiens
agtattttcttagtttcttcctttcataaacaggtgacattcaggggctcatgatccgtgagaaataatcagttttttctaaagtagagagattagctatattggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcatgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacagaagtgaggaaggtgggcctgggaggcgctgggcctgcgccgagggaactgaccaggttgttggattgggttcctagtggtcagtcagcagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttca

SEQ ID NO: 64287 - DNA, 8328 bp, Homo sapiens
cattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaaggtatttcttacttatgataaccacgtttagatgggcttcaggtcatagttgtagtgttctgaatctgtgttagaggacacagagtgaggctgagcaaatctctcttggacttaagacttgttcttctccaattaagtcatagtcgtcatacacagatggaatatgttttcatccttttggtattatatactttttttttatcttaacaggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgcagaagtgtatgttgttaggaatgaaatgtgctttatgtattgtgagtgatgatatgaaagacagagtaaaggaggtcacagctttcatctttttgaaggtgtccaccaagcttgataattggaactttaggtgttacatctaacagcgtttcttaaacaatacccacaagtcaatcaatccacttgcctatctcactctttagtgcatcattaaaattgacataa

SEQ ID NO: 64288 - DNA, 1021 bp, Homo sapiens
ttaaaaccaaccatgaccttaacggattttacccaaactcgtctaacttcagtatgttttgtcagagattaatcagttacttgttcaaacttaaattgagatagtgtaaatatcagggtttcctagataaggacagaaaagaaaaaaataaaacaatctcatagtactccttgggtgaacaatgtgattaacgatggcacgtagtcatggaaaaaaagataaaaagtgagttaagaacttgaattactcttgtctggcacacgcctatgcacatgccaggagatgcaagtgcaacaccatctcagtagctggcgacagagctggtggggactccatgtaattgttccagttgtttcaattaaaacttatcagttgtagctagttgttggccccgcggaaggagcctgctggccgatttccctctgcagctcagtacttctgaggaatgtgggatctaatctgtcctgagaaggttattaacaatggggcatgtgtgtggtaccagcatggtgcagaagcctcttatcaacctactcttgaggggctggctccagtttcaacactacatgtgaagataacttaagaggtcttgctttatacagaagttccttcccttgcagagattctctatctgcttgttgccaatgggagcctgcccttatgacctcctcaaaccactgtttgtgctgtctcctttttagagacagcaccccccacccgccccgcactaccaccaccactgccctggtattacaacatgtgtgcctgtttgcagattttcaagtaaaaatgggaatttaaaggccattttcttaattgatgttttcaaaagacattagctggcataactatggttttttagtttcatctgatgcaggaaatgtctatgcatttggtcttgaacatgataaaaatgaggaagggactgaaaaaaacccaccatccccagacaatcatttgatcccataaacacgaaacctaatgatagctttcattttgaggcagaggtaaaatcctcatt

SEQ ID NO: 64289 - DNA, 1034 bp, Homo sapiens
cccctctctagccctgacctgtctctcctgtgttctgctagcaggtccgttgtggacatgaatggcagcctgtaatctgcatttgtggtctcggagttacaggtttgcagactgcttgcaagcactgtcacattgagtcctcatgacacactggagcctacatcccttcattccccaggctgtcctaaaaggcagtttggttgggtagtttagcatacagactctggagccagatttcacatcctaagtattccctactggcttcgtgacttgtggtcaattttcttttgctctctatgccttggtgtcctcatctataaaactgggatcatagtagcccctacatcagagagttgaggtgtggattaaatgagttaaagcattggaaaaagtgtgccagtctattcatggcacattgcaaacactcagtgaatgttgctgtcagtcttgctgctcttcgttgccttgccggggtgccttggcctggtttgtagtggtctccacattcagcctgcctgtctgccagaccttgccatgtgcctggacactgtagtcaagctgaggggctgtccattccctgtaccagcccttggcccagtccatccctcaattttcacgtgtccaaatcctcctctgcttttaggacccagggccttggtcctgcagcactatttcttcattttgttttccttcctccccacacctggcagcaatgtccacattgatttttctccaattctcttaggttctgctgcattccatattgtgttgggctgtctctgaaaatatctcacctgctcgctcagcctgagcattctgggagaagtttatcttgctttttccaaaatgacaggcacagggagcctttaggccatggttgtccaatgcacattgatcttgtggaggaggagatgggatggggtgggcactcagggacggagcaggtggagggaacaggatgcacactgcatagaggtgggggtgcaacagggccataagtggacatggccgtaagtacttaggtctgcatggaa

SEQ ID NO: 64290 - DNA, 1520 bp, Homo sapiens
gagttgggaaaaatgcattatactaaggagatcttaatcctggacagtcttctctaccaggcagaaaggttctgctctccactggtcaaggccttgggcctatgtgtaaaactgggtacctaacaaacacatgggcagacgcctgcagctccttactgggtagcacatgacacatagtatgtccttggcaaggccatttgctcattcctctgtgtaggtaaccaagtgcaacagaagtggaggtatagcccatgaatgtgaactaatcatttttaaatgatttggtccatgggcaggttagaagatgaaaccttcccaaggccaccaaaacttgatttcttgcttgaaaatgataagatgcagttataaaatgcttctgttgatttggaaaaaatgtgtgacttgttcaaaacaatatgtattaatagaaaatgtaacataaataagaggatacaaaaaagagcttaatgtttctatcttctgggcctagcaatagtgatttttttttccttttggtaggaaaatgggggctcagtggaataatcagttttatttctttttcttttaacttcatgaagggtttgtattgttcattttgttatttaatttgttcatttgctaaggaaagaacttctttcttggaactctgcggagtgtttttagatggactttactggaaaaaaacaggaattgaaattatattcacagtgcgctctaaactcttttaaaatctcatgcatggatggaggaaaatgcactgaaatatcaatagtggttctcacctcatggaattagaggtgacttttattctcatctccttctctgtggtttcctatttttcaacgagtgtgaattacttttatcatcatgaaagaccagttaaaaattaatctcacaaattaacactctcaagccaaaccacgaatttttgtttttcacaacctggcttggactataaactgtcacactatctcagacctatgcagattcttttctgagtgaggcattgaggaacttgttataaagatgatgctttccttctggaaatcaagaaacaagccaagggcttataatgtgttaggaaagatgtcctgagtaactttcctcctggaatctgactagcctttattacagctacttaaggaaatgagttttgtgggttccctgttcactgtgtcaccatttttttctttatcctgtactcatatgtacctcagggtccccagattttcttatcctgggattgcatgaccttgtccttggctctctcgggcccctgccgtttccagtgttctctgttcatgttcacaatattgttgatttggctgtggcttcttcccgcagtgttcttgtagactgaagagagcacattgctgcccttgtccctgtgcagcttcctcttcctctttatcattgctcaggtgagtggcctgagcagtgctcctgggatgaggtgaagagaagcagtcaagactgcagggaagggctaggggtgctgagctggccgagcttccctgggg

SEQ ID NO: 64291 - DNA, 1053 bp, Homo sapiens
agcctctcaggcactgctcttggcatcatggttatagaggtgaaacaggacaaggtctctgctgtcgtgaagcagacgtctacatgtgtgagatgtagaatgtgacgtcaggtatgatcatgctctgaaataaaagacagtgagaccggggtggagagggaagggcctgtccaagaagtgagacagtgagctcgttgggggtaaaatccataaaattcctcttggggtgactacagattgtcagctgcgctgtcagcaccttgttttaattgttttacttggctgccattgccaatgcccagctgactgctccctgcagcgagaactcccacctcaggcctcgctttcttcagctctgctgagcgtgcctctcctgggtcggctcccggttctcctccagctgctgagattccagcctccacagcctgctctgctggttctctgttctttgtccttagcttctggtttggcttggtccctttcacgtcatccttaacgtcctccctgggtgagctcatccaccactcacctctgtcttgaagacacccggatctccatatccggtctgaacctcctcccagtccacactcctagtggtctgccccgagggcacctcaacctgtctgtcccctcctgagtgccacatgcgtctttctccctgtgctgcctgcttggtccacgcccctcagttgcttctgcttcatgagtcgtcctggccttgtcttttccctcatattcccttggttaccacatcctgaagagctcatcttctaatttgtcaactcagttcttctctgtctctccactcctgtgtttaggattcatcattttgttctatgacagcctcttaattggtcatcctgtgttcatctttttcctccctcattccactgcccacattcctatcaacgtgatctttctaacacatgtctgatcagagctttcttttgcttaaagctctccaagagctcctcattgcttagaaaataaaagctaacccccttcagcggggcctgcagtcttctcatcatctggcccttggccccctgcagc

SEQ ID NO: 64292 - DNA, 1050 bp, Homo sapiens
aagtacagatgctgacttgggacccctggggtcagagcttcttcctatttgttagactcctcagtattcactggggactttacaaggtttaaaatgaagacaaagaggccctcaggcacccccatgaagggccactaggtatccttacccttcaagaaaagcattctcagctggattaagggggaaaaaggctgtcagacagtagttcgcaagaatagatattctggcttatttaggaaatttgggattcatccaggaccaaggtgggtggacctcattcctgagaattccttgatggattatttttcattttgaattgctattatcggtccatcaaaaacaagagctaaaaaaataaaaagtcaggggcaaagaatatagagaagagacattcctgaggtctcagcatgctgggagacacaacaggcgtcacaaactcaagcccaacacaacctgtcctgcactcaaagctgacaagaagagcaccccaataaacccaatggccaatgaacctcccatttcaggtacattttatcacattatgaatctgttgcttggctgcacaaacagaccactcctcactcttacaacaaaaacttcctgagccaggtaaactatgctggcacttggaacagagagagagagacagagtgtgtgtgtgtgtgtgtgtgtgtgtgtgtgtgtgtgtgtgtggtctccacccttaaggagctcaggttgctgagcataacaggtaagtaaatcaacagtaacaccgataagtgctttgcaagagagacatgagggtgttctgggagccaggaggaaggtcatttccaggtcatggagaggtgctgggtagggaaggatggtgtcctgaagatttgggggaaactggagttgagttcccaagagggtgaacagagaccacgccattcccaggagagggcccagcattgcaaaggcactaggaggtgatggctgttggtagctaggctgaggttagaaatgtgagttagggaaaaaggaaaacccaaagtggggtgggggtgggggagcaaaagctgcagg

SEQ ID NO: 64293 - DNA, 1025 bp, Homo sapiens
cctctttgagcatcagtgtctccttctacaaagtagggacagtaattctttcccaggggtattttgaaggatatacgaattaatatttgtcaggtgcctctcagatgttcagcacaaaataaacagtgtataaatatgagtcctctcttatcttcctgctgtagagagaaagttcgttggggatgctccaagttggtggctactggctgaggatcctggagtaagaggaaggctaccatgtaaacccagagatgaatcatgaacaatgtgtattctcaggagcttagtatttgatatgggagcctaacaagcaaatagtgtgtccagtaataggaactgattaatagaggaaagattaattaaccttctaggtgggtggggtggaaaagtaggtggggtattgaaggttcaacaggagttcgacagagaagatagaccataaataataaatatacggctgtatccactagagataaagttacattgttttttatgtacatgttgacttcttttggccttgccaatgcactgatatattcaaattcagctcctctctttttctcttcccttttcccttcactctgcctttcctccagccctgccttgaaatactcagccactgaaaatttcttaaagaatttctttatactttagtaagtcctcagaggataccagttcaccctactgagattttacaagaactttggtgtagctggggttttttttgcattcctttttctacggtagatataagttcttttgggttgcccatcaatgaacaaactaccaaccatttgatgtttactgcgtgactcctgtataccaagcacatgtgccatttcacttagtccccagaatgtcagagcagctttgtgaaatgggctgcccgttctttcttatggatgaagaaactgaggcttaggtaggttaatatactgaatattatacatgtagtgagtgggaaagccacagttcacctccagggtctttttctccctctttgctgccttgcttggggtcctgct

SEQ ID NO: 64294 - DNA, 1021 bp, Homo sapiens
gtttgtaagaagggagatgctggaaccccagttatctgtaaaccccacctggaacttgagcacagtctaggtattctttaaacaaaaaaaaagaaaaaaaaagaaaagaaaaaaagcagcatttgtcagatcagaatcaaataaggtgaaatgtacccactgcgagaaaagaaccaatgacttagtgtggcttggagtatgcaaagatcaatggatccatctgcatgaagaagactcccactcactgacaccaccatcttgactattctcttattaaaaaatggaacaggggaggctgcggagcagcagagtcactccccagagagccaatgccactacagagaacatgcatcccagggcttaggttttcttggtgagaaaaacaccacagagtgtcaacagtctctccctggaccagttcgtcccctcctgcttttcttataaaggaatcactataccaagttatcccaatagaaatcaaagacactcaaagatcttcaggtcctgtcatctgtcccctcttctccatccccacagctctagcacaacactcagcatcaatttcctggacgattttcacagccgctaaagtaattctgctgcctccctcctacagtccagcccccacactgccaccagctggctttctaaaataaaagtgctgaccacgtcactcacctcctgaaagatgtctactagatttgcactgcctatgaaataaactccaaagtcttcgcttgcatgcaggcatgcattaactcagtcatttgtccatccacccacctcgtgtttcaggatcacccactgtgtgccaggctctgttttaggccctagagtgctgaatgcaatagataagaccaggtcccatcttcatggatttatattcttgtggggtaagacaaacactaaataagaagacaaacaaacatatcatataaagtcagagagtgatgagtgctaatgagagaaaccaaagcgaggtaggacagaatggttgaagcagcggggagagggggcagaa

SEQ ID NO: 64295 - DNA, 1316 bp, Homo sapiens
ccacttgccaataatttcgctctacatctaaatggagaacaggagtcatataagttcacagattgaatggatggttgatttacgaagcccttgaaatgtggctgcaggccgatgctggcaaccccataattagatatggcatgctctgcaatgatgtattttttaactgttttttaataactcagttctccttctgggatgaggagaaaaatggaatttgttaaaaataaatcgagattttagtggcttttcagccttctgctgcttgttgctcaaaatattctataaataagagaagccctgccctatagtgcactgtaaacacccacagacactcacagccaaattcttccaattatgaccctgtgcctgttgccaagctactgcaaggacctacttgaaaggcggccatctaggccatttcctgattaagctgccctgtagcaaggaatcaaggcctgctgctttggcattgtatctagtctcaaataattactccgtgttcctgaaattaagccctttccttgtgatagaattacaattcagaggtaagtgaaaggctaaccactcacccatctgtccgtctgcctaagtcgtgtgtgcatttaagaccctgagctgtcacatgttagactttatttaaatcaggtagcagaagtgcactcacaacagcatctttaattgcactgagcaaatcaaggtcaaacaaaaggaggtcaactatcgacatgacaggtgagtcagatgcagcctgcctttctgttcagtggcttcctgactcatcagtttggatcaccgttgcccagcccagcaggctgaaatggtcatttaaaaatccgtaccgtaccccaagaaggcaatgcagttatgtcaggtgtagggcttactgctctgccgttcaaatgccagtgtgtgagttggaactgccccgacctctgggcttccacgcagcctcaacaagccattgaagaactgcatgcagagaatcaggagatgacagtgtgccacattctcgctgagagaaactacttccagctccttagaaaccagaatgttcaaagcagcaatggagcaaaatgggctctggctggaaactaatcaccccccacctcccaccatgaggttttcatgtcagcccaactgggtgagtgttcaagagaagtgtcgtccatattggccctgagaccttcaaaaggtcctgtgacatggctcctgccccaggaactcactctctaaatgggaagcccattaatgaacaagagaactaatatgtggtcagattttccaaactcaaaattgagacctatatacttgga

SEQ ID NO: 64296 - DNA, 1056 bp, Homo sapiens
cacacaaccccttgacctggatcttactcaagtcagtctcctggccgagtcacacacaggaaaagttgctagaacacagtgaaatgttcaagagcaagaaataagagagagaaagaggagaatctgccttttgaaaattggttcagagctggggcagcctccatcatgaaatagtgttaactttattaactacagaaataattttaaaactagaaactattttaccaacaagaaaaattgctagcttgtactgaaattataatccagatccaagaaaaaaatgaaatttccaaactaaagctcatcagccattttccaagtatttcctgtgcacttgttactgcaaatttatatgttctcaactctgagaactcgaaagcaggtaagtggctgtaggtatcaaagattaggaaaaacaaatatgtgtaggtgaccttggggacattctgtgtacaaactaattgtttgctatctgacaacacctggcaccatgtttgagaaccactgtccagtctggctaggaactccctgggcaggaagatcaaccatctcttctcagaaagaatggattcaataacccaagggcttcagctttggatcccagctgctggatctgcccacagccctgattcctccctccccacctctgaccttctctgtagtaggtggttcacatcctagcatgtcactgtcttttactctctggttggttgtctgtctgtagccaaatcctagtacgtcttcctcatccgtaatcactccccgtcgcttgttcctctccatgctagccgctacagccttagtttaggcccagaccaaccccgcccggcctcttcgcatcctctaaaaccgctggcctttggtatcccaacaggtgacttctccagaggctttcacagtttgccctccctagcaaagttttccctacgtccctctgccccttccagcctcagaaagagaagtaactccccaaagcccactccggcttaggcactgtgcctgacatgcagcccagggcaagaaagagatagaggttcaccacacaggctggcacca

SEQ ID NO: 64297 - DNA, 1020 bp, Homo sapiens
gagaaagatggcccatgacttcatccagagtctttgcttcctgtgctctgggatgcctgggcttttctggccacagccatacactgacagggccagaagggctgagatgctgggattgaaccatctttctctttgtgagttgctttccagatagcacgcattccggtcactattttccagagatttaagcagcaaagtgagggaccctcgggcatcgactcagagacctggaggggagcagcttgaagcaatgtaaaaagcactggataaaatctggttctaccaaaaatagggctatgagagttacctcacctccctgaaaggtaatatctttatctgaaaaatggggatgataatactactaacctggaagattgacaggaggattagatgagattctgcatggacataacagtccttggcatgatgtctagcagtgaagaaacataaatatgagaataataacttccttcttcctccgctgtctattccttctcttattctagtcctgtctgctgttgggttttgtctgttgttttgggtaaatagctaacctctctgcctctttttgtctgtagaaatgctactggttctgaatgggtacttcgcgccccctataggacatcgtgggaatgtgtgtgggtgatctggatgtcacagtgacccagacgaggcttttactgggggaagaggggaaggcaggggtgctagatataatgcttggggaacaaaagattgcccaacatctgcatagctgcctaatgctcagtgcattcttgtgggcaaaaccctgcttaaaattatctgggcctagagtctgactccaattaacacataaacacaaataatttttgcatgtttttaatatatactgaattttctgcgaacacagctaccaagtatataagatttacctatttgttatgaataggtgcaagcatttcatatatctttcatgatgttttctggtgtagcggtgccccaatacttacatattgatttacatgttgtcttattttt

SEQ ID NO: 64298 - DNA, 1020 bp, Homo sapiens
taaaaataagacaacatgtaaatcaatatgtaagtattggggcaccgctacaccagaaaacatcatgaaagatatatgaaatgcttgcacctattcataacaaataggtaaatcttatatacttggtagctgtgttcgcagaaaattcagtatatattaaaaacatgcaaaaattatttgtgtttatgtgttaattggagtcagactctaggcccagataattttaagcagggttttgcccacaagaatgcactgagcattaggcagctatgcagatgttgggcaatcttttgttccccaagcattatatctagcacccctgccttcccctcttcccccagtaaaagcctcgtctgggtcactgtgacatccagatcacccacacacattcccacgatgtcctatagggggcgcgaagtacccattcagaaccagtagcatttctacagacaaaaagaggcagagaggttagctatttacccaaaacaacagacaaaacccaacagcagacaggactagaataagagaaggaatagacagcggaggaagaaggaagttattattctcatatttatgtttcttcactgctagacatcatgccaaggactgttatgtccatgcagaatctcatctaatcctcctgtcaatcttccaggttagtagtattatcatccccatttttcagataaagatattacctttcagggaggtgaggtaactctcatagccctatttttggtagaaccagattttatccagtgctttttacattgcttcaagctgctcccctccaggtctctgagtcgatgcccgagggtccctcactttgctgcttaaatctctggaaaatagtgaccggaatgcgtgctatctggaaagcaactcacaaagagaaagatggttcaatcccagcatctcagcccttctggccctgtcagtgtatggctgtggccagaaaagcccaggcatcccagagcacaggaagcaaagactctggatgaagtcatgggccatctttct

SEQ ID NO: 64299 - DNA, 1846 bp, Homo sapiens
ttgctatgttctgagaagttgattcttggtatgctctaaaggaaaagccaatgggtttcctgacggtctagacatgggggtgactcccagtccatgaactgcacaaaggcccccagccaagggggcagctagggctgcaaagccacttgccaggtacatgccccatgtgacagctggaggaagaggtccctgtacaccatccacccatccagggaggagctgctggtttgggacatgttcagtgtgggatgcctatgagatgtctaggtgacaccacaggccctgttgctgtgagtggaggtgaaacagagcagtcacctgccacccccacaactctgaacactgaccacgtcccgtttactgagcatcaaacacgtgcctaggatggttcctgccctgacgtgtctcctttggtcctcgtaacgaccttttgggggaggcatcgacatcacatagaagatgacactgaggctcagagaggtatggcaacttgtccaagatcacacagctgagaagggctagagcagggactggaacccagatatgcccacctccaggctgggactctgcacatgctctattgcttcagtgactcagcaaataaaagcaacagctctgtcccaagtaggagaaagagggcagggcaggctcatacccatccctcctcccacctacggggcaaggatatcaaaaaccagtaacaaggacatgaataaccaatgggctgggggaatggcacatctgttcaatgggttaactaaaagttagccaggtgatcctttctgtttaaacgtgaacaactgaaaacctttctaaaatgcacttgtccatttgcctggcaagtgcacttggaggaagatgatgtaatctataacgagtctcgggatcttcccagccctagatctaaaatgttcgtctgaatgtatcctgcctgaccccagaaataactctacaaattcctcttaatgaaaatgaaatcggcttgttttttttccttcatttgtctccttctggcaagaagaatttaaaaaaaaaacccacaaacttcagtgatttcagtttcatttttctgagctttggatatagtgagtatcatgtgtctgtgggtctgaacaggcatgagtcgtacagctcaaggtcatttttctgagaaaatactcagtgcaggaatcacaacaaaaataacaacacaaaaactattggcagaaaccacacaccaggcttttttttcatgctagtcagtgttgtttcgtttagttctcaaagaagaactaattaattgtgagaggggtcagataaattgcctgaaatccctcagctcacaagtaggaaagccagggttcaaacccagctctgtctgactccaaagctctgtgacaactgaagcaatactaccttttctgagttaaaacaaaacaaaatctcttataaatcaataaaaaggcaaatacctcagtggaaaactaagcagagactatgaataggaaaccccaaaagatgaaacacaaagaccagtaagtatacaaaaacatgctcaatctcataaccgtcaaaatttaatagataatatgccactttcactgctcatattagcaaagattctatttaaagataataccagtattagtgaagatgtggtaaatgggcaggtcagtacactgtatatctgaatataaactgatatatcttttgacaaagtaatttcatgcctaaattaaattttatgtttaagaacatcatctcttacatagtactcttttaatagatatgcactggcatctgttaatatatcaatagatataaatagatatacatttaataaattttcatttaattagtattcatt

SEQ ID NO: 64300 - DNA, 1021 bp, Homo sapiens
aagtggggtggtgggaccccaggacaggcaggaagggatccgtgggacaggaagcctgcagagcatcagagcctcctggcaaggccaggcagtgggcgtgtctccagagcaggctggccaggcgtgggaccttcctggcagaagaggaagcaagtggcagcagaagaagaggctgagggttctcccctaggtaccagacaggcaggacaaggtgggttttgacaatagagtgaggggattctgggtgcccgaggagaggcagggcaggatggtggtcagggcggggcctcttgggttccaatcccagccctgccacttactagctgcatgtcctaggcaagttaggtgacttccaggagctagagatgcctcatctgtgaaaggggtggattccccgcactgggttgttgtgcagaccacatgagttgaatagaagaaaacacctagcatgctcagtggcgtccactatggccatggaagtggatggccttgtgctggttgaaaagggagaaggctgggaaaagtgatgtcaggagatgcaaactcaggttgaaatcctggggatacaagaactcagagatggtgagagcaggggtggcaagaggacatgaaggaacttaaagctggagagatccaggacattgacccctgggaacgaggagggagttgaggagagtggctgcagggaaggctacaggtatcctgggggtgggtctggaaggcattccagagcgcagcatttcatagcaggaagcattgaggactccaaagaatctgaaaagtgaatagagttttaagagtccaaccgctttgttttaatataaaacagagagacaactcctcctgtgagaagcttggactaggacaatgagaaaggtcagtgggatatgaataacagaattttggagctgctcagggagataagatgtagaaagcaaggacaatgatttccttagggagacgaagcccacaggaggaaaagcggaacccagcagggtgacagctgctgctgaggggtggg

SEQ ID NO: 64301 - DNA, 1069 bp, Homo sapiens
gtgatggaaataactagatcagaggaacagagtagagagtccagaaataggtgataaatcaataaaggtgtatttcaagttagtggcaatgggatgcatggactagcaaatggtgttagaaaaaatctcctatccattagagggaaataagaaattcctaagcttaggtagtatatcaaaataatttccaaatagcattaaattaaaaaaatcattaaaatcttagaaaaaagaatatttatattattttgggtaagaaaagacttaaaacatgtcacttttggtcccacatacaaatatcgtaaacaaagttaaaaagcaaaagggtgggaaaagtgtttacaacatcaatgatgaacaaagaattaatattcttagtatacaaatttattcgttcattcaatatttattgagcacttagtatgtactagaaagtattctgggcactaagggcacaagcagtaaataatgttcctgttctcctggtacttagaccctgatggagaggactgccagtgactatggtagattattgtaggtcacattttgataagggctaaggacaaaacattacgtaggtggctgggctagggaggcttggcagggtttgcattatgtggatattcaagggggcttcactgatggaatgacatgtgaagaaaaagggaaagtcattgaatgtcgagctgatagcacatttgctgtttttggaatgtcgagctcataggatttgctgatggattgaatgcgggttgtgaaagaaaggagtcagggtggcttctaggtttggggcctggcaaccagaaggattgacataggaatgactgagaggcttggcttggagatagagttttggttatggatgtttcagtttaacatctctcttgtatattcaagtgaggacgtcagggaggtggtcggccataaatatctgtaattcagggtgacatctaggctggagatataaatttgggaattgttgcagtgttgatagtatttgaaagaatgacactagctagagcccctggagagtgtgtgtagatacagaagagggcccaggacatccatg

SEQ ID NO: 64302 - DNA, 1072 bp, Homo sapiens
ttgtggactctggtttgctaatcttctgtaattcatggagactcaattaattaagcaaccttaatccctttcactatcattttaatgtaactgaagtcatctgtgactgtcaggcagagctttttctcacctgagattatcacctggcctcaaggaacagatagaattctagacaaaagggagaggggagtttttgtccttccgtgcggcctgcgtgatctctgaactttagaactagctggggaaactctctgcctgtgaggaaccccagggcgtctaattgggaacactgttctagaatgcccatgatatgatccagtgctcctagaaacagctatttttgcccttgggattacattgtttgaagggccatgctctctcctttcctgtgggataaaggaaaaaggagagaggcccagctggcagtccatgccctcctgataaatgtatggattggagaaggcggtgagggggatttggaactccttcctctggggatttcagtctgttttcttctactgaaccacaggatgcaacgaaacttggttttctgaagtctgtgaaagggagggagatccttgctgtgaccccaggacttctgtggccctcagccccactacgcccctccatcccaattcctaaaatctaggggttcccacctacctgagaagcagaatatttggcagtagtgcctttgaaaagctgcctggggctctgctcagtactttgttggtactttaattccaccctcctcacttcgtcccttccctgccaaatagatatgtatgcacatttatctttgatgctcaatatgttttgcaaacagaataagcttcatttatccagaatgatggggggggagaatgagaggttatatagatatttcaatcctatggttaactaagcatttttataaacactacatattcccaattttcaaacaatcagaatatggtaaaatatatgttaacacacaaactcttttgagatgataacttttgtttgataacctgagaagctggtccaggttttatagtaagttcaagttaattttcatttgttttacccttat

SEQ ID NO: 64303 - DNA, 1052 bp, Homo sapiens
agttcttctgccgttagtaccaggctgtgttctgaggctgcgtcatgacagactgatacagggggctgcagaaattggctgccctaaggcttcaagctcttccctcggaggccagccttagcaggagctcccatggctctgtatctgcggcagctgcagcaaactacatttccatcgttgctgcacctccttaggaggaccatcaccaatggcaggtgcacatcagtcagtgtcaccctgcctcagcgggaggagtgtgacattcctcagaggaggctcctggggacagatgtagcatctgctgcacctaggtggggacctagttttgatccaaggatgacggcgttggttactgggtgccctagtcagtgaggctgtgactggaaagaattggtgccctgcccaggtcacatggccacacagcgggctcctcacagacctcagggacagcccacggggctctggatgctctgtgctatgaagccaccacctcccttctctttcctttcacccccatttcaaaatccaatttgacaaaggctgagaggaaaagaaacgaggagaaatgaacaattcagtttactctgaagagacaatttttgtagcttttctcctgaattctaaagatgaggtaaacataaaaaaattaatactgacctggcagtgagaccattttcttggagactttagttgaaaagtctaattttaaacattctgcaaattctaaatttgccttgtcagatgaacattgaaaacagttacaactcatttatttttgtcatcttttcttgatgcttggttacattttataagaaatcgtttttcatattgttgttcagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgagaccctgggctctattgtcctttatgtccttgcccacaaatgttaccaccc

SEQ ID NO: 64304 - DNA, 1045 bp, Homo sapiens
cttagaacaatcttgtaatatgttccgtattccccccattgaaagatctgactctgatctgatcgatagcattatggctttcttctattgctgcaaaataaatatcccacaatatgtggcaaggacagagggtaagaggctatctgacaagggagaaaggtaggcaggttaacacaataccagagaatacgtcacttggaaatccactccatactgtgtttgcagtgctgtgtcacttcttagctctattgaacctcagtttactctaaaaattaatgataacttataggatcaaataagagtaacatttataaacgcttctagaacagaacttttcacctattatgtcccccagagtttttattcatttattcattcactcacacactggtatttgcatggaagcttggtaggcagaagacttgaagaatcaaaatgacatttatgtaaattagaattaatgtaaatttaatttttccaaagatttctgctctttttagtctcagagcaaagttatggaggaagttgctgttatctctgttaatagacaaggtgactgaagcatatgatatgcgtgacttgcttgagaacagagaggctgaacagcagagctggaatcagagcccacccctatcttctgccttctgaggtcttacaggggaattccaagattgttgccttagaagagcataaactgtttatataattgagggttttcccgtcatgttatcaaaaccaacctccagatgcctccttcctggtgtcaggcaaagtggttggacatatgtacaggttcacataggaaaagtttgaggtctcatgcacaaaaacacaaaggcaacatgcagactgtgcatgcttacttgttgcataattgattttctgcatgcaattgacttgtcatgtttaacatttcatctccccagaatgatctgattggtcagagtttgtttgactacctgcatcctaaagatattgccaaagtcaaggagcagctctcctcctctgacaccgcaccccgggagcggctcatagatgcaaaaag

SEQ ID NO: 64305 - DNA, 1039 bp, Homo sapiens
aaaccctgtctttaccaaaaacacagaacaatgagctgggtatggtggcacatgcctatggtcacagctacctgggaggctgaggtgggaggactgcttgagcccgggaggtcaaggctacagtaagccaagatctcgccactgcactagatctagcctgggtgacagactgagatctgtctttaaaaaaggaaccacattaattagattaaaatgtggtataaatctaaacctcagtgcaaggcttctagtttttgctgcctcctttttatcaggacaaccaaatgccagaagctgcagcagctgaggccacaagacagctgaggctgtctctttttccagcatgttgtggctgtctctagtagccagaaaaattattagcctgtgcatattctgagggaaagcagtaggcagcagtaaatttgggacacctgggtccttggtccaggtctattaccaattaattgtgaatcctacaggagaccagtccccaggctggcctctgttcttcatccataaaataaggaggttggattagatcaacgctgtccaacaagactttctgtgatgatggaaatgttctatgtctgtgccgttagccacatgggaggctaccatggccaacgagtattttattggacagctcaggactaaataattgcttccaagtcctagattcaaaagaatttcaatcacaataatggttctggaacattccatagattcagacagcatgctatccctactgtttttcttttagccatggacatcaaggcaccccacttaattgtctctatatgccaaagaatgacagaaaaatctctgtatttatgatgatatcctattgaatctcattttttaacagagactctcatcatttgtctctttttttttgaaacagggtctcactctgttgcccaggcggaagtgcagtggtgcaatcacagctcactgcagccttgacctcccgaggctcagctgatcctcctgcttcagcctccagagtagatgggactacaggtatgtgtcaccatgcctg

SEQ ID NO: 64306 - DNA, 1059 bp, Homo sapiens
ttgtaggtggcccaaagaggacccaccccactgttccagggattccagggggaacccgggctggggcaggaaaaataggccgaatgattgctgaggaaatcatggaaatccacaggcaagtaacaccttctagttcctctgttaaaccagtggttctcaacccagggaaattttttcccccaggcaatattttgcaatgtcaggagacatttttggtcttcacaactgggtgggaggttgctacttaaacatcctgtggatagagaccagggatgctgcttgttaaacatcctacagtaaacaggacagttccctcctccccacccaacaaagaattatccaatccaaaatgttagtagtgcctagattaagaaatcctgccttaaataaagaagctaaaccaaaatagcccagcgctaaagagaattcttgagaagacttaactttcttatggctcaaggagcttctcagtgcggatagatgtacctttactttacaggaatgcaggagtagagctgtgaactatcagagtgatctggaccttaacaaaacattcactttttttcaatcaaagagctgcccaggattagtactagaaaccaagcagatcagctagttattactagctgtcttgggagagacttcctttccatatgaaagagaaggagcttagaagcagtccacctgggtctgagtcctgggcctgtctctctacctggctatgctgagacttacttaacctcttgctctctgttgatttaaaccataaaaagaaagcactatttcccaagaattgtgttaggattgtgagggcactcaggaaagttccaggaacacagcctgacatatagtgagtgcttaaaaattaattaaatctgtctttaagagcagtcgagagggaagcagttatcataagtctgtccaaatttggggaatagagaaggtggtaaccagattcttcagaacgaaacttaatgtaacataagaaaaggaagaaaacactgctgccgctggattctctcaggagaattagaggctggcctgttttccaattggcca

SEQ ID NO: 64307 - DNA, 1016 bp, Homo sapiens
tggaggagtggtctctgggtcacccaaaagctacattcatccatgtaggagctgagagtcctgtggttacacaactgccatcacactctccctaaactgtagctgcaatgccaagtgatggattctttcctgaggtccttcagcctgacaagtatttaggtggatttacagttctaagtcttcccttctataaatcttctgagagatatgctagataagaaaggcctggacccatttttcatcaaccactgccttcgaaggctgcttttcctgtcactactactaggctaccttttagaccctggtgccgtccatgtcctaagagtattcactagctaaacagtgtttgtggagaaggggacaaattgttttctgtggatcaaagatggaggttgatcttagaagttctcctccaattcacctggattctgtgaggaaataaaactggccacttacttgaaattcaccaactgaatgcaaactccaatccaagggctttgtcagtgagatgcttgactctagggactgcattctagatcaggtgcctgtagaacaaatccagcttgtcatctgtttttgtaaataaagttttattggaacacagccacaccgattcgtatctgtggctgctttcaagctgcagaggcagagttgagcatttgtgacaagacaccatatggcctagagagcctactatctggccccttacagaaaaagcttgccaaaccctaatctagatcttcatcccctttctcacctttaccccttaacaaagcacatacactccactgaaaaaagaaaaggcagtgtaattctcttttctgacaggataagagggtcatcgccttctagctgtggctccagcccattgaacatcacgagtacgcctccccctgatgcctcttctccaggaggcaagaaggtaagactgatgattcttagcctaagctagagaacctcttgcccaagatctgaaatgttgggggtgggagtatggaattgcaactgcgattgct

SEQ ID NO: 64308 - DNA, 1068 bp, Homo sapiens
tctggagactgaggtgggagaattgcttgaacctgggaagcagaggttgcagtaaaccaaggtcacacatggcactccagcctgggtgacaaagtgagactccatgtcaaaaaaaaaaaaggatacatagctagagaccaagatctgctccaacatactcctactttaataatgtttttttgatggttgatatattgagtaattgaaagaatgatagaagattttatgaattacatcagtagggttttcatgtctggctcatgaactgatgagtaggtggatggaatattgttttcacttctttgttttaaatttgtttctttaggatctatagcagaaaagctttctaaggcgaaattgggtgagaggtctgtgtgtgtctcctcagtttttaaaatctttctttctttcaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatc

SEQ ID NO: 64309 - DNA, 1062 bp, Homo sapiens
taggtaaaatgaaaaagtagttaggtgaacggaggtctcatctaagtttaaacttccacatttcagagatgtcagagttctctactgtttctgaaaatgttaccagcccttccttaataataagttttggctaccttatgctccagatattttatgctttctttacttttctttttccaggattactataaaacaggaataatccgttgtcctgatggcatatctattcctgaactgagagaagcatgtgactatctttgtatctcttttgaatatagcactattaaatgtagagatctcagtaagtatgatgttttgtgtgtaagtggtttgtagaattagaatatattggaacaaaaagcctgaaattagtgctatttacctagttagacttaaagtatttaattcaattataaagcattctagtaccacaaagattattaatgaaagcttgcaaagaccttgatgatctccttgtgcaattttccaaatattttttcaattttaataattttcttttttgacaaacccagatttcctcctagacagttttctatattatttatttgttaccagttttatctcctagatttggatccttggctttggtcaagtgtggtcatttggctgcatttctttgattacatcatccaaaaatttataattttttgtattaccacgtgtgataatatgagcactatggaaaacacaaataattctcaaaaacaatacctatcattaaagatcctagattgaatgtctagccctcatgtatacataggattaaatgacttcatccaagaacttcaaatattgtctcaaagcagtgtgtagaaggttttaatcccaactctttgattggtattcttctctcactacttcttcagcacccctactcccattgttacttcttcagcacccctactcccattgtttctcccaaccctgagaaaagatgtgattatgcacaaaaaagtcaaaatagtgtatgagaagtatcaaatgttgacttaggtacttaagccaacacttaagtggttggagaagttcagaggaagggga

SEQ ID NO: 64310 - DNA, 1743 bp, Homo sapiens
attgttgggcatatctcattcgctttccatttttcaatgattgctctctttcattgcctgatgtgccgtgtcttgcagactgttgtttcctatattccgtttggtttcttgggttgtttcagacaagagtatgaactcagcccttgttattctatcttggctggaaatagatattagggctaatccagtcttcatgtccttacctatccttagttcatgaatttcaaactcttcaatgcagcctgaaacagagctttcccctctgaacttgctcatcctcattttcttttgtacatattaactatttttgcctttaaagtgatttcttaatctgaaagtattgaattaaatatagtaggacataatttgtcttccatgacatctgattttgaaggtctgattcagggttcagtctatatgggaattaaaagaaaatatgaaagtgtattatgacaccttttgaattcgtttaaaatctaagtggtttagagatgaagccaatgttttagcagtgtctagtctttcagctacagggatgtctggtgaaaacgcttttttaattactcagtctgcttggcccttactcaaactgaacatttagcttgtatttgtcttactcgttgttgtgcttgtaccttgtccattaaattaccagactcacatttagataatgtgctttcttatagttgaaaatgatgaaaacttagctgccagaataatttgaagagttattttttctatatatgatctttgttctatttaatgtggattcctttttttcctactttagaaaacaagccagaaattccagtattcctactctaatgattttttaaaaacataaatgcagtaggatcttttgatctgtttgaaagaaaagattatgttctattgatgcagctgtcctctaattttttttcactagaatgaaggtgggagtagaatttttctctgtaggttgatgagaaacaaataactgataaaggctgttaggttgcctttatttccttagaagtaactttcaggataaatacaaagtcaactttatcttctgtcctggtattctgttatagcaaggtgatgactgatttttataatgaaagaaaccaccaaaataacaaaaaatattaaagctaataaaatcaaccaaagagatgacccggagacactgaaagattttgttttctgaatcacgaagattagattttaactcgtgtggttttgctaaaggagagcagtataatattatgaaaggggcactggaatgactcaaaaggcttaggttatagtgttattagcgtttctactaaatgctgtgtgaccctgagcaagtcttgcagttttgaactttaacatcctcatctgtcataaactaaataaactaacatttcatgagtaattatgtcgtgccaggtacgttgctggtcagcttacttattatagttcatttaattcacctattcaccttagaaaataaatagaatctacattttacaaatgagaaacctaagtttccagaatattaaggatcattcaaaatgccaagcaataagcattagaggacaattttactctaaagccatgaacttccttctgtttctaaaaagaactttaatatttttgaaccatattatatgctaacagtaaatttccaaattgccttaggtctggctttattatttttattatcatcagttttcttatttgcagtgtactctaattattgaaattttatctatttgt

SEQ ID NO: 64311 - DNA, 1467 bp, Homo sapiens
gttcataccagatttgcattctaaagtttgatgtgaatagatatttgcttctacacttgatcttagccaaaaggccaagaagcaatagatatttgcttctgagagtgaccattttaataagatttaaaagtttttagaaactttactgcctgttgattcaccttatgcttcaaagcatgattttgaaacaaagtgaaaagttggtattaaagaaaacagaagcattattaagtcataaagctgcaaaatttaaaaatggaaatattttcttttgtgtttaaggtggatttgtttatgtaactagaggtgcttggaagtgattgatattccttagttgaagaaaattgtgatctcagaggatcatgattaagggttctaatttgggcttttgtggtaagtttactgggtagtatatgttggtttgtgaagttttcaagtggtgatcagttggtgatggtagatgtttttaatctgattgtagaagtgcttttggtttcttgagaccatggaccatattacaacaagaggatgcaaaaatctatgtagattggtaagagaaggaatttagtgcactctgctaagaaaagtgtgaaaagaaaggactattagaagaagaaaggcatgacttttattacttaagtgtaattaaaatggctaagtagttgttttctattttggtattctcaggcagctgtgttttggccaagaggtcaattctggtgtacaatttgctatatatatatatctgtgtgtgtgtgtgtgtgtgtgtgtgtgtatgtatctccataaaaccttaccataattaggataatgagcatatacatcacactcaaaagcttctttggtgccctttgtaacccttccctttgaactcctatacccctttcttgtgaaaccaccaatatgttttctgtcgctctatacagtactctatgtttcctagaattttatataatttattttttgtggtggagagagatctggcttcttttattcagtgtaattattttgagattgattcatgtcgtaacttgtgtcagtaaatcattcttttttatgttgagtagtattccattgtatggatatatcgcaaattgtttatcctctcacttgttcataaacatttaggttttttccagttttgagctgttacaaataaagctgctaagaatgtttgtttacaaattttttttatggataatgtcttcatttcttttgggtaaatacataatggaatggctgaatcatatggctagagtatgtttaatttcttaagaaacaatctcttctccgaaacagtttctaaaatggttgtaccattttccattcctaccacaagtgtatgagagttccatttcatacatgtactcatcaatgcttgatatagtcagtctttttatttagccactctaatgtgtaatgatgtaacagtgtcattttaatttgcatttctttaatgacaagtga

SEQ ID NO: 64312 - DNA, 2996 bp, Homo sapiens
cagtttcccttttaagtcacttcatagccctagcagcagtttagaaatgcaaaagtttggttgctttaaagaatagttcttgagtggattcttaattaagtacaataatattttctctttgattttaaagagctttactgcccagaatggatacacaataaaattttgaaaggaaaaagaaagttagctgtatcccagttttctaaaccctggcaagctggcagagctagaattagctttacagatggcatttggcaacatatctacatatctctaagccctcaactcctgcgttttgttatgcctgtctatcaattacaatatccaatcactgctcagagatggagaaatgggacgatcacagctcacacgatgctgttttgttagaaacgtcagtgctgcacaacccacggctgagtcagtgtctgtgagaaaataaactgaattaatatgtagagggggttgtatctctgaatatttaaagcctaaatattgcaacagcattattacacagtagagggaggaagctaaaggaagtctatggacaggtgaggtagggggagactggggaattttctgattgttcagaggaatcttgaagatgatggaaatatcagatgtgctaaagtttcctagtaatgcccaaggatgctgacctggctttcagtgcttcattgtttgaaagagcagagtccctttatactctgatttcaaaatttttttcttgtttttgtgtgtctaccttggcatatactaaaggaaggtgtgtattcatttattacatgatatctctgggttataattatttacatatatgaatttgaaagaaagattgagagggatatgtgtgacctttgtttcattatgatcatttacatgactaaagataaagatcatatgtctgattttcagtttaatggcaagttacttaaaataaatgaaatatgtttttattgttttcgtgggtttgatgctttgtgttttatttcaagtaacttgagaatgcattgtgtttggtactgttttttatgaatatcattaaaaatttatttaaggagagagtaattttgcaataatatttttgatttatttgaaaataaaattcaagataaatgaaataattgaaattttctaaagaaggaattgaatatatttttacatttgaatgaactaaggattaactgaaccatttatatatagtactttacagaactgaatgtacttaaatgataaagctctaattggttaaagtgactttctttcaagtcaaagaacccagaaactgaatagatgatctaactactgccactgaggttttggattagtgagtataaattttcaaccagacaaaatttctaaataaggataatggtttttcctgtgagattttaaatcttaacaggtgatattgctcactttattaggaaattttacaacaatttaaaacattttgactaatggtttttttccttctctctttattacccttatcctgctgatccttaatttttttggacatttgggatatacagcattttacatttactttgtttttaatgtatttatatggtttataacattctttccttgaagtgtcaggaagttcttttaatttcccccatttaatttctaaaagtttgaatggtcatcttatggttgtcatgacttatttatatagttctgttcgtggtatcttgtattgactttttttgtggtttagggtccagaaatgtttttgtcagcttattaaatagagttataaaagcagaatctcaagctagaccttttaatcttatactttataggatactttccccaggttgtgctgattcttttaagataataatgtctgtcttattgtgaaaatggtacatactcattaggtaaatttggtaagcccagaaaaacatatagaagaaaatgaaaataagtttttctattataaaaagaaaaataaatattttggcatataacctgttttttctgtgtatatataaaaatctaaaataacacatatgcacttaaaaaggcattactgtagtgctgttatgtaacctatccttgaaaaaaaagaaatttaattatgaacatcctttagtcatgaagtgatcttctattgcataattttaaaggattacatagtgttttgtacatacatattttgtaatttatttcaccaatccgcatttttctgataactgatcagagaaaagatcagcatgatttcacagcataaatatctccaaaaagaaagaatgtcttaaggagttaagtaaaaatgtaatattgattatttttctgacagagaaagatcttcagtgtgattacacagtgaaccctttaaagacatacacattacttttaaagcaaagcaaatagctaagataaccatcataaagtataaaaaataaacaaaaaatcaggaaaactagagctcagatgaactgagacttcagaaaaatgtcaagaccaccaaaaaaggtttcttatattacatttaatgtaagaataataatcaaggaaagtataataataatgcatgacaatgagagggaaaaatctagctcttgaagcttctttgtcaaagtggaagaggaaaccactaccacctctaacagaaatagaaataagacaaacattgataggaaggacatgaaggccaatatgagtatagaggtaaagaattcatctgattaaatgagttgtcttctgggccatttaaaacatcttataaaaggaactgcatgcaacaccttaaaattattgttattatttgtgatctttgaaggttttctgagaataaaagaactgctaaaagatgggagattctgggcttgattttgaagcaggtaggagattttggaattaaaaatggaaaggactcatttatgactgacttgaagaaaaacagtttaaaaatgattagggataggtttgttaaaattagattgccagaccaacttagatttttctctgatgcagttagtagactagca

SEQ ID NO: 64313 - DNA, 1080 bp, Homo sapiens
attcatttcaagtttcaggccatctatctattatttttaaaactttcattttctgctgtgtaacttaatgaggaatgcctcattttgtacactttgatctgaaattttaagatgttaattgacaactcagaaacctcacatattacaggtatgtaagcatgttttcataaagcaatatcttctatgaatattacttaggggatattattgagcatttaacttacttgaatataaatttcttcttaccactgataacaaataccagctttcttgaaaaaaaaaagccataatattgtgataatgaaatcgtttttgtgattttaaagaaatagttcaggtactttatatactatagctagaaaatttgagtgattggtactttttaagtctcctgataatatgttcacttttattgtggacttttaatgttatgaggtctaaaatgttaatattaagttgactttttaataatttataagtccatgccaaattgtatgagtgtttttttggttttttatgtttgttcattctgtgtgtgtgtgtgtcagcatccaaactggggcttttgttctttttctctatttcatggatattattttgtcatttagattaaagatatgttggttttgccaggtgtggtggttcatgtctgtaatcccaacactttgggaggccgaggcaggcagatcacttgaggtcaggagtttgagaccagcctggccaacgtgacaaaaccctgtctgtactaaaaatacaaaaattagccgggaatggtggcatgcacctgtaattccagctgcttgggaggttgaggcacgagaattccttgaacctggtaggtggaggttacagtaggccactgcattccagcctgggtgacagagtgagacgctgtctcaaaaaaaaaaaagtattggttttatcacattaaatgtggggctgtatttatatctactatgttatatatatgtgtatttttttcaagtgaattatatagtattcatcctagttcttgctgtttttctgctgaaaaacagattgctaaggtataatactgcactatataatgaagaggtgaca

SEQ ID NO: 64314 - DNA, 1019 bp, Homo sapiens
attgacatatttttatgttcaaaataattcatggtttttatagtcatctaatacctgattgatttatgatacagtcattcttaaggaaataacaaataggaaataggcttccttttccaggagcattcagcaaataaactatgtggcatttgctcaggaatttgcatcagtcatagattcaaaggaagaatttgaatcagcagttcttcctttcccccacttttatttttatttcactcatggatctacctacttatttatgtatttattatattaaatgctcatttattataaaattttcagctgtttttagaaagaaggtactatgagaaaaaaattatagtaaaattgtttctctaaaatgaaaatgtattttctactgatttttgatatgaacacaattttaatgagtttatctttggcattctttgtgaacttgtactgcaatactgtgtaaaactcaggaaagtatagtattttcccagttttggaatttccctttgacttttatgtacaactctacctcacctcccaccatcaaatccagcttggaaaagtatatagaaggtatacaggagtgggtgtcaggaaacctgagttccagtccaaattgtatagctttgtttaaattgtttaacttcatttggtttctcttttggtgtctgcaatttctgaaagtcaaatcatctatttccaaacaaatactttagtctcagcatttttcgagatcaagattttattctatatagtgaattatccttgttctttataataccatttagcagcattgtgatctttggcaaagttactaaaattctgaggctttctattctgtatatggggatcataatgcctaccttgcaaggtgattgtgaacattaaattggatagtgaatgtggtttaaaagtgtttagctcagatattctgtaaagctgttgttaagtgagtttccttatcatttcatttgactatagtagaaatagcagttacaagcctcacatgtgaaaaggcataaagt

SEQ ID NO: 64315 - DNA, 1103 bp, Homo sapiens
aatgtagttaatttcaggagttggtcagttatcaagagagctggttattataaaagtgagcccagcccttagtgttttctctcacccaagttctcttgcctttctaccttctatcatagatgacacagcatgaaggcccttgcctcatgctactgacatgcttttggactttccagcctccagaaccatgagctaaataaattcctgttcattataaactacgcagtgtcagatattctgttacagcaacagaaaatggactaagagtaagattttagtaggctggatgaagccacaagatggctgaggtttaaaaggcacattgttggtaataagcaaaaatatcaattctttttttttttccctttaaactcttttggacttgaaaaaagtaccaatttttatataccttgcttggtgcattggaaataacatgggctttttgttagactggggttttaatcttatctcttaagatttcctcatatatgaaacaggataataatatagagttgttttaaggtttaagtaggagaaaatatataaacttcctagaacttcgatagtgaaaatagaataagtggtctccatacactgtgcattgtctttgttttgttttgttttgttcttccatttatcattaccattaattgatactacctggaaatagtgtcccgaggagcaattatttattttgttactatagtcttgaagattctgcctatcccccaacccccacctcctgtttagacagaatgtccaagagaaggggaaataattgcatcatctttttctcagttaacttttggcagtctcctgaatgcctgcccctagccaacaggcccagtggttccagcctctgtacagatgatttctagattattttgaatttaaatttatttctatcatgcctaaacatagtaatgaatagtgacatattttccaggaattttattttcggttgtctggtaattattttttgatgattacaagatccaaacaacaataaactttagtttttctggacattggggattcaagtgccagattctgaaggacctttttatagtaaggagtttagatataggaaacgaggagccatt

SEQ ID NO: 64316 - DNA, 1026 bp, Homo sapiens
ttgtgagcaagtgttttgtctcagggcaaattttagattccttaaacttttcggacagtgcagacgtagaacatttccattatcacactgttgtgataatggaaagtcgcgctgagcagtgagtgctacagtctagaacttgaatcatatttaatagagcctttactagcctgttgaattgatggctgatagacaaaaatcggaaaggaatggaaggtaaggggaataatgaataggtcaaaatggaacagcataataaaggttatatgaaaaaacataaagcatcatggaaggaaaaaatattgtttaaaatattgtctgactttgtttaaagggtgttgcttcttaggagttgaccataatctcctttgatttaggcatcagcttcaggagcattgcctgtattaattgatattatgtcaagatggtttgcttcaactaaggtgtttctggttttgaagtcaacactttttggtcatagtagaaaattaaaacattgttatttctttaggatattaaaaaaatatgccttttgagttttaagaaggtagcctataaactaaacagtgtctagttacttaacaatgctaatcatgtaatgtaggtactttgtaaatgcttaaaatatggaaagattttcaaacatttattgagctgtttgtgatgggaaagaaacaaatgaataacacttcatttattgaagtgttaatgtgttaattaagaagtcagcaaaatttgaatagaaattctataaaagtgataaaatcaattagcacaaagattttatatccaaatcacctctggaacattaagggttgactgagctgactttggaagtcttaacatcttggtgaattagagatcaccctttaagtggacaacagggctgggcgcagtggctcatgcctataatcccagcactttgggaggccaaggcaggcagatcacttgaggtcaggagttcgagaccagcctgaacaacatggtgaaaccctgtctctactaaaaagaatacaaaattagcca

SEQ ID NO: 64317 - DNA, 1932 bp, Homo sapiens
aaagctttgttttcttaaaacttgcacggaaaaggttctgatgtctttcttcttcagatgcaggtgccctgacacccttatctttgggaatggggcgggggaaggtgagacatcggttagtaatttgttagtgtgggccagtgtgactgtccctgggcctcacagatttcctgcttctcctttctcagtattctgagtccatgatgaaaagtcactagtccagacatgctgaaagatagagcttcacttgcttgtggctttgtgcacttagtaaacaagattattttacgaagatttattatcttgcagagttttcatgctttttatttaaattagcaatctaaatgaaacagcacaggatattaattgtatttggacaactgagttccttcccgcccctatcctcccaaccccccaactacacaaatttgatcaaaatcttttagagagggggttagggataaattttcaatgaaagagactgtggaaatcggaataagagatataataaagaatgcagccataacggccaaaagagtttctgtattagagagcctgtccaggattgaagttcagtcctgaaacccaggactgcagttgtcatttgaatataaagcggaaagcagtagaaaatacttgggaagggatttgaaagtggaccaagactggtaaaaaaaaaaaaaaaaaaagtgtgagaagaattatttctgatgatgtaaatgtgttttataaattttcccaatatttctcagcgtgtatgacctaacagctattatattaatacatacaaagtaggaaggaagtttctgaagcatggaatgtggtaaggaaccaccagagagtaacagtgttcaatcaggaaagcttttagtgtttcaacaatgtttttgtgttcgttcaccttttttctcactcccagaaaagctttcagatagacttctaaccctatgtaattatgttacccttccaccagtctgaattttcttctttctcactccctctaagccatgtgaattttttaaattattaactatggagttgcaaaccactgtggtctgcttttggctttttataataggtgacttagggaagtatggaagtgatatggaaaatattgtgcacctttcaaagccatagcatgagcaacaaactcacatgccttcgggtactagttagataatgaaaatgagggaaatgcactatgccttatcagagagacatccaagtctcaggtccccctaatcagtgctatataagaatatggaccccatcttcagcattctcaagagaactcggaaatctagatttttgcattcagtgtcttgcgtcttaaaaatattgacaactaattaaaaccattaaaaatatcatgtgactgaatcaaatccaaacctgtccatagttgtattctcctctccagtttagaagctctgttataaatcaaaattaataaattttatgactggaaaaaaaggaggtttaaagcaagtttggagtttcaaacttaaggggtcttgggaaaaatgtcacatctaattgaaaacagtagttaagtttaatagcctttaagtatagttatagtagggcaatttgaactggtatttactataaacgttttaactgtggaaataactgaagaaaaagcatctcagtatttatggtttaaaaactcagagttctgagcaaagctgatttataggtatcttgtacagaaattgaattatttagaagctctttattgtatttgcagctaatatataaaattaaatacaagagaccctctacagtccatttcaggatttgaatgtttattgtttgctgtgctatcccacattgtcttcctaggcattgacttactggaagaaatactgatcccttggattttattccatgccagatggagattggaggggtttggcaacaggatggaaa

SEQ ID NO: 64318 - DNA, 1034 bp, Homo sapiens
ttcctagtataaagcactcatttacattttctcctgttccttagtactgaatatgcacagtattttaagttatgtatgtttctttttattttctttctttatgtttactctaatcccattacagattaatacttttttttcaaagacagaattttaatactttgcccaggatggcctctaactcctgggctcaagagattgtccacctcagcctcctgagtagcgagaactacagctataggcattcaccaccacacccagttttgtttctttttaaatacctcacacctctctacacttgtaccatttgggtattttttcagagagtggcagaattcttaatatagatccctagtcatattatgttttaatcctatctgttacaatgctttgggctgcaaataacagaatctctgtctaacagtttaaacaataaagacactctcatatacctaatatctaaaggtagtcagttccaaggttgattcagcaatctatgtatgtcattaaggacctgggctgttcttatctttctgctctgccagacgtcagaatcagaagatagtagccacagctctaataattcagtccatcagcctccacggcagcaagaaaaaagaagagactaaaaggacttttttttttagctcttttttttgtttgtttgtttttttcagaaaggaacatcttcctcagaattcttttccttcctcccccagcccctgaacagattttctcttttatcttgccagaactggatcatatgcccttccctatataagtgccttatgaaagggcaggggggaaccagtgaggttccccactattttttttttgcccttctgcaaaaacacagcaacgaggcaccttctaagagggcatctcttagaggcagagagccctcagcagacaccaaatctactgacagattgatctggaacttctcagcctccagaaatgtgagaaataagtttctattatttataaattacccattcttagatattttgttatagcagatcaaatggactaaa

SEQ ID NO: 64319 - DNA, 1220 bp, Homo sapiens
tctttgccccgccgccgcccttcacagggccgggaccgcgtgggggacgtacggtggggcctggtttgcagccgcggagcccggggagccgcctggggtgggaggccgctagaggtggcgaaggtggggcggggtggttagccgagcagcgggctccgcgtgctcgcgggagggtagcggcaaagggaggcctagtgattgcaggattccgggtctggggaggaagaaagtggtgggaaataggtgatgctcagaaaagggtgctgagggagaaggcgcggggccggggagtgtggttggcctattagaagtaaggattgatagggcctgggtggagatcagctgggagtgaaggggggacgggcttgggttttgaaggtgaaggtctctggagaactggggacacgtggatctggagtaagaggcacctactgaaaccggaaggtggctgagaaggttttatgtgaggtgtggacgggaggctattggactagaaggcattagttggtctgttaggacaaagtatacaagcagcaaacgcggtagatttatgtgtggtaggtgaaggctgtgaatcttttatgagtagttgagcaagaacagttgtctgattctgcggtgtcggagagtggagggtctcaggtagtgtcttggtcaggtttgaaggttaatttactgctagtggagggccaaatactcaaaagagtttttaattctcactactggggctgatcctcctcctacactccacccctcctgccatccctgtgacagttcatctcgttttgcctcagcagcacaagaactcactccctccgaagtaatggcatacatattgtttgcttttgactagatggcagtcaggaatcccttaattctttatgttaaaaaaaaaagtgttggtttaaagacaacatcagaagatactctcagaaaatctgccctccaggggagtttctcagctgtcatgttgggcatgtgtaatatagcataaaaatgatgcaagatctcttacagtaatacaagtgagaattaacgtataagtacaatcctgatgtatttttttcaaattaatttaaaaagtaaacagagacagggtttgctgtcgcccaggctggagtgcagtggcgagatcatagctcgttccagcctcaaactcctcggcccaagagatctttccaccgtggcctctcaaaggcttgggattacaggggtgagcc

SEQ ID NO: 64320 - DNA, 1053 bp, Homo sapiens
tgtatgtactgaaaggtggtatttgcttaacctgaaggatcaagttactaacccaccctgaatggtggagatacagtctttgttttcctgaacacttgttttcttagagtttaatacatgaatttaaggtttaaaaaaacccaacaaaccactgatagaattgtgtcattttaactgcttcttttggctttatatccttcttcctacacattggttctatagttcctctcattaatgggtttgcaacaggcttagagtttcagttcagtaagacaaaatggaagtgctggatttagatatagctgatcaacttaaacacttataaattcaccattgttttcggttcccaatttgaagagtggagacagaagtcaagaaaataagcttttcttattcaaagaatgattcccaaaccaataggatttgccctaggatcagtacagacttattacagtctcctaaacagagaggaaagagttgcgtaaattcatctagcttttagtttaatttcacttagcccatagggattctgagaggaaacgatattaatgtgattcctatttcatctaggcactgtagcataatccttcaacaaattaccacatttgattctcatataattctctaaaatgtgaataccatattacagatgaggagagtgagactcagagaagttagtaactttccaaggttggagagctaagtgacagagctgggattcaaacctttctttgtctaactccaaaactccatgcttgtgaaactaatagcacggaggactgatttataccttcaactgaaaaaaaatgccacaagccttaggtatttgttaccttagaagatgagactcttgctctgagtgtttgtgctctgtgacactgcctctaaataaatgacagtgattttttagtgtctaataggataccttatattttcttgctttagagatgtatgttttcatattttagaattttttgaagatgtatattgtctatatttacttcaaaatgtttgtgaaatggttactatgtcttaaatgtatctcaaaattga

SEQ ID NO: 64321 - DNA, 1032 bp, Homo sapiens
ttatgaatttgtgttgggctgcattcaaagccatcctgggccatgggttggacaagcttgcattaaggccggcagcagaggctgaggacttaaaatgtattctgagcgctataaatgcttttttcttttgtttgtttttgtttgctctctcctgatccactgcctcctccaccttcgtttgtggatgtttggagcaaccatcaggctcaattccagttctcttttgtccctagtacccatgctggatgctcttctcaatcagatctagatactaagcctgggagccaaagtttatgcagaaagtaagactgtcatgagtagctctgctgttctgtgagcaatcttttaattatcttgatttccttatgatttagtccagcttttggatcctgaccttgatgttttctcccaggttccatttaggagattggtaaaaagagctcttgcctcattatagtcctttcctgtccttgttttgcttgggttgctgtttcttctggtatggctattctaccaattcagtcttatctgtttcttctagaaattcttctgtttcttttctttcttcctttttgtttgacttggtttaatggagctattttttccaggttgttatgaacatatattttttaattatgaaaaatttggacataaatcacatgtatctactccccagcttaaataaaacataaatacaattcaagctccttattctctctctggttgtattgcactccctctcatgcatctattaatatttttccatctgtatgcattgctaaacaatacagagcattgttttgaatgtgttagagctttttgtagtgacataatacatgaattcttctgcaccttgtttttattttttctttcattatggttgttttcttaatatgtcttttctgctgttttagaggaatttgggtagagaagataagtcagctcatgtatttcttactctaactttttaaaaggggagatttaagcaccttttggatatactgtcactaagagacacgtagtagaaagggc

SEQ ID NO: 64322 - DNA, 1067 bp, Homo sapiens
ctctgtcaaatctgggataaaaagttaaacttgactcacaattgaatatgcctttaaactgtaatcattttgtgatctgattgtctagcaaaatttattcctttgggtacacttaaagaatgtttaatgttcagcttaaatcctatatatgtaatacttctgaagtttgttcagtttctggtttgcgtttgcttaccaactttttccttgaacatattgactttgttttcctttttaaaaatttgttctaagattttaggtagaatgtaaatcgtgtttttttctaatctactaaaagggaataaaataaaaatgaagtgaagtgaaaaattaagatctagattttagaaatctgaatgatcattttaaacattgtcctaatgtctatattgctgaagtctattctgaggggtgatacaatctaatcagccaaggcatggacagttcaaattcaactttgtgaactaccagctttgtgtacttagcaaactccttaactgctctgagtctcagattccttatctgcaaaatgaggataatagcgtgggcctcatagggtgttttctatacagaataatggcaattaagaatagcaactttaggaattgtatagtttaagtttctaaaaaaatagtcatccttggtgggaaaaaaatggtgataatgagttttagaaagtggaaaaatactgctgtaaaataaatatttttccctcttgatagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaaggtaagtacaagtaattatataatatttgaacttcagtatagttattaaaaaatctcattttaattctactttttagtcaatttgttttgaatgtgatttgatactatttgcctatgttaactgtggctttcagtgtcctacagagtgttaaaagaattctcttcttctt

SEQ ID NO: 64323 - DNA, 1189 bp, Homo sapiens
gttaaaagtatctgatgatgaggtccaggagtctgcatttttaataaactgctagttatatgttatgccaagtatgagaaccctggtttaaggtctttagaagtattatcaacatagatttctttgaaaaacctaagatgcctgtagaagaaagacgaacaagaaaatgtattggcacttcaggtcgttgagcttttttttctttttaaatttttctttgaagtgatttccatgtcttcatttagtgaaggattctaattacaaagactttctcattttgtacccccctcccaaaagcctgtcttaccgaagatacatttatgactccatataaccaaaacaatgagaacattatttttgtttagtactaaatgacttctgatataacatgtcagagtctcagtctgaaggtcaatggagtagaaattggattgaggtaaaacacagttaggttaactagcctggcagagagatactagatgttactcacttgggtgcagaatggcttcaggtttgggctctcaggtacagatgcaaagggaaaaaggcaaggcatagaagtgttcctctcaaattatcccttattttcggtgacctagaaactctgtcaccatcctcagggacatgtaacagaatatcctttgtgtacttttcccaaaacatggctcttcctgcccccattgttttgcaaatgcaaaagaaaatagtgcattcccttatagtctagtggacagtatcctctatgtgaaatgtctttcttgttggattttcacttgaacagattttctccctcaattaaggaagaaaaaaaaatgcatccatgattttaagaactcaacccaattatttcattaaaaaaattatttctagtgtgttttcatagggtcttggatactattaaattaaaagagaaactatggcacaggactttttttctctcctggagttactccttgttcctggtgacccaaaacttgtcctgtcctcaggaacctgtaacagaatattctctgtattcctctcccaaacagtaccctccctatccccattgttttgcaaatgtgatagacatcaaagcactgcttcactttacagtgaagtagactggattctatctatgacatctcctggtcttttaaaacaatagttggatttttttcttaaatactgaaaatataagaattttaga

SEQ ID NO: 64324 - DNA, 1035 bp, Homo sapiens
ttttactttttctcttactaacaatatatacaaacatttgagaaactgaaaaagaacttgtaagctaatgctgtatctcctttccttgctgcaaagaaatctagctaacataattttaagataactcatgggtttgttctgtaaactcgttctagtaataaggcttactagctaaagtttctcctgagtttaggcaggtttttttttcctcatgtatcaactatccctttcatttttcaaatctcatctccatggtggaatttttcctaagttgggtagcaatttcccttcaatttaattgatgttcttttcctttcatatacaaaaagtacttccatatacagaagaaaattttatcttgataatctctgttttatgctttcttatcaattagtatgggtatcattagagtatgacaatatactgagtctacttgcatacacagcattattgacaagaagtaaaaacaagtacataatgtattagaatcagaagtttaggaaaaaccatggacaccacctagtatatcgccctccttttacagatgaacagagtagaccatttcttcaaagagaactggaggaatttttttgacttcatagtaggttgctaattgaatttttatagcatgcttcaatttatttttattgttcatcatagcatttgttaatctcattagagcatatgatttgcagtgctgcaccttaaatactaggccttttatgccttttgtgttcattataaatgtatgttaattataactgtatataattaacatgttacttcattaggtggttatatacagatctgtatttcctaacctgcaaacttccagaaggtttcagatatattttggaatttatttggactttagagagggtatataatttatgtactgtgtaataagaaaaaactttaacttgatctgggttagtatccctgatcaaatacatgtaaaatatatgaatgtttaagttgtatcaaaaaaaagaccataagtcagtgtagatcagattttgctatccactgtatgat

SEQ ID NO: 64325 - DNA, 1333 bp, Homo sapiens
aagtcagaggagatttggtttgtttcttagtagcaaaaagaggcagaccttccaggaggtagaccccttcctctgtagatcacaaagtaaaaaaggtacagggtgttagggtatttgtgaattcctggaatgagagaaagcagaaatataaaccagttgggtcaattgatttaggcaaaacctaggtctgtgtaatggtagtaagtgatagcatctgttgttgctttgacaattattctatttttctctgttttattcataattttgaggaggatttaccattttccctaatctcaggctattgaattagtaaatagcataaaatcaaacttgaacaagcttaattttgtaaaaatattcaacaatataaaccctcttttataaatttctctttgcagagagttaatggaagagtagtaggtagccctttgaaaatgattttactcaattatttttgatcccagaggaagactgcttctgtttgggactggtagaaatagtctggcctgaatctagtctgttttttagtttttagaagacagctaccaagtatatatttggggttgtagagttcaaataataaatctctagcttcataatgtttctaagcttctctcccttttaaaatttttggtattagggatggattgataactttaatggaccaagtggtctctttattgcggtaagtaaaccttttgatttatttaatattctatacatttttctgctttttgtatatctttaaatatatatacactatggcttatatatcttaaggtgttgtttttaatttcaacaaaggcagggaaaggaattcttcgaacaatacgtgcctccaacaatgcccttgcagatcttgttcctgtagatgtagttgtcaacatgagtcttgcggcagcctggtattccggagttaataggtatatgaggtgacaatgtcgcttattaaatatatagtaactgaaaagggaagacatagcttttgagtaatgttaattaatccctctatccagatattgccataccaatatttaggctgtatcactgccaactccaagagttggtattatcacagacaatagcaagtgctcccatcagtagtaatgaagaattaatgttaatgctcatgtattacttacaggatagacaagttcacttaaaaatgaaaaaaaaaaaaataccctcccctaagcatgattttttaatccaaactaaaacttgttgaatatataaagagctgaaattcacagaatatggtttacatatattaaacatggtacaccagagcagctttaatcagcccatgaacatctttcctttaaaaaataat

SEQ ID NO: 64326 - DNA, 2025 bp, Homo sapiens
tatatcaagtggtacccagagtaataaatgaaggagttaggaagtaggatacagtttgccagaatattttctattaacctgtattaatctatttaaattcacagattcacagcagatatacatgttcctagttctataggaatagcataacttaaataggaatagttaaaacccattgaaattgagtcaattttaaattgttggttgatgagttcaaatttaaagtaaaatttttttggcattgatttagtgataggtcttatttaacctctaattgattaattacccctgcagaacaattttgatttcaatgtagattttttatgacatttgtcctaggatttttctgtggcatttttatttcagtgtaaaattgaccattagagcatataagaaaaagataaaatctaaggtgattttaactttatgataattattttcagtattcttttaagaatatttaaacatttttaatgagttaggtttttttgtaatcttttattgtgttataaagtttagtaaaagctgaaattgagcgttatattttagtgactatctcaatatacatttctagtaaagtattaatatagatgatactaggtttgattatgttgacattacatagcctatataaattacaacagaagttaattttgggttgttttaagcctgttaatgtatgttaatttgagcatcttaagcaaaggatgattattttccttttcttttttaagtaagtacagtaataagagtctggaaagaggaacagaaaggaagaagctatcgtgagaggtgaaatatagaaagtgacactgtaaactgacataggtaaaacattaaaaggattttaagagtgaattttagcaaaaattcattcatctaaaattcataaatagcggcagttacaaaaccacttgagtttagcagtctaataaccatattctcttagctactagagagtagaaaagtttgttttttaaatgtacgaactctgacatctttggtaaaatattttgcattataaaaacatgatttttttttttcaaaacttcattacatggttattatcaaagctgttacacaacttttcttcttcagagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggtaatggtgactagctctgtcttatctgttcctctgttaaacaacccatgcttacactaaaatgcatattaactctgtatttgtttatgcttatgataaggcttaatagccttttgtgaatgagaagcctcttgaatttaagactttgtcagaaaagcaaaggtagtgttgtaagtcactctaatttgtttaaagtttggataagttattgtcatgtattgaattctaagtcttactttaggcttctttctgaataacaatatttaaattgctttgacgcttatttttcctacaggatattatgtaagtcattccttcaagatgaatcctttaaaccaagtattcaggtgccccagttttaagtttaattccaacagcctatcgcatcattatcggaagggtgtcagccatagagtatctgcattattgctcgattgcactcatgttgacaggtcagaaaccgcggtaagaagaatagcagtaaatacactatgtattggtaaggtggtggcagcttgctggagagatgaaaaaaatcactagcatgagctttacctttagatttactcacctgattaatcacaatcagaatgctaggacatttcttagaatttggagatctttggggacactaactatggatcacatcgtattgggtcgttcatcctccaaaattccataatataggaaatgtcctacatcatggttgtcattgttattataagctgaaattaagcccttctctccctcttaaa

SEQ ID NO: 64327 - DNA, 3495 bp, Homo sapiens
cagggttttgtcatctaaatctggtcaattggcggatgacgctctttaggagtgattttgtcagcatagctcctcaagtatagttcctcaataattgatatgtgaactaaagcaacgagttactgactgcccatacgcccatcataaatgatggtaagcataggataatggctttagacagttttattcaaaaagagagaaattgggaggcacccagcaaacactggtctataacatttctgaattccagtcagatatgtgttgatgatttcttgataaggagctcagtcttattctctgggagttctctgaggttcttgcctctgccctctgagtcatccttccttttgcataaaaactggcctgtgggctctgtgtgcagccaagtagccttcttatcctgcttcgtgcccatgaaaggttaggggatcagggcaggaactggaaagcttttcttgtaaattaaggccatatagtaaatattttaggtttagcaggacatgcggtttttgttgaagctactcatctttgctgttaaaaatgaaagcagccatagacaataggcaaatgaatgaatatgactgtgtcccagtaaaactttatttacaaaaacaggtggtgggctggatttggtatataggctctggtttgctgacccttgatatagcagtctcttcattttttttttcttgtctatccctttacatgtaatctgacatgattgcttaaaaattgtgtgagtttccggtgtatctgttttcaaggaatccagcctattagacgaaagccatacccataagtttctttgacacaaacccttctctatcttgggtcccctgtgaggttcctatgggacagcacttttagatcttaaatccttgcctcttagatcctgccttttgaacaataagagtttctgttacacatttctttaagatctggagagtgccttttgtctgtctgaaagttctggaaggcactgcctaggtctttctaaagtcttagcaaaggattcatcttcccctaccctgctatgctcagaaactgtttcttaaagaattcctggctgacattttacatttcctccaaattccactcaaatagttcatttttttaagatcatctttgtcctcttttgccctctttcagcaaatttctgctagatcattgagtttattagtacactttctatattccatataaccagaggtgacagtttgttgtcctcacttcaagccctcaccaacagctttcttaaaaccctttaaggcttccattaataatgttttcctggtcctttcacatttcactactgatcacctcacaggccttagagattttgtttaccacttgaccctgaagccaataccacatgttttaggtttttattatagcagcccctcccagtgttgagatctgtgttgagatttgttaatctgttttacataacaagtcacctcaaacttagtgtcttaaagcaatcattttatttgtgtgtcacaatatctgtgggtcaggaattctagaagggttagcttgatggtaatggctcaggatctttcaaatgattgtagtcagacagggactggaggaactttgctgtggagggagtggtaaaggggggaaggggacagagtagctggggtggctgggcatctctctctctccagtagtgtcataccctctccatgtggcctctccatatggactagtttgagcttcctcgcagtatggcagcctcagggggagttggacagcatacacagtgactgaaggcttcaagggtgagtattcagtgagcaagacagaaagctctacacctttctgacctagcctcggaagtcacatcatgtcacttccacctcattctgttggttctaagttattttcaactctcattgagaagacagtcaaggtgacattgtattgtaggtgggcatgtaggatggagataatatcataggcacctttggaaattaatatctttcctaaataggaaacgttaaggaaacagtcttcttaactgaggtttgtgctgtgtgaggctttctaagtatcaaagcaggacagatccttgacctccgggagcttataatctgaatgcaacaaggaatataaaggtttttttacttagacaattttgtaaatgttaaatacaaagtcttataatttataatatttcatttgttcagaaatttattgagcacagtaatagactttacaccttatattggggccttactatgatgcctaattctacattaaactgatgtcagtcatgtcattcatttcatccagtttacttgtttacataataattctgaatgtgagctagataagcatctgacctgacattttttaaaaaatggctccatgatcttatgttttggttaactagcataactttatctagcttaacttctctaaaccaggtatctatttttaatctgtgtacttctcagctggagacatttgacaacatttgcaggtatttttagttatcacaacagggggagggctgctaccagcacctagaggccagggatggtgacaagcatcttatagcatgcaagatagccctccacacgaaagaatgatcagacccacaatatttatagtgccaaggttgagaaaccctggactagataatcattaagatcttgccttactctaaaggattgtgattatttttttaagttgccataataaagaataaatacatattcagaacatacctggcaatgtagtcataaacatctgttctaaggtatgtttaaccaaggagtgatggtgcaaagttttacatttcttattccccaatagttttcaatccagtatttttgttgcatgataaatattctataaatttcacacacaaatatatggcctttcaaatttcttccccctccccgattttttattgcaattattttttgaatggctgaattactgattgatgttagggtgattgtgtcacttgaatgaatctgaagataagattaggtgagagaattatcagtgaacaagagttaagaaaaactttttaataaggtatatataggaaaaccgtgttagctgtgtgtgtgtgtgagatttaagtatgctaaactggcgtgatagtatatattgatgtagtgacaaacttgttgtatctttttgtttagaaaaaaataatcacctaatcttttctaagagcagcatgtgtttttcccccagatgctttttatctacagaactatccctgtccagaaattgccttagatgcttgataattcgttttgtgtttgagattttattttgaagttactttattggatgaaatatagtttttttttacatagtttatattgcttcattttcttccagtattctggattcagagtttatttctaaatgtattgaattgtgttatcagaagtgcttagctaatgatacttttttgatttttttctccttatttctaatgtaatttccctccatgcccctcccatttct

SEQ ID NO: 64328 - DNA, 1778 bp, Homo sapiens
tatctatttcagatagttttcagcatgagtcattgatttcacagcacatccagatgatcaagagtggtgccaatcattgttaaagaaaagttgttttgtttttttaaatgaatagagttgactatgtggcaaacgaatatttctgtattgtttgcttcagcagtgctgaagagttggaattataaatataacacagtatgttattaattcacaggaaatcttagcaaatgcagctgtgaattaaaatgtagtttaaggaatagaaagcaaggaaatattaattgaatccattcatttgcttagtattttatgtagaaaatttaagagtattgtataccctttgagaattaattctgtatatcagcagaactctgtttaggtggtattaaatgcatttgctgctgctttcaaaaaaaatttgttttccttttggatttataaattgttcatccaagatgcagaaatagtcttattccctgctgatttggtacacttaatgattaaatgttataattttaatactaatgtctatattatagggggaaacttgcaccctgggtggtgataggatttttcctaatctatacaaaatatgaatctgtccatttttcttacaatacaggatgatgaaaacaataactcgtcttcacaaagctatggtgtttcttgaatatttcacaagtaattcttgggtttggaatactgagaatgtcaatatgttaatgaatcaactaaaccctgaagataaaaaggcaagcaagtattttctgttttatattagaaaataagtagcatactaattacagaactattagcaacctgagaaatattttccacagctattatgcaacaagtaagccattatttatagtctctcataaagctttagtcataattgttagtggtgaaataaaattgctgtatcttaacatttctagtgtaagtattttagagtggcaaaggtattttcaaagcatgattgaaatgttgattctttttttcccttaatgttggtttcagagagaattttatctttatgtgtttttctttcaaacactttgttttctcttgagttttgagaaaaagcttctctaagaaattgttttttataaactcttttactttttgttattccacattttgccctttgttactttggaacttaaattctttgtgtatgttctttttgagcttactctagatgttttaacatgtatatctaacacagactaagttaagcaatatttatagcctccttcttaataataataatatttagaaccttaaaatgttttagttgtgattaccactcccactcacttaaaatggttgtattaatacattacttcagttctctaattttttttttctttttctttttttttgagatagagtttcgttctgtgcccaggctggagtgcaatggcacaatcttggctcactgcaacctctgcctcccgggttcaagcgattctcctgcctcagcctcccaagtagctgggattacaggcacataccaccacacccagctaatttttgtatttttagtagagacggggtttcaccatgttagccaagctgctggtctggaactcctgacctcaggtgatctgcccacctcagcctccccaagtgctgggattacaggcgtgagccatcacacccggcacagttctctatttaaaccccatgttgagatactcttttgttcatttagtttttatttagatttctccctctctctctctctctatatatatatatatatataaaatatg

SEQ ID NO: 64329 - DNA, 1532 bp, Homo sapiens
gcctcaaaaaaaaaaaaaaaaaaaagactgtagatttgggtcattacagtttctcaagagtttcttttttcatccagtgccagcttcctttctcttcccacttactttttttattttcataatgttttatttaacctaacatataatcaaaaatattgtttgaacatatcaaaaacctaaaaattatttaaaggatattactttctgttttttcatactgagccttcaaaacccagagtgcattttatactccactgcatgtctcagtttggactagccatattaaaagtgcccaagaggcacaggtgggtacagaaacagaagcctgtactgcctgcagaaccatgagccagttaaacctttttatctttacaaattacccattctcaggtagttctttgtagggttgcgagaatggactaatgcacctaatcactacctcctctgtcttcccagagggaacaactcttgaattctagcactcaatattagttttacctatttttgactttatataaatggtattatacagtattttttcattcttctgttgatagacatttgagttatttccagtttctggctattaggaataattatcctatgaacattctttatgtctatatgtacacatttgtgtagggtatatacctagaaataggatagcatagggcattcatatgttcagtttagcaggtaatggcagttttccaaagtggttgtatcagtttacattccagagggcagtgtatgagagttcctgttaatccacatcctccataacacttggccttttaattttgattttcaattttagccacttaggtgatatatagtggtataacaaaatgattttagtatacattacctagtacataaaatgtttatttaaaaatagtaaaaaaaaaaaaaaaagtaatcctattggaaaatagattagagagatgaacagtttacagaaaatgattcccaagtatttgaaaagatactcagctttactcagtggaaatgcagactaaagttagactgggatattatttactatttatcaaatttacaaaaatgcagacttggacaatgtactctagtgagttcctggacaaatcagcatccttacacattgctggtagaactatatggtgtatgtttctccattcttttattttcagtcattttgtatcttatcttttagatatgtcttttgtaagcagcatatagttagttgtaagcagcatatagctgttagtttttattttcagtctgacaatttttgacctttaattggagaacttaacccctatgtaattcctatcattttagatttagtctgactagtagtgctttgtatttgtcactctggttttaagttcttttttcttttttttttggccgccctttagattatgttttgaataatttaatattttcccatctatatgtgttacatagaattatgttcctttttggtttagtaggttactctagagattacaatgtcctttaatttagcaaggtctaatataaattgatac

SEQ ID NO: 64330 - DNA, 1954 bp, Homo sapiens
agcatgtatctgttattgttgttattaggttggtgcaaaagtaattgtggttttggccataatgcatgttttaattctatatatatattaagccacacaagccagtatttttattgcagcttatgcaataaatattcatacagatttaccagcgtaactgtccttttattgctctttatttcttcctccatccccagacataaatctagaatcattctcctgcctaaagaatatccttaagtttactttctctaacatgggttttctgctgatgtcagattgtctcaggttttattctctggaaatatctttatttcacctttatttttcaaggatatttacactggcatagagttttatttaggacttattttcattgcgtacttagaaaacatctctgtcttttggctttcattgcttctgttgagaagtcaacttacagtctaatagttgttcttttggaggtaatctataggacctttttctgactctcatatgcctagatgtgtgtgggggcagggatgggggcagtgggagttgtatttgtgttttgaattggtgacttggtttcttatttttggaaaatttccaggcattgtcttctcagatactgcttctcttccttttttttttttttaaataactgttcttatgggattcccaataacatacacatataccttctcaaaatgtttcctaagtcttcattttaatgcagagttactgcatttttatattttactgaattttttatagtagctttcccttcctagaattggctatttttagataagtgatggtatatactgaataatatctttgtaactccaaaaaattatcttattatatgctaaggagcactgagcaatgcatagccctcttactttgccataacatttctgaaggctttcttttctggatttacctatccttctcatcaaataatctaattactgttatccaaactccttagccagctttcataacatatcttgatgtcagagatgttgttttcataacgcatcttgatgtcagaagtattctccaggaaaattagtctgttcagtaggcatgaactggaaatgtatcagtacgtgcataaagtagtgaggaatacatagatctatgtggacaatataattttgtctttttttttctttgtttagcaaaatggtacaggcttttttcttcttatatttaacctacttctctttaaatgctgacattagtttccagattatcttctcaaatgtttccatgtttaatggatggtatgaactaggaatacaaacttttcagtgactagcggtaagatttcagaagttaattctgtatttaagaattttgtaattatgtcacttggaactggcctttagaaaaagtgtgaatttctgactggttgtgagaaaaattagtcaagaaaataatcagtaatttttttgttaacgtagaccttcaatattgatgtacggcagttacattgggcagaatatatagagaactactgcttgggaactaagaagtacgtattgaatgaagaaatgtctggcctccctgcagccagaaaacatctgaacaagtgagtttgatgcatggatttgattgcttcttgtcttccttatgaaatattccacaatttttttggtaaactggtatatttgctatatctgtcattcaaagatgcagataatttttaatggtaatctcttatatttgtagtgctttttaatgtgatttttatgacactttttaagactttcacattattatccctctcatgcctcataactctgtgcgactttgcagggcagccagttctatagatgaggaaattgaggcttaggaaagttatatttgcctaagccatattgtattgagtggcaaagcaaactagaatattgatctttgactccatattcgaacctcttttctctacatcatttttcttacattg

SEQ ID NO: 64331 - DNA, 3423 bp, Homo sapiens
gcttggataagggcttatccacttggcctttgatcttgtgactgtcacctgtaactgaaagagtaagttacttgtctgacaacttgtaagcaactaaagatgtcaaaaaaaaagtttgctctattttgtctgtactgtgatgtatgtaatgaatgaacctttttagattagatgggaagctctagaaattcaaggtacatatctgttttacctacagtatacttaatgcctatcataagtttcaaattaatatggatttgagctttgattaaaaactcagtattaattagctgccatctaacaatatttttttctagaaaatactgtctaacatatctcttgatttgctttccaggttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcagg

SEQ ID NO: 64332 - DNA, 1024 bp, Homo sapiens
caaacttatgtgccacagaatgatggtttgggaaatggaaatagatgggcaggaaaatgatttctgtggtcaaatgtttgcaaaatgctgtgtactagatacccttcttacagattcataatactagcataatgaaggttttgcaaagtcctggcgaaaaaaaaaaatctgtttaatttggtttcacccagtatttatggtgacatctattaacattcacagtttggtgaaacataggcataatctattttaaataggtttgaagtcctatatggaatgatgctgagaatgttaggatttcataccagcaaattagtcatgggtagatggagagggttccagtcctagcatccaagaagtcacttttttttaatggaagtaggcactgagaccttcccaacagcctttctcttttttaaatcctcgaaggtcttatttatgtatttggttcatttgtcaaatatagtcattttgacagacttaacaactgtggttaactccagcccacccctgaggagatcccgataagaaagcccacctaggcatcgcaatacctgcagttcttagacttccactgtgcttggcttatggaaaaaaccccacagaatctctgaagcatctgtccattgtccagactcacccgtcattgtctggcctccctttgccgccatctgtctggacattatttgtttctttcttagtttaatgcaagctgagcatccttcctcagattccttgagcagtttggctcttggcattaatctacactggtcattaagaaaaaatcagaattttaaaagatgaaatcatatctataaatgtcaatatataacatgtctatagtatctagttaaaatgtgggagatggccttgtggaaatgaacaaagacccctgaaatgagaacagagactgtgtgttcagagcctgttgtataacaagggagtcagctgccattactagcatttggcagagtctcaaagacaggcagaggactgggaaagccttctagtgaaaacaagagaa

SEQ ID NO: 64333 - DNA, 1029 bp, Homo sapiens
tacaagctcacaaacacccaaggttgagttataaggattttcattatcatattatttaaatatgtgcaaagataaccagatatgaactccttatgcttatagctctcttaagatgataaaaacaaaatagtgatactaataataacacaaataaaactgcaaacactttaaatgctaattaagaacattgctttaatgtgatgggtgatgctgttttgctgaaattaaatgactgctcacaatctcgatgcaatgctgaccctcgtagcctgggtccttccgagtttggtatgcatacaccagggccctttgggctaactcagttctcccactgttcttccaaccactgacaacacattgttcaggcagcagcacacgtatcctttgggctttacctagtcaaaatgtctttgatttgttaactctgctttccttttagaacccactctctttagcagctgggttctctgggaaggagacctgcatcaagattagagtgcaggaagttaccaaagaatgttcttgggaaccacagctgtgggaggcaggggaaggaagcaggatgtgcagagggagaagttgagctgtgtcgcaggcccaacaaagacctctaccaaccaactcactgggctgggtggctcttcagagttgtcctgccttggggacaagagcactgacctttgtgcccctggaggatcactggatgagggtcaccctggaaggaagtttgacctcacattaggctgtgttatctagccaatgccaaagaactgacagctaagagcaaccttttaccatcatccctgcagctgggaagtaagtccttcactcctgaagagagatctggacagagcgtcacattgtcttccacactaacgcacaataaagttgtatagggcaaccgtgagatgtgaaaacaaatgcatcccagccactgaactgcctggtgatgcttgactagatctttgagatgatccttaatatgtacacaatctattattttattctcacaaaaatataaatataaat

SEQ ID NO: 64334 - DNA, 1029 bp, Homo sapiens
tcttttttctttttgagatggagttttgctcttgtcacccagactggagcgcaatggcgcaatcttggctcactgtaacctccacctccagggttcaagcaattctcctgccttagcctcccgagtagctggaattacaggtccctgccaccatgcccagccaatttttgtatttttagtagagatggggtttcaccatgttggccaggctggtcttgaattcctgacctcgggtgatctgcccaccttggactcccaaagggctgggattacaggcatgggctacagtgcctggcctgcttattttcatcttatgaaataatttgcatgttagaaacctggggaggcccaggaattccatatcctgaggtgctttctgccagtgactctatgattctagagcagaagggtgtacaatctccctggcactcctaccgggaaaggtcgatgccagagtgggttctaacccagtaccttccgtgcgattctctcgatgacaactctggctacttgagtgatggacccaccctctgggtcatagaaaggactctgaggatggtccaggctggtcaggggccggattttctcctggggaatggtgggtttgttgggtgactgcaagaaaacatacagaggtagagagtaagaaataaaattgggaaaacccacaaaagccatttgttatatggatcagagcaaagtccttgataggaatttaacaagcataactactatttatatttatggaattgtgttcatgccacatactgtgctgagaaatttctagaactatattttaaaattcttccatgtccatggtaggattgtgctaagatgaagaagccaagtttcagagaggccatcccagctaggaaacggctgagccaggttggcctgaatcccaaactctttctaatagacccggcattggaaaacttttttagtaaagggccagatgctaaatattttaggctttgtgaaccatattgtgtctgttgctaatattcaactcagctgtggtagtgagaa

SEQ ID NO: 64335 - DNA, 1038 bp, Homo sapiens
atgagcaaaaacaggcctaaaagctgctaggacccttctactaccatgtaagcaagcctggctagaccactggagagaccatgtgcagagaagccccagccatctcatgaggccccagatacgcaggtgaggctggtctggtccaattgtgccaccagctagtagtagccacatgaatgagtccaaactagacccaagaagaaccatccagtggacccagttcacatcactgatccacagaatcttgctaagtgattgtttaaaaagactgttttgggatggcttatgcagcagccatataaggaacactaaaccactttctcttatgccttactccccaagtacttggctcccaaatgctaagtatagagaagtacaatttttgttcttcctactcagcataaacatgctgctctccaagaaaacttccctgaccccagagattaattaggttagatcttttgattactgcttccatagcactctagattcctcttttatagaacccaccacatttatggttacacatgagatatttgttaaccacactacagctaagagtcatggaggaatgtaccgtacaactatgtacctgccacatagtaggctttaatgaatgtttgttgactggctgactaccatgtagaacagacagcactttgatatgcaaacagctccctaatcataaggatcctgaaccatcaaggagatcctcatgcttcaaaaagaataggcctttaaaaatcagaaaacttgatgtacatgttaatcttcacttttttacatgggcaccttcagcactgaagtccctggcaggcattttctttttcttctgaagtcctggaactctgaagttaagctggagtttggggatgtataatctttctcttgggttacaaataaaacctatctggcctctgtgtctgtttgccatccccaaatcagtcaacacaggtctgatacagtcaccctcttgcttaaaaccacctacagaatcaggtcccaaaatccttggtgggccactggccttgtgtggtc

SEQ ID NO: 64336 - DNA, 1008 bp, Homo sapiens
ttaggagttcgagactgcctgaccaacatgatgaaaccccatctctactaaaaatacaaaaattagctgggtgtggtggcgggtgcctgtaatcccagctatttgggaggctgaggcaggagaatcacttgaatttgggaggcagaggttgcagtgagctgagatcgtgccaatgcacgccagcctgggtgacagattgagactgtgtctcaaaaaaaaaaattgtgtaattatgcactgtacttgatagtataactatgttgatatggaattatcttccatgtcttctagtacaattactgcccaggaagataccatgtttatcctgtggcttttgttactgtagcactatcatgtatccttggtagtactttcagttggcaaagtttatttgttttagttaacttcagataacgagattgcttacataatatccagatttaatgagaaacccatcaacttttattatctcagtttaccttttttcctctttatgctttactttgtattattattattattttttgagacagtctcgctctgctgcccagtctggagtgcagtggcgtgatctgcactgcaacctccacctccatggttcaagcagttctctgcctcagcctcccaagtagctgagattacaggtgcctgccactatgcctggctaatttttgtagaggtggggtttcaccatcttggccaggctggtcttgaactcctgacctcgtgagccacccaccttggcctcccaaagtgctaggattacaggcgtgagccaccgtgcctggctggattgtttttattactacatcttcaagtcccatctccatctctccctcccttcctccctccctgcttgttcccttcccctccctcttcctcttcccctccctcttccccttctttagtagagacaaggtcttgatctgttgcccaggttggcatgtagtggcgccatcttggctcactgcaacctgcctcgggctcaaagtcatcctcccccttaag

SEQ ID NO: 64337 - DNA, 1593 bp, Homo sapiens
ttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagatgatgtttgattactcattgtgttaattaagtggtttcttaagggaacaagtgttagtgaaacttactttagtagctctgttccttttctccagtgccttagggtttgaatctagaagtcagcattggtcattcagcaggtggaggggatgtgaaacagtttgatgttctttgacttgttgaatatttacttaagtccgtgtttcttaaactttttctatgaagtgctcctgatatagaaacccaactgtagaggaaggtgaatacctacacagataccccatgaagatgaaactgaaaacagctaaagccacacaca

SEQ ID NO: 64338 - DNA, 1010 bp, Homo sapiens
tgcattcataattcatttctccccacatattgatgagtgtcacctgtgtaccaggttttggggaatgcaatgatgaagagaccttatggcctctgaaacttacacttttctccatcctcacctcttgccattttctctctttgcttaatgtattccagctatgtgacgcttcttttagttcttggaaagcccattcactctcatggcctcacacattcagttttctctggcaaggatacttcttcacacccccaccctccacccctcaactccatactctgttatcttctgggcttaaatgtcacttcctcagggaagctttcgctcatctccctgacagggttgtatactttaatagcaccttacactttcccttcccagaatgtattactgttgtatttaatactttttgtgtgatctgtatttggaaatattgttgtaggctagtatttccatcacagatatgttcttctgcattgttctgcagaggtgggctttagtttatcttgagctgttaagtctgttgtttcaccttatgataaaacaacttggcctcttggctgaattattagcacaatctgtggccaggattagatggaacaaatccagttgttaataatgtaccataaacataactgttggaatttcaggtaacacaggaagaaggacaacagttagcacggcagcttaaggtaacatacatggaggcatcagcaaagattaggatgaatgtagatcaagctttccatgaacttgtccgggttatcaggtaagcaaaacacattctagatgtgtgttttaataaattactattaaatgtttttagtaaggatattttatatggaagtgattcctttctagggattaatgcacatggtgcattacaatttttaagtacatattctaggcacttctagaatataaaatataatttaattatgaagtataaagtacacataggattttgataagaataaatgctgcttccaaagggggtgatggtgtgaaga

SEQ ID NO: 64339 - DNA, 1396 bp, Homo sapiens
ggatatcttcaaatattgggaaattaacatattccaactaacccttgggtcaagaaaatgaaaagggaaattacaaagtatcatgaactgaatgaaaattagaacacaacatcaaaatttatagcatgctactaaagaagtatatatagagacatttgtagcactaaatatttgtattagaacaaaggtctcaattcaatgacctttagtttcttccttaagaaataagaagaaaaagagaaaattaaaacccatagtaagtagaagggaaataataagagaatgaagaccaatgaaatggaaaatagtaaaaccataaaggaaagaaaaactggcagagtgtagtggcttatgcctgtaatgccaacactttgggaggctgaggcaggaggattgcttgagcccagcagagcagttcaagaccatcctgggtaacatagtgagaccccacctctaccaaaaaaaataaaaaataaaaaccctaaactggctttttggaagatcagtcaaattgacaagactcttgccggaatgatcagataaaaaagagaaaagacacaatatcaggattgagagcggtatcttcactttagatccttcagatgtttgaaagataataaatactataaacaactttatgccaataaattcagcaagttaaatgaaatggacatattacttgaaaggcacaaactaccaaaattcactcaagggaaaaaaaaagataatatcagtagtactttatctacaaaataaattgagtttgttttaaaaacgtacctcaaagaaaacttcaagcccagatagatttgccggtgaattataccacacatttaaggaagaaatactactgattctgtacaaagtgttccagaacattgaagaggagagaaaattctttgcaacttatgtgaagccagcatagcactcagaaacccaaaccagaggaaagcataagaaatccacagtccaatatctctcatgaacacagatataaagattcttaataaaatattaaatagaatttaacaatatataaaaagggcaatatatcactcaaggagagtttattcctgcaatgggttgttggtttgatatttgacagtgagtcaatataattcatcatattagcagtctaaaaaggagaaatcatataatcatctcagtaagatgcaggaaaaaacatttggcaaatccgccatccattcctgataaacgccttatgcaaagggagtagtggagaactttgttaacctgagaaaggacatctacaaaaaaattctctaactgacagcacacttaatgttgaaaaactagctttgtttctaagatccaaaataggtcaagagtattcccgtcaccacttatgtcattgtactggaggttctaggtagtg

SEQ ID NO: 64340 - DNA, 1094 bp, Homo sapiens
gtaaaagcgagataattcatccgcagcagatctgcattacaagaaatgtgaaaagatgtccttaggcagaagggaaatgataccaaatggaaatctgaaaatgaatacagagtaccagagatggtaattatgtggataaatataaattactcttaccataactgaatatttaaagcaaaaataaacgcattatgaagtaaaagttaataacaaaaaagagcaggagggagaaatattgttgttaactagtttgtttttttcttgagagacgggttctcactgtgttacccagactggccttgaactcttgagctcaagtgatcctcttgcctcagccacccaagtagctgggactttaggcatacaccactgcacctggctctgttgtaagattcttaaaccatacttgaattggtatggtatcatttgaattagactgtcatgaattaaaaatgtataccataaattctgaagcagccactgaaataacagatatatagttaattaaccaacaaaggaggtaaaatgcaatcataaaaacaactcagctaacccaaaagaaggtagagaaagaagacaactagaacaaagaatagataatatggataggaaactaatagcaagatgactcaactgtatccatgagcacattaaatgtaaattgcccaaatgtctcaattaaaaggcagatgtgttagattgaataaaaaaacaagatgctacaagaaatctactttaaatgtgaagacacaaaggttaaagtaaaaggatggagtaagatatttatatagctactttaattattttcatgattgcctggctagcaataatgaaaataattaaagtagctatatgaatatcagataaagatttcagagccaagactattaccagagataaagaagagtgttatataatgataaagagattaattcctcaagaggacataacagtcccaaacattcgtgatctaatagcttcaaaaatcttgaagcaagatgttaagaactacaaggaaaaatagacaaattcacacttaaaatcagagacttcaatacccctctcgataactgataggaaggtagaaagaaaat

SEQ ID NO: 64341 - DNA, 1043 bp, Homo sapiens
atgttagccaggatggtctcgatctcctgaacttgtgatccacccacctcggcctcccaaagtgctgggattacaggcatgagccacaatgcctggcccaagaaaatgatatattatcttaatgctaagatttggaaatgtccactgatgaaacttggtatagaataaattttcctgctaaatctcgttcaaatctggttataaagttagagtgaaaaaatttgttcttcatttcaaatcaatataaactgtttgaaataattaagaatatggcattgcttacattataaacctagcatagacagttcatctattttttttagatttaattttgtttttttttaagaccatttccttgaggtttctaaacctgattatatttattgatgttgcccagtggaccctgcctgtggctcttctcagttctttctagtactagaaactctatatgtcattgcatctgggaaataatggcaaagtagatgtgcattgaaggagttctcttcctatctctcgctgacttttgcctcacccctatatgcttcctgtcctgaatatagaaataggatctttctcaaaccttctcatggtggtagctccagtaaaggaataggtaggagacctaggataggtggagatctcctgtagggtaggcagtggcagattagggaagggaggagggtgtatgcccactagaaccccaaagaggctctgccattatcagcttgggtctatatgagttatttttaagttgtctatacaccagattgaggatccctagcccaaaaatctgaaatctgaaatgctccaaaatctgaaactttttgagagccaacatgattccacaagtggaaaatttcacacctgatgtcatgtgatgtcacagtgaaagctttgtttcatgcacaaaattacttaaaatattgtataaaattatctttaggctatgtgtgtaaagtgtatataaaaagtaaattttgtgtttaggcttgggtcccattcccaagaaacatcattatgtatatgcaaatacagtattctaa

SEQ ID NO: 64342 - DNA, 1067 bp, Homo sapiens
tacccaggctggagtgcagtggcacaatcactgctcactgcagccttgacttcccgagctcccatgatcctcccacttcaacttcccacatagctaggaccacaggcatgtgccatcatgccctgctaatttttgtattttgggtagacactgggtttcaccatgtttcccaggctggtcttgaactcctgacctcaagtgatccacccaccttggccttccaaagtactaggattataagcgtgagccactgcgcccggcctttttttttttttttttatcttggcacataaaataatgatggtcttacaatcagtgtcatcttagatttgatgaaaaagggtaaattcacatactgggacaagtgaactatgctagggcatggtataggctgaagctcagtgtgataggaaaagctcagggtagggaatggggtgttagagggatagttacagtgagggaagtttcattctagatcagcagtcagcccagtagaacagccacctagtgggaggctagtacaactgattgatggctcaggagcaggtattgcccaaaatcctgggtatgtggaattggaattgtggagagttgttggtgggtaataagacttcgccccacagttgagatttaggaactatgtactcacttatggcaggaaggctttataagaagggggctatgagagaaaatatttgcaaatcatctgggcacagtgatgcatgcctgtagtcccagctactcaggaggctgagatggcaggatcccttaagcctagagttcgacaccagcctggacaacatagtgggatcacatctctataaatgaaggaatgaatgaaaaccattgaaaaaatatttgtaaatcatatttctgataagggatttatatccagaatatagtactcttacattcaatgataagataaaatttaataaggggcaacgatttgagtagccatttctgcaaagaagatatacaaatggccaataagcacacaaaaaggtactcaacatcccactagggaaatgcacattaaaactgcagtgagagactattttacatcc

SEQ ID NO: 64343 - DNA, 1045 bp, Homo sapiens
tttatctgcaaatgctgttggccctcctttggaagtaaacacggatctggccactttacacctccattccagtcacctcccttcaagctgcaattttcttttcatgatttattgtaatagcttcttaagtagtctctgatttcacccttgacctataatccagtcttctgactgcagccagtattacttttcatatgaaagtcagaacattttattcatctgcctcagaccctctagtggttttcatttcactttgaataaaatctgaagtcctcactctggcctgcaagtctccgcctgcctccctgttaattttctgaactcattaaccactctctcatgtttgttgttgtagctacactggctgtcttgctgttcttcagacatgttacagtactctcaccgcactgcctttaacttaatgttccctctgcctggaatgatactctagatcacagcatggctcactccttcagttgatccaggattcccttctccagtgtcacattgtgcgtggagccttctctggctatcttatgcagtatcatatcctcccctccaactcctgctgttgccagcccccttcatttttcttcagagttcctatcacctctgatgtattatgtttgcttatttattgatggtcaatacttcaagaaactgccagccctctaagagcctggggattagatcctcagctcctgacacaatgcttggcacattataggtgttcagttagtatttgtagattaagtggggtggtgagtgagcctagggaagattcttgtggcagttttagcagtttagtaatagaacatgtgctgtggaaatcaccccctttaattctagttttgcttctacagaccattctctgttctagaagaggtgagaaatgaaattggggtttaggatattggtaggtaacgggatagaggggagaggaagtgaaaatggaagtaacagtctagactctgggaagcaaaagttacaactagaagtgagttggttacctacctgtttatggggcacccttccatttctaagt

SEQ ID NO: 64344 - DNA, 1079 bp, Homo sapiens
ttttttcataggtcagaactccaaaatcaagttgttgtcgtgctggttgattctggagtctgaggaagaatcatttccatgcctctgtcctggcttctggtgcttatcagcagccctttgtgctccttggcttgcttgtggatgcatccctccaatctctgcctctgccttcatgtggccttcctctctgggttattttctgtgttttgcatctcaccctcctttctcttataaggacaacagtggttggatttaggtccagggccatctcactttaataactgtaaagaccctatttccaaatacggtcatattcataggtaccaggcattaggagttggatatatcttttttggatgccaccattcaggccactacagtgagcaagcctcttcctgcatttgcaaataagcactatgaaagtacttttactaaatgcaataatagctatagaatctgacctatattatatgcatataaatgtgattcagagttacatgtttactttcttttcatgtggtttacaattgatgtggcattcttttactatgaattaggctgagcacatacagacaagctataatttgtgtctctaaatggtgtgagcagggtcttaaattctgtgaacatgtgctgtttagctcttgactttttaaacctacgtacttgggtatttttataagataaatgtttatagttccttttgatatgaatcatgtttgtctccacataaaagtttaaaattatccctagcgacctagtctgatttaaatttgtgtgccataagatattttataaaaacagaattgctggtagaatgaggttaagtaatcaaaagtaagactggttgtccttggtgtgaatagacagccactttcagagaagtgctggcccggcctccaggcatgtggtttggagggaatctctggttgagaacatttgctgctgctgctttcccattttgagatgaacttgatgaggaatttagttcttcgtattattaggaaagtaaaacaacagtgatacaggtgtgagattgcttttttgaattttattgtgccatagacctatatgtcttc

SEQ ID NO: 64345 - DNA, 1014 bp, Homo sapiens
agagtttgagaccagcctggccaacatggtgaaacctggtctactaaaaatacaaaaattagccaggcatagtggcgtgtgcctgtagtcccagctactctggaggctgaggcaggagaatcacttgaacctggaggcggaggttgcagtgagccgagatcgcaccactgcactccagcatgggcgacagagtgagactccatctcaacaaaacaaaaactacaaaaaaaccatgtgcctgcattcaaagatttggtttggcaataattttcaagctatttttcattctcagtatttcaacatttgctattacatggcagctgttagatgttcctctttattttatggcatctaattgataattattttttgaaaaaaatgtaatggaaatgtggaagaacattagtcaagagctcttgaataaaattcgttaatattttgttctgcatttattgcttttctgcacttcttatttctgcatatattatttctaaaattgaggatttggttgatatgtaaattatgattagagaccagaacagtttaggacccaaaatgatcaagggaaagcacctcgctggaaacccccatgacaataaaactctccttgtagttcccatttgtatgtttcaattataaggcttatgttaaaattagatcagaatttccatcatagactctcaatttcatagttgtgtaagtgccatataaacctaattgtaaacaaaggcatttaatgatggacattatttgaacaatttaagatcaggttatttagctcacaggctagaaaatacatgtctagtttcacattttaaagttgagagattgtgaagatgggctttggttctaaaggtgaattttatagttttttctaatgattttccagattttctacaatgaagatgtgttgttttataacataataaattaaaaatacttgctaaattcttttttctttactgattgctcttgagacttactgcattgtaaacaaatgactattttagatgt

SEQ ID NO: 64346 - DNA, 1181 bp, Homo sapiens
ttatttatgacaggctattttttgagcatcttttggatattgcactgtgcgattgtcactttccattatgtaaatgaggaaacagtcaaatatgttcagagacgtaaaattttagtccaagatggtggaagaaggaccaaacttcctgttatgggtttctgatctgggctttctgctttaaaatctcttctgaactacgttttttttgtctttttattagtttaaaattaatgtttttaatagctctgtggttttgagactgaatttttacattcttatcacagtaaatgtttgcttaaaaaggtggagttgatctggtctccctttatcttgcctctgagtaccctaaaatgtggatttaattttagtgctagaaactgtttagtgggtctagttgttttccttaattaaatttaagcttttacatgtgggtgattagaaaagtcttatccagaacctcagttggcattttttagaaatgactgccatgtagtttttttttagtagactttaagaactttagagttacagaaaacctgagaagatagtataggaacttcccatatatctgtcacctagttcctctattgttaacacgtatggtacatttgttagaattaatgaaccaatgtggatacattattattagctaaagtctatactttattcaggtttccatagtttttacctaatgtcctttttctgatccaggatcccatcaagataacacattacatttagttgtcatgccttcttaggctcctcttggctgactttccttgtttttgatgacccaactattttgaagagtactcattaagtattttgtagagtgcccctctattagaatgtgtctagtgttcttctcatgacaggtgtagggttatgggttttgggttaggaagaccacagaggtgaagtaccgttttcatcacattatatcaagagtacatgctgtcagcgtgatttgtaactgttgatgctgaccctgatcatctggctgaggtaatgtttgtctggtttctctactatgaagttgctccctgccccaacccttttccatattgtattctttggaaggaagtccttatgtgcagctcacacttacggaatgaggatgctgtctaattttgaataaacatttaaatagtagaggcttagtttaaaaatttacctggagt

SEQ ID NO: 64347 - DNA, 1411 bp, Homo sapiens
tgactagtcatgttaggggaaggaggaatggtatagacataagattttaaaatattgacgtgcgtcgtgtgtttacttatttgcaatcttttttttttttttgagatggagtcttggtctgttgtctagggtggagtgcactggccgatctcggctcactgcaacctctgcctcccaggttcaagtgattctcctgcctcagcctcccaagtagctgggattacaggcgcctgccaccacacccagctaattgttgtatttttagtagagacggggtttaccatgttggccaggctggtctcgaactcctgacctcaggagatcagcccacctcagcctcccaaagtgctgggattataggcgtgagccactatgcccagccatttgcaaccatttttttaaattgttgtgttaagttactataaaaattaacatttttatagttttcccacattttactgcatactactttatatgactttatgattgttaggttcttaaacaatgaattttgacttaagttcttttatatttttatttttaccaatccatcctatttaaaataaattaatagtatgtttaatatctttcagaaaagttctttccctgtgctttaattttaaccagttttagctaatgtttttgcacaaccttttctaaaagcaacaaataattgattaaggggaatctgggctaagctgaagcttaactctgaaagctgtgttaatgagtttccataggaaaaactgtctactgcttttattttgtttatagattgaaattagctaaatgaaagaataagtaaatgagagctgcttaaattaagacatccattaaaattttttgtcttgattactttcccgtctcagagtcaattgatctggcttttggtactgagcacatgactctagacaagcatgcagtcattctaggcatactgctatttgaaaaaacagctttaaaaagatgttagaacctgggaaaaaatatcttgctctcttgtggtttcacaggatgccaaaggtttagttgcttgtatgtttcactcaattgctttctgttcaatgaataaaatcagcaccgtgcattagaactttgcagactcactgcaaaggaaatagcaggaggtaaagtgacctcaaatgaatgtggctttttttgtggggtgcggtgggtgggcagtgctacaacttaataaacaaattgagttttgcaggaagaaaacctttaacccatctttatactctctcatggtgacatttttcttctgctatcattcccattctttaaacatttttacaatgattagttcattttaaacatgtaacatagctacagttgagttgtttagttgttttataacgtatatgtttttcgagtccatcagtaaactggaattataatcttattt

SEQ ID NO: 64348 - DNA, 1035 bp, Homo sapiens
ttgtttctatggttctttattttattattattattactatttttgagacaaggtctcattctgttgctgaggcttgagtgcagtggtgccatcatggctcactgcagcctcaacctccccaggctcaagtgggcctcctgcctcagcctcccaagtagctgggactacaggcacacgccaccacgcctggctagtagttagttcttttttattgtttggtagtatttcattgtatgatataccacaatttacttgtctgcttattgatagaacatttgggttgtttccaatgttcattaactgtgaataaagctgccccagacattgatgtacaagtcattgtttggacttacattttcatattgcttggataaataccaagttgtgattattgggtcgtatggtaagtggatgtttaactttgggaaacaggtggtttcttataaaatggttgtaccattttacattcccagcaactgggtatggaaattccagttactctgggtctttaccgatactgggtattttagccaatctaatggctgtgctgtggtatctcattgtggttttaaatagcttttccttgacgactaatgatattcagcatctttttatgtgcctattggccattggtatagctccttttgtgtgtctgtatgtcttttgtctcttttgaaaattggattgctttgtgttactgagttgtaaagtttcttaatatatttggaacacaaatcctttgtcagctgtgtattacagatagtttcttctagtccatatcttgccttttcatttgttccttcccttttaatacttacatcctctttctgtagtagacttgccagaacttttttttttttttttttttttttaagagttggggatctccctatgttgcctacgctggacttgaacttctgggctcaagtgatcctcccgccagtctcctgaatagctgggactatagatgtgcgccaccatgcccaggccagaaccttataacaaaatagttcaaacaaaatgaacacagtagat

SEQ ID NO: 64349 - DNA, 1049 bp, Homo sapiens
ataaatgcatgagaatgacagataccaaattcaggatattgattacctcttggtgttgggggaggagagaggggaatattattgaggaggcatgcaagagtcttcaatcatattacaaatgttttgtttcctaagtcgggaggtgagtatgcgtatttatattttttcataacattttctgaggtattttatagttaattaagaacagagaatgtactctgacttaactgtgtagtcaaatggaaatttttagctgttaatttggtgttaaaggtatcatgacttgtttgacgagacacaagtgttttcttcaggggttttccttcagagtaggaaactatttttatttttattttttttttggtccttctcaaacaacaaataaaacttgagtacattcttattacagtaagaaattcatatttcaatttgtggataaaacttgtacgtgaatgtgtgtgttatgatttgctttaagaattactatacatggtttctgaagatttctccaaagcacagtatctaatttttgtcttggtagttacaggaactgatgattaattttgcctttagtttcctatatacagaaatgcctttaacttttctcagcaccgaattcataacactatttgtaggtatacaaaacaaatgcccacataatgtagtttgaggtaggtttaccgattgaaagaaaacctggagtatcatactagacctgtgctctgtgctatgctgttgactttttttgctcatgaaatttattcctttagaaaatggattacttttggaccgagaagattttcatcaagtgttgaattttcagggggagggataggattatttatgtaaaaaatgtgctgccactcttttggtggctttgcgtatgacaggaatcttattttcatcatgggattagaaaaaatgccgtggtcattgttcatcttaaaggctttgcctgatttgggtacttatgcctttgagagaggtgggatgggggagagaaaaggaattctgtgttcttggaacaagaatgtgaaagtatatacatt

SEQ ID NO: 64350 - DNA, 1011 bp, Homo sapiens
attcatatttgcattttcagaatcgtagactaggaatacctttgttacacagaactaagcacaacaaaatatttgttgctatttgctagtatcaagttttgagtggaggccaggtgcggtggctcactcctgtaatcccagcactttgggaggctgagtagggcagatcacttgaggtcaggagttccagaccagcctggctgacatggtgaaacctcgtctctactaaaaatacaaaattagctgggcatagtgacacgcgccaataatcccagctacttgagaagctaaggcagaagaatctcttgaacccaggagtggaggttgcagtgagctgagatcacaccactgcactccagtctgggtgacagagtgagactgtctcaaaaaaaaaaaaaaaaaaaataaagtcttgagtagggcacaggaaataaatagtggaaaaaagaggcttttggaaagatgagttgtatctattatggttccatagcatctagttactgaagaagagaaagagctggctatcattttggatttcagaaatcatgtgtggcatatacacgttgaatcttgagttttagaagttgatccgtagcattcggttttagccaaaatagtctttggagaagatagtcctttcttaatttctgtctggcaattctgacttgggaagtatacaacagtctgagagtaaggtcttaaaagttgtaacttttgttttatttcctgatgaattttctcttaatgcctgtttttggttaatgacgatgtggttgacgtttcagtagtcaaaagatgcgagctgaaaggaaagctaagcaggtagtcaagtcaaactgcagaggaagatttgtggtagatttaatgtttaagtttcagaaatcacatggaaaagatatgtggctattaaatttgtaattttgtcctttttgcctctaaaattaaggtgtgtcaactaagggaaatttgccccatgcaagtaggcttgtgtgcaggtacacagaggcatac

SEQ ID NO: 64351 - DNA, 1049 bp, Homo sapiens
ggcatgatcatagcttactgcaacattgaaactcctaggctttagtaaccctcctcctgtcttagccctctgagtagctaggactacaggcatatgccaccatgcccgtctaacttttttatttttattttttagagatggggtctcattttgttgcccaagctagtcttaaactcctggcctcaagcaatcctcccaccttggcctcccacagggctggtattataggcgtgaaccactgtgcctggcctttttatttttaaattgacagataaaattgtatgtatttattatgtacaacagggtgttttgaagtatatatacattgtggaatgactaaatatagctaacatacgtactatgtcacatagttgtcatttttgtggtgagaacatgtaacatccactcagctttttacaagagtacaatatattgttattaactatagttactatgctttacagctactttttattttgaattgtgatttaaagaacatttccaagtactttttactgaaaacatatctaagattaaatttacttttgcatgataaatgatgatttggctgggtataaaattattgggtcccaacatttttgtgttataacagtagaggtcctgctttatttgttatctttgtctggcctcaagtttctgtagaaataacttcactaggtgtatgcttgcagcattctcttatcattggaaatggacacatttatcaggatatgactagaagtttttctctgtcactagtattctcagggaaatgatgaaacactctcaggtctgggaagacttctccatttttgtattcatttttttcagttatcttcttaagtacctattatttacacattgattttctgtaactttatagtacattgttttaagttagctaatgaaaaggataagatcctctctattctaggaagatttatcaaatttgtcttctccatccttgatgaaattttctggatgtcacacataattactgtctccaaaacatatttagtgcccttgatttctcggtctgatattaaaca

SEQ ID NO: 64352 - DNA, 1041 bp, Homo sapiens
aaaacaaaacacaaagataaattggaggttgataagattgatttcctagaggatgggtaaaaaggtatatggtggaaaggatagagggaatgggggcagggacccttctgaggatacctttctgacttttgaaaccatgttaatgtttcacatactgagtatataagcagcaaacacaccaaccaaatcaactgatgacaaataaaaacaccttaacagggagtacaaatagaaacaaatgaactgaaccgtatttcaaatgagtaacttaactacactgaaggagtgaaaaacaactaatttaggtaacttttgatcctagtatttgaactctgtcctcaggataaagacaaaaagattgaaagaaacattgaactctagttaatagagttaactagaatttttggtttttgttgttgtcataaaggcatgggtttgcaattttgaagcaattgtctatactgttataagcaaataagtaaatatattgtggaaaatgggagccagtttctcactgttggagaagggagttacaaaggtgaaaaatgtgaaggttaaaatgaactctgatgtttgattggaattgcagatagtggcataaattcatagttttagaagtatgtagatataggccgggtgtggtggctgacacctgtaatcccagcactttgggaggctgaggcgggtgtatcacgaggtcagcagatcgagaccatcctggctaacacagtgaaacccccctctttactaaaaatacaaaaaaaaaaaaaaaattagccgggtgtggtggcgggtgcctatagtcctagctactcagaaggctgaggcaggagaatggtgtgaacctgggaggtggaggttgcagtgagccaagtcgcgccactgcagtccagcttgggtgacagagcaagactctgtctctaaaaaaaataataaaaataaaaaatgaatacaaaaaattagccgggcgtggtcgcgggtgcctatagtcccagctacttgggaggctgaggcaggagaatggcgtgaacctgggaggcg

SEQ ID NO: 64353 - DNA, 2931 bp, Homo sapiens
cttgagcatgtgtgtcttttaaagctctgtcatttatcggctgtgagaacatggccaaaatactcagcctctctgagcctcagttttctcgccagtaaaatgggtctgattacacattctttataacttttatgacaaagatggtagcattgtatccagcatgttgtatgtgctcagtaatggtaggtgttatcagtgtttatgcctacagttctgtaacatgtttaaatgcaaagggaattcagactcagagaagtctgtggaaaaaattgatgaaagcattatgtaggcttggtggtggggagaatggaaatgtcatatgtgggagtcatatgctagtttggagagaggaggtggcaagtggggaagtgggattgatagttgatttgggacctgtgatctggtctctgcaaaaaggagcctttttggagagacaggaacccgaccacctggatgcagtctcagctctaccacttgctgcatgtgtaattttaggcaggttacttaacttctctgtaccttagttttccccatctgtaaactggggaaatatggtggaccacatatagctgtgaaattaaatgagttaacatgtcaagggcttagaacagtgtctagtacagtctgtagtaaagctgcatacatttttatattaattttagattatggagctaaagcgatttttttatatttacacttaatagggtagctattcattgcctgactcctggaatgttaaaattcattccaccatgattgtttagcagtagtaactggagggagagaacacagcagactaatcattttaataagcagaagtcagttctcttggtaggagattagaatggcacaaattggacttacttttttaagactcctgaaacaccagactgtttttacaattttcagtatatatattttctactatgtgattttgagcagaaaaaaatataaaattgggaacggagaatttaaaaacaatgccttttaccctaactttctttgacttagatttagttgttaccttctgttcatatgaagagttgcaaaattagggaactaagataattaaattgagataccttttcctttttaaaaataaatataacaaatcataaagtagccatgataaaatgtaaagtattatgttatttaatgaatatgtgtgtgtacattacctcctcctttctgttgctcatatttctttgaaaaatgtgtaaagttctgttggtaggtagaacacctaaatgttaagtaaactctaggtaggaaatgacttcaggatggtacagagtggttaggagagactgctgggtgtgtggggtctatgtctctctacccaggtgactttgagtagtttcttaatctgcctttatctcgactgagcttctctttcttccccatgaaatgttgggtttggttgaacaaatttctgcacttttgaaattctaggagtgtttttttttttttattcatttaactagctgtgtgtttagtcaagtttcttaggttctctaaacccaagtttcaccatttgagaagggagaataacattaaataatagtacccttagggtttttggagtaaataaaataatgcaggtaaatcatccagcaccgtgccatctacagagtaagcaaataagaattgttggctgggcgtggtggctcacacctgtaatcccagcattttgggaggccaaggtgggtggatcacttgaggtcaggagtttgagaccagtctggccaacatggtgaaaccccacctctactaaaaatacaaaaattagccgggcgtgttggtgcgtgcttgtaatcccagttactcgggaggctgagtcaagagaatcacttgaacctgggaggtggaggtcgcagtgagtcaaggttgcgccactgcactccagcctgggcagcagagtgagactcttgtctcaaaaaaaaaaaaaaaaaaaaagaaattgttacttggttttatttgctgctgttagttctgtatcttggtgttcctccaaaacaaaatttgtaattttttcatttttctttgacacataatctggtctattactttaagtcttcattgccctctccttcctggctcaaccctatactcccctccttacttctgtgtggtattcaggtgatgaatgtggattccgttttgagttggagaaatttctttttgtcagtttggatttaattttaagaaataatgaggtaagcatttaattttggggttagtgctttatctggtaactctgagaaaaggccatatatgttttaaaaatttacagggaggtttatatattttttttagcatattaactttttattcaacaatttgccagattttgaggtaggtaggggttagctgatttctcacgtcttgaatttcagtcagtcctatgacctgttagtctggacccagcattgctttttaaaagtttgtcttttgctgagtactttttcattgctttttcctggggcagagagccgagaagagatttcaggagatttgtgttaatagttaattgatccacatgtgaaggttgtgagtttaaattcccaatttgctgttccattgctacatctcgaagatttttcctgcaattagaaactacttaaactgttaacttttatctattattttgaaactagacatttttagtgtttaaacttttttaacattaatgtacaaatgaattgttagcattgagaaataagacacctgcccccaaagtggtaccatactaaaggttttcttgtttggggaacagttgaaatggtcctgcaggcaattcctagataaaatttctgtacacccaaggaagaacattttcttatagaggatgactgcctttggagaagaaggaaattttaacctgcagtttcttaacttacgtcttattcttgttttgttcattctctttct

SEQ ID NO: 64354 - DNA, 2475 bp, Homo sapiens
ctctcacgcactcgctcactggctagggattagagcggtgtgtccgtgggggtctgaagcccgggttacctcccgaacctcagccccaagcggcgcggccccgcccctccccgccccctcatgcatatgcagcacctcagcctggcagcccggcccccagacggccatttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccaggtacctggagcgggcctgcccggggcgccggagcggcggcgggcgggggctggcgctacctgtggcggggcggccgccgcgacctcgccccagaggcgcctcgcgggcccgggccggggccagggggcgggagggcgcggggccgactacgctcctgccctgcggccgcagcgtcgcgctcctgcctcctcccgggcgcggcgtcgcgggagtagggcttctcaggaatgtggtcgggagggcggagctggaagggtgggaagcaccgatccaccttattgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaagtactgtgtatttctttgtgtgtgtgttacgctctttttataagtactctcttaggtaatatgtccgggtgggagtgtgtgataatgccccggggaaatggtggcttctaggaagttaaaaatgttctctgatggggtgagaccatttcctaggaattcctgatgccgtcctgcttctcgccgtgcctaggtgaagtttgggatgggccgggctaggatatgaccgagtcgtgcgttctgttttctaaccaccctctcccctacccccagccctctctggttgctagagacggtaagtcaggggtttgtggtaaagaaaagggaggtggtattcttccttcttagaatttgctcttggggagaggtttgagtagtcttttttgggatttttaaaacacaaagccccgatgtctttctgcttttgtcaacctaaaaggtgtggcatatgctgggagagaacgaaggtaccctgttataacaggaaacaaggatatttttcacagtatctagagtatgaacggtgaaatatttttgtctggtttccttttcacccatttgtcattaattgggatacctgaatagcttatttcacttagtgtttatagtgacattaaaatattgagtactgtaacaaatgtgattgtcacctttcacattgagtaaatgagcaataattgctgctataatattccctggattactgctgctaaaacctttgaatccaggaagaaaggatgttttatgtaatgagcatttacagtatgcttattagtgggttaaaaaaatcactgagtaaggggtgagattggtttaagtttagcaggctacagaatcagggatgctgtcaggttgctatttccctagggcgcagagagattgtacgtatctaatggcaaagcaaaacaatttatagctaaccctttggggactagtctgatggctgagggagggtgggggtgaggggataagtggaggagaagtctaggagtgggagaataatcttgggttacaatattggtagtgttatttaaaagatttgaaccacaaatatttacgtttttttgaggaaggggccatctgaattatttgagcccatgttaattaattaaggtgttgggcctttttgttttggggaagtaatggtattaaaccattaagaaagcggtaattgggcctggcgtcgtggctcacacctgtaatcccagcactttgggaggccgaggcgggtgaatcacgaggtcaggagttccagaccagcctggccaatatagtgaaaccccgtctctactaaaaatacaaaaattagccgggcatggtggcgcgcgcctgtagtcccagctactctggaggctgaggcagtagaatcgcttgaacccgggaggcggagatt

SEQ ID NO: 64355 - DNA, 1020 bp, Homo sapiens
tcccagctactcgggaggctgaggcaggagaattgcttgaacccgggaggtggaggttgcagtgagctgagattgtgccatttcactccaacctgggtgacagaatgagacttcgtctcaaaaaaaaaaaaaaaaaaaaaaatctggtgacggcttgaaaaatctagcactgaaaggtaattaccagtaaagtttggtaagtctgtttggtatgtccttgattttattgttgataatggtgtcattgaattgaattggggcttaataatatggaataacctactgattgtacatagtttaaataattataaatatcttaatttttctttacagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtg

SEQ ID NO: 64356 - DNA, 1022 bp, Homo sapiens
gggaacatcgtccacttgtatatctgctgcagtgcctagtatgctgcaactgctatgtaagtactcactgaattgaattatttgtttaaccacaaaaaacaaagtgtgcctgagttcgaatcctatccccaccacttatcagttgtgtgatctggaacaacttacttaacttctctgctttcatttcctcatatgtaagatggaaaataataatactatcagaattgatgggagtattaaaccagtaatatttataaagcatgtagaatagagctctgtacataataagtattatataaacaatcttattgttaatagtgtagttctttggatatttggatattaagattttttaaattcaagtttgccccagtgattgcgaatctttttgtatatgtaattgcagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagttagtccttgggagattttctcatattcctttatctttcttccttttgcctgctgttgaggagtctgctaataaaattaatctcgctaaaaagtgtttaacatgaaaagcaaatagtctttcagtatctgttcttgcaaattagccttaactaaaaatcatgtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccag

SEQ ID NO: 64357 - DNA, 1050 bp, Homo sapiens
tgtatttgaaaattattaagaattacaagggtcaggcatggcacttcatgtctgtaattcgagcactttgggagggctaggcaagaggattacttgaggccagggattcaagaccagccagggcaatatagggagaccctgtctctacaaaaaaattaatattagctaggcatagtgtcatgcctgaagtcctagctcctggggaggctgaggctgccagaggatcacttgagcccaagagttcaaggctgcagtgagctatgattgtgccactattctctagcctgggcagcaaagcaagaccctgtctcttagaaaacaaaaaaagaattacattcttttaatttatttcttgtcctagataattttcttttcgaaaattgttagttccattttcttttttttttttttcttttagttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagtaggtttaaaatacatttaaatgtaaggtcaagtaagcattttatcagtttttatctttaaagggtcagttgatagaaaatagaatggagaggacaatcaagccaaaataagacaagtttgtacaacaagcatctcgctaactccactctcatttagtctataataaatggcccaaaataatttttttaggagtgatttagctcagggtctctattctgattttctctaaaacattgtgaatcttaaagtaactaaagagcatatttttaaatggcatcactttttggctattactattatttatatcttcctttcacatttaatgaagagaaagattgaaaatgcaacctaaatctgtctttcccttcagagagcctttgctaatgagaaaggactgttgcatctaaattttgcttcatttaaagcatctgatggatagtctctaacagacttgaaatatgtctcaggaaggaagggacaagta

SEQ ID NO: 64358 - DNA, 1113 bp, Homo sapiens
acaactctgggtgatctttatattcttgttgtttgtgtactgcaatgcagatgagttagactttgcctctaaactgaaatatgcttaatcgatgtacttcttgggattcttttcctgcatttttctggcttgttccttagttttaacccttaaattttggctgttagtaagtatgtctacctatagcagctttttttcatccttttaatttgtaatgcctctaatcttctgtaagtttgaaaaataacaagggactagaggaacccattcctcagaacaaaatgtataatatataaactctagtacagggattaattaatgagtgtattttggcttcatgggagtgtgtgtgtgtgtgtgtgtgtgtgtgtgtggtgtgcgcgcgcatgcttattttcaaattttatgatagatgaataacttcttaaaatgtatttctttttttatataggctgctgctcagtgttacattgatttaattattaaggagagcgacaacaatgtaaaactcatagttttggatcgcttgatagaattaaaagagcatcctgctcatgaacgagtactacaggtaagtgttatctgaaaaagagagatcctaaataaaatgtttttcaaatttaggtcattctcaagctttgcccatcttggttaacctaaatgcttggaaactgagcagtttatattttgatcagctaaagtgttaactattgagtcatcatagccttttggggtattatctttaccacaaaaaatatttctaaaatggctggacgcggtggctcacgcctgtaatcccagcactttgggaggcagaggcgggcacatcatctgaggtcaggagtttgagaccagcctggccaacatggtaaaaccctgtctatactaaaaataacaaaaattagctgggtgtggtgaagtgcgcctgtaatcccaactacttgggaggctgaggcaggagaatcacttgaacccaggaggcagaggttgcagtgagctgagatcgtgccactgcactccagcctgggcaacagagtgagactctgtctcaaaaaaaaaaaatgtttttctaaagtgaatcagtattatatttttttatcttttcggtttgta

SEQ ID NO: 64359 - DNA, 1001 bp, Homo sapiens
gttaatgtgtccttacttttgttactttacattttctttttctctttcacttgtgtatagcatacacattttaagtcatcagaaaaccttttacgaaacagtaaaaatataaattatgatgggatgaataaataagtgcacagctgtaaaaattattttgttcacaccatcctatctagtaaagccatttcttatctatgtttttgttggcctctaacttgcttctttctgaaattactgatgttgtgtcatagtgtctcatcccattttgtctgatattttcatgtcctcataagactgttcttagctttcatattgagaaaactagcatcccataagctgacattcatgaaaaaactccatttgaaaacaagcgttcctgaaatcggttgaaatgttaatgttttcttctccaggtctgtcatgctaatccatcagaaagagctcgttttattcgctgcatctataacttattacagtcatccagccctgctgtaaaatatgaagctgctgggacattagtgacactctctagtgcaccaactgcaatcaaggtactgtgtatttcttttggggccagattagatgatagattttctgtcttagcactcatgatttagtgacatttcaattcactatgtggttacatggcacagagagaataactacaaacttataaaattatttgatgccttacattgttcagccttccttcttttcttccttcctgctttcatacacacatatatagatacagacagagaatgacagtacagttaacctctgacaacacaggttcgaactgcgcaggtccacttatacatggactttttttctacctctgctactcctgagacagcaagactaatccctcttcctcttcctcctcctcctcctcagcctactcagtgtaaagaggttggggatgaagacctttatgatgatctacttcctcttaatgagtagtaaatattttccttatgcttttcttaacattttct

SEQ ID NO: 64360 - DNA, 1021 bp, Homo sapiens
ggggcgtaatcagaaatagtccaataaaatttattgatacttttactggagagatgttttcagcattgtagttctgtatattacagtgtccaatatatgaggacacataggagatttttcttttaggtctcagtaataggaataactatacacctaagcagctggttttgattgtatggataccctgaatcccataacacatagtgttttccctctttggtttagctgctagaaaatcagaccccaggtttgtggctcatttccagaaaatatatttaactttatgtcttatattttatatgttaattttattcttgatttttttcccagttaatttctctttgccctgatctcctcatttgttttatattgagttgtaatgtgtgtattttttaagatgcattaagtccttctattgaatgaggtggagaatgataaatatattcttattttttttaggatcgagctttggattacttaagtacttgcattgatcaagttcaaacatttggagacattctgcagctggttattgttgaactgatttataaggtaagaatgataatctatgatgagtaaaataaactcagcagtttaagacagggttaaatactttctttctgggataattattgctaggataatatattttaatagtataaatattttatagcatagcctattaaagcctttgtttcttttacttttggtttattgtattttccaagtagaatacttgcttatatcctttctaaacctccataaagattttgataaaaattcatggcttgagccagtgtagctgcacataaatcattgtgaacttcccagtcactgaatagattataattaggctttaaaataaaattcaagattttcttgagcatacatcagactaaaatcaaacaaaaaagccttaaatactttttatgttccctgtttgtaaaagagaatagaaaaactttaaatgcattaatatgacattgtaggccattgacaggaaatctaaaaccagctaaga

SEQ ID NO: 64361 - DNA, 1122 bp, Homo sapiens
gcctagggctgctttgctggaggaaggggaggaggaagcgggtggggcgaggtgggggtgcagcgcgttgattaagggacccgcggacatagagtcggaacccaccaaggaccgcgataaagcgctttagggttttggcagagtattcaggcacaaggtctcttaacttgagcatgcagattgtgtgttgtgtaaaaaccatacggtccataacattgtggggtgtggctggggggactgtcactgttctgtgggccttcattcggctatacagcattctcaaacactggaccgggatgcgatgagggagtgatagataatataccttatgccagagctgataatgtggtttttactagaatttatttttatgggaacacgatatagattgacctgccctttctaatactttaaaaggtcactataggtacttgtttgtgggttttttttttttaatttgtaatgatatgtctgtgtttatttttctagattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctaggtaaacttcgatattattttgagaatgaaatgaaaaaagaaaaaacaaaaataaaaaactcatatttcatattcctttataattagaaatgcttaatttttgtctaaagtttttctaggatctcttcgatagaccttttattaaaaatgcgaacttctttaaatattggttgtttgaaatagaacatctcagtttatcttagtaaacctaaagaaattgtaatagtttagatattcctcaaaatgtcataatttttgtagacttcaatatattaatgtggctgattattttctctaggcaacaggttgaggatgtgtattggaatatcttaattccatcgtgcacttaacttcatgttacttagcttgtaaaaccaaaagaactttgttctttggattacccacccaaacaattaggtgaacactggaataaacatgtattttccagaaaagtttaccttttcattttttatgcatttttgcaaa

SEQ ID NO: 64362 - DNA, 1078 bp, Homo sapiens
tattttatgcattcggcatacctaactttttcttactctttttttttatatttctaggctacacagttggtctgctagtttatatttattggaaaacaaacaaacaaaaaaaagcttcaccctaaacaatgttagagtaaaagcaaacaaaaaagaaaaagaaaaagaaaaagaaatctgcatataagtggaccctcactgtttaaacctttgttgttcgagccaactgtattttttttaaataaaaaatctttattccctcaaatcatgagcactcaaggagaaaaaaaatactgctcagaaatgttaacaggacagtgaactaaaactgagtattcagaatatctctttacccctttttctcaatttttaataacgtaatatttgtgattagatgtgtatattgatcaagtgttcattttacatattttctttttttctttccctgttaagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccacttc

SEQ ID NO: 64363 - DNA, 1142 bp, Homo sapiens
acagatggagaccatcctggccaacatggtgaaaccccgtctctactaaaaatacaaaaattagctgggcgtcatggcatgcacctgtagtcccagctactcaggaggtgaggcaggagaatcgcttgaacccgggaggcggaggttgcagtgagctgagatcctaccactgccctccagcctgggcgacagagagagactctgtctcaaaaaaaaaaaacaaacacaaaaagggagaagtgttgattatttggttatctattgctaggtaataagctaccccaaaacttaggggctagaacaacaaacactacttctcacaattttgcggctgactggggctcacctacatggttctttgctggtctcacctgggatctctcaaacattgcagtcatttgtggggtgcaactggaacacccaagataacttcagtcacatgtcttctttactcacaccttttaggtgtcttagaggagcatctagaaggcagagacctctgctaggatgactgagcctctgtccacgtagtttcagggccgcttcttcagcagggtctctctagcatattggcaactcagggcttgcaaaagtcagaagtgaaagccgccaggcattcttaaggctgagatgcaggactggcacaacatcacttgtacacattctgttggttaaagtgagtcactggcctggcccagattctgtttgagcagagactgggagaaatgctcattgggggccagctttggacactaagatggctcttcataaagagaaaagcatcaagaagtgaatctcaggtgaaatatgggtctttttgctagatgtttagaatatacatttgctatttatagatgcttatttgatagcagtgtaattgaaagtaaaaaagaatctagtatggaaatttctacagcatgagtttttttaacttggaaaggatattgttggtactatttgggggatcaagatttgcaatatttaaactgtttttggtaaaaactagcactgttgggaagaatgctgtggaataccacaaactagtttggcaaaggggaaaagaatgtctaaaaagtgctgattgtattttaaacatagtagtgataatacaaggaaagcttttattcctgagcaatgcaaag

SEQ ID NO: 64364 - DNA, 1069 bp, Homo sapiens
caatgagcaaatataaggactaggattctacagaacacattctacaaaacttggagttgtataatttatagtcgggattttgatttgacctagcaaaagagaagatcaaaatcgtaacaaaaatcatgagtcctctcattaaataaaataagaatcagcaatgtcatagaatgctattaaaagattatatgactagcattaaacttggctgtttttactgtgataaatttagtgtgtaactaaaaaccacaatttgagactgtagatttgataaataacagaagcctagcataacaatgaaattaagaaataattgttaatttattacatataggtaatttaaatgaactagttaaacatggtctgcgtgccttaagagagacgcttcctgcagaacaggacctgactacaaaggtaagtattgtcttttccaattgtagatattaacgttacagtttaaacctttattgcataaatgtaatggagtatatatgcaacattctgtaatttgggatatgattgtcttggcagattcttttcctttaagctatttgctaagtaatccaattttattttttaaacatttctttttggtacaaagcagtaaaaccagtaaatttcatgcaaaatgtccttcattattttcagcagattggcatatcttggtattatttagttaacaaaaatatatatatattgagcacctaccatgtgcaggcactttctaagcattgaaaatacagtaaacacaacaaataactttttcttcatggaacgtacatcctagtagggaaagatagacagtatatacataagtacattatatagtatattagaagaagataaatgctatgtaaaaaataaaaaagcgttaaaaggagaaagaatgaccaattggatgtaggtaggtgtaatttaaaataggtggttgaggatattctcaccaagaaaatgaaatttgaggaaaagatataaaggaggtaagtgagtatgagctatgcagatctagagcaaaattattctaggaaatacaaatgcaaaggccctagtatttaaggcaaggaggcca

SEQ ID NO: 64365 - DNA, 1201 bp, Homo sapiens
ctcctctagagtgcttcttatgaatagaagtaacagtggcagaaacacgtaaagatcccccctgctgtgttttccatttcttatatttgctcttttggagaaatgttagtctgctttcaagaaaaaaggacagagtagataatctttttgctggttcgagatctagaattacgacaagcttgctgacagtgggaaggataagagaagagaggttgctgtttttcttttgttcagccttctcttctctgttccataagtgctctgatacaaagattttctagagctaaaaaatgtttcagtcttttttaaaaaccttatgtggctccagagtttagcacaaaaacgcacccttgcaggcatgtctttcttaccttctgtttttcttatatggatgttatccatgtaaacgcttggaagaatttgaagtgaaatcaaacaatttagattggaatagttgtctataatttgaaattactaaactttttttgtttcttttttagtaattttatgcgtcaggagtgtttggattccagatttgtattcgatagaccactgcctgtgtctcgtcttgtatctctaattggaagcagtatcctttttatgttagcatttatggatatgaactttgaagggttttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttaaaacaagctcgttaaccagtctaagagacccagataccaacacaacgatatggccggagaccatatggtgttggtctccttattgctggttatgatgtaagttcattgaatattgttatatg

SEQ ID NO: 64366 - DNA, 1027 bp, Homo sapiens
agattgtgccactgcactccagcctgggtgacagagtgagaacctgtctcaaaaaaaaaaaaaggtctcttgattaaaaaaaaaatcagttgagatttaactgtgctcacctgatatttgaaaaccctaatttttaatttataaaagatcttctaagatgtgtgttttttgttttttttttctttagggcaggattcatcaaattgaatatgcaatggaagctgttaaacaaggttcagccacagttggtctgaaatcaaaaactcatgcagttttggttgcattgaaagtaagtacagtaataaatatgtcttcctctgtagaaaacaatgtaaatttcaccatagaaaataaggttgtaaacttatttttacatttgtctcttttttttttttttttacatcttataatgtctctatttagagggcgcaatcagagcttgcagctcatcagaaaaaaattctccatgttgacaaccatattggtatctcaattgcggggcttactgctgatgctagactgttatggtaagtataatcatgaaaaataaacatcctttttgtttcataattgattagttttctcaaaaagatccagataaggtattttaggaagttgtctgccaaagttcttgtaaattaagattatgaataccttggtggttttgagtttgttattaaattttccattttttgatccctgtaggagtaactaataagattaaacattagcacttttcagaagtcactgagtaatgtgatgtttgttaatacaatgtatatcgtttgagaccctgttatgtctaagaagaacgtgatacttttgtctggtttctaaggacaagctgaaccacacttgttttctttgtgcttgttttcttcaatacatcagtatttattagacatttattttttgcaatgctcaatactggatactgcagggtatacataagtgactcagacatggatcttgtcttaagggaacttgaaggcaagtttatctataaactcaaatgtagtttatctat

SEQ ID NO: 64367 - DNA, 1013 bp, Homo sapiens
attaaaaaataagtcatacatgtccctaatcataaaaacagaaagggacgtttagataaagagctgtgggagtatatgttagggggatttgggaagaaaaggagaagacttcaagaaatcgacatttaagctaccttaaagaaaaggaagacttttaaccatttattagggcccaataaaagggagcagcataagcaaaaataggcaagaaagttgattgtgaactttagtaattgagcctaaaggggttgatatggagggtgttagaataagagtttggaaaaataggacccatttagatctgcttctccctctcccacgagtttatggtaaatgtagaattggcttacatctgagtacagtagtaatcttccagtaagactgcatgaacagagtgccttaacattgaatggaaatacaagcatatttcttaatgaatgttaagagttgggatttgaaatgttcttctattaacaggtatttttttcttttacttttagtttcgaaatcagtatgacaatgatgtcactgtttggagcccccaggtaaaataatgtttttaaaccttttctgtgaagtggctttttgtggctgcaatatatttagaaacttgtgagagcgtaggcttggggaaaatggaatataattattttagacgttcttggaagttgcatttataattaaaataggtttcctgatggacctagaggacattatgttaagtgaaataagccagaaacagaaagaaaaatgtttcatgctctcacttatatgtggaatcttttgtttaaaagggcaaatatatatatagagagagtaaaacagtggttaccagggtagggggtggcagtggggaggaaaaaagaggagatacaaagtagcaaatatgtaggttgagcaagtggaaagatctaatgtacaacatgaagactacagttaataatgcaggtagtgttttgtattcaagatttttgttaaatgagtagtttatagcccttgccacagcagaggaa

SEQ ID NO: 64368 - DNA, 1027 bp, Homo sapiens
agcattccaaagtattttgccaaatggcaaaaaccgcagttacttttgcaccaaccttaatgcaaataaaagcatgtacacaaacaagatactcgaggaagaatacagctgacacacagaaacggatcgttatcttgtggctttcctgcagcctcgttcctttcagtcacataacaccccaaatctgtggacggttaatgagagctagtatcacccagagtcacggctgttgactcggacgactttagatgcagcccgccagcgggagaaactggagggaatccgccatacacaggaacctagaagggctacgtgacaggggctgccccgcagctctcagccgccggcactcccagccaggttttcccgccagtctcagttcctagatcttccgaggctccgcccgccgccgagcggtcggaaagttttaaggagggggaagtgttgcaagcctatcgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttc

SEQ ID NO: 64369 - DNA, 1129 bp, Homo sapiens
ttccctggattcagatctgcctttcaggagttcaatgagggaaacaaacaggtaggctaaaacaattggaatacaaagtattaagtacagttaaaaagagatctaaatggtaccacagaagtggaccagtcaggacaggaaacagatggcatactgaaaaggagtgattaaagagagtttaataaggaatttatttacaaaggtataggcagttaaggacagtgaagcatcaacagtgaaaattgctcctacacctaggcctgaagaaacaaagggaaagagctattaccaaacttcagaaagcaagctataggagagagctacctcacaggaactctgtttcaggtaatgcagcccctgccaatccaaggcctggaagagagggatgtaggaaaatattacaattgtactcttctgtcctctgagtttctttcagcgtgtcccactgttcaaatctaccagaaagtcagaggacaaggaaacctgttactgtcatccaaagaggtcaacctctgaggacgcagggcaagtagagaatgctggagaggggatctcaagtggccagcaaagaacaacccagcacagaagcgaagggactaacactttcttaagatttcataaaagaccttttaaaggaggttatatttgagataggcactgaaggataagtaggggtttaccaaatagagaagtgaataagacattttaggcaaaaggatagcattgtcaatatctcatagatatacaaaagaacttgcatgggctatatattcagacaagcaatcccatttggcagaagcacatgatgcttttggagagatgggtctgaaaagaaaagttaggatcagattataaaggctcttaagtgccatgctaaaatgactggactcgatcctgtagttaatgaggatccgctcagaaactttcagagaaagagagtgacatgagcatagtttaagttagaaaaagatccctccaatggcagtgtaaaggatggactagagtactgaaagactaaaggcaggaagatcattttggggatctttgccatagtccaggcaagataaaggtgaatggaactaaagcagtggcagtgataaggaagcaaagattctaggcattttctgaa

SEQ ID NO: 64370 - DNA, 1030 bp, Homo sapiens
ttccctaacttcttttacttctcctacgtaccatcccccctctaccagcatttaatctatctccattaatgaatgcattcattcattcagtatttattatgtgcccggtgtgctggacactgtgctagatgacaaagatataatggtgaagatgtggttccttagtctaatgaaagcaagacagtaagaagactattacagcccgttgtaacaggagctgtgatacagaggtaataatcctcagtgtactctgggatctcaggagcccagactacagtaggagtagcaggtaaggagtaatgctctggaggactcagagaaagtgatttctaggcttgatattaaaaggtgaatataagttacctaagtaaagtaagtagaaaagataatctgggcaaaggaagcaagcagtgcaaaaatctggaggaattcagctatagtgcatttggataactcaagtatcctatggcttaagtgtaaggtatgatgggactacagagatggtgtggccctactaatggaactggagtttgttattatttgttacataaaggtttatgttctgttatcatatttgcttatttacatggctagctctgcaatatattcttcaaacaagaattctctcttattcaatcttagctcaatcttcatgcctatagcaagtacttagcctacagcaagtcctcagaatttttcaagtgtgttgatatttctcaaaactattttaataaatcagactttaactgtatttcctttgatttttggctttattagtcaatgaattttaatagaaaactcttaaaatagaatataatagaaaaaacttttcatattgtgattttaaaatatttttcttaacattcatttgcaccaaatcactaaaagaaccctttttcctagatttacaaaaacaaaattacacatatgtttatgtcgtatttcactttcaacataaaataaatgtttcagagatgtgtgggtcattttttattttaactcaagtgacagtacctgaattctttggctg

SEQ ID NO: 64371 - DNA, 1054 bp, Homo sapiens
tgagtttgtacagaagggcgtgacaaaactagcaccagcattattgaaattcccgttataaattccataggaaataataaattgatttgaaaattagaacaaattcagattaacaggtgtgtgtgtgtgcatgtgcgtgtatgtgtgtgggcatttaatctgaagttatcatctaaagtaggattggcacgtgatcatggaaacggtagggagtagaaatccagttttgtgagtttttgtctgggcctagccattcatactctgccattaagcaatcctataacttttactggccttgttcttctcaaatgtgaaatgaagcaattaatttagataacctttgaaatcctttctagtcttaaaaagctctgatttctgtatgccaaaaatacataggcatccttaagactcacctttcaggttgccaataatataataagagcaagagccaagagcaaccttttatattatttatactaccaaactaaaccaaagtctcagtgttgacaagtaaaaataaagggattgtgtcaaatgactgttttctgaaaaataaaatccaaagccctcttcacaaaatcgtcttcaagattctctagccgccttttagctgtcattcaggtttttataaggctacaagcccaactctttcaataacccatagtcggagtgcatccctctgaaggccaacctagcacctgagagaattctaaaataaagtgtaaggacgtgaccaaagaccatcagaagtttacttaactaaaaatatgcacaaaaagaatgagctagctatgtttatagtaactcccttctctgtttacagtctttgtcaaagattattactaggccacatttcttagaggtcagattatttaattattcccttgccaaacttaaacaaccaataaaattacttagttctttaggttcaagaatttatgaccattatctgtcatgaaaaaaactgaagtcacagtatacctttgacttttcccagcactttaccccatccttattttacctgactttgccttccctcacgtctttttttttt

SEQ ID NO: 64372 - DNA, 3150 bp, Homo sapiens
agagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatct

SEQ ID NO: 64373 - DNA, 1050 bp, Homo sapiens
taattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgt

SEQ ID NO: 64374 - DNA, 1262 bp, Homo sapiens
tttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagtt

SEQ ID NO: 64375 - DNA, 1046 bp, Homo sapiens
tttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtacct

SEQ ID NO: 64376 - DNA, 1059 bp, Homo sapiens
tggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttcttttt

SEQ ID NO: 64377 - DNA, 1021 bp, Homo sapiens
gagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggaggg

SEQ ID NO: 64378 - DNA, 1034 bp, Homo sapiens
gccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagc

SEQ ID NO: 64379 - DNA, 1068 bp, Homo sapiens
cagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttat

SEQ ID NO: 64380 - DNA, 1048 bp, Homo sapiens
tagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaa

SEQ ID NO: 64381 - DNA, 1047 bp, Homo sapiens
tgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagata

SEQ ID NO: 64382 - DNA, 1042 bp, Homo sapiens
accaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttc

SEQ ID NO: 64383 - DNA, 2017 bp, Homo sapiens
tgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataac

SEQ ID NO: 64384 - DNA, 1099 bp, Homo sapiens
aaggcatttttaaaacttgttgttttgtttgcttttaccaaattatcttaaaactgtttcctgtctaaatgacagaaagaaatttcagcaaatagttctttttaaaatcagcttattccataatatggacctctattggttaaatttcctttctaaaaaatgctttctagcaaaacatataactaaccatgggtttcaatatttgtgattaccacaaagaatcatgaattatatgtgtgtgtgtgtgtgtatatatatatatatgtatttattaagtatagtacatacacaatatcaaaaaatcatataagaattataactacttatttctacctcaaaaaagaacacttaagaagctagagaagtttgcccttgctgtgaaaggcaacatgatatagtgaactgaacacaagtctgagaagctggccctatagttttaaatcctgactcagaatgtcatgaatcagcaagttgtattctgaatcaaaaattcagtgtgtaacagtgaaaaaactgcttaacctattcgaatctaactttcttcatctatgaagtaggaaaagtagtaccaatctagccatgctgctatgaggattaataaatgaaaaaatgccttgttcacggaaaatgttaaatattgttatttaaataaatgataattattagctgaaaaaaagcctttcaagaactaaaatttcattttgtaaaaaatgaaaagaatgagccacatcatagcttttgaacttcagtgtgatggttgctttttggcaccaaactctttcagaaaaaaaaaaatatatatgtagaacaccaccatagaaaacacttgagagaagagctcttttgattgaaacttaataggaagtctagagccccattcatatggcatttttttgagagacttcaaaatagaagtctttaaggaatacacattcaaagtattgtattagataatcttttacctataaaaggtgacttaagcacttaaatgaattttatttaaaaattaaagtgaataagactatacaactatgaaataattttaaaggtacccttacttctcactgatttttataagcatttcattaatgtcatgaca

SEQ ID NO: 64385 - DNA, 1050 bp, Homo sapiens
cttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtctt

SEQ ID NO: 64386 - DNA, 1050 bp, Homo sapiens
aaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttga

SEQ ID NO: 64387 - DNA, 1044 bp, Homo sapiens
ctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattatta

SEQ ID NO: 64388 - DNA, 1011 bp, Homo sapiens
cagacccttcatggagaattggctgtgactgagaccagacatctcaagcaaggatttggtattaattgccagaaatttaaaggaaatcactttttttttccactatgaagtccctagctgcactgaggtttgtatgagccatctcattagctaaatccatcctagatggttatctattataaagaatttgtctgatgctgagggataagtctctttaattatttggatcctcagatagctcttctcttggcaaaacgttttctggatattcctatagccactgctgcatgtaagtgatgagtagcatgaacaaacaactttcccttgtctctggtagggccctgagccaagcactataaatttgggcctcatctctcctattcagacttgccaggacaatgataagataaattatttccacaaacagggttgctttagaggcttcctggagagcttggcttatctgtaggtcttggacatttgtaggaatgcttccttgccttcataaaagtaaccaacaatgtgccaggctttgtataaaacctttaagatagtctacaaagctgtgtataatatgacacctgactactgctccaccttcattctcaccatgctcttcctcccactctgaagtccagttactctggcattcttttagtgagtcacattcagcctgttcttgctgccacagggcctttcaatgtggcatttctctgccctgaagtcatcttatcttctctattcccaggtatctcttatctttcagatctcagttaagtattacttccttagagaagtcttcccagattacaacccctcagtctaggttttatttctttcatatttgatttcaaatggcagaagtgcttccctttcagcttaccatttcagttttagtttatgcatttattagttcaattatttgattaacatctattctcagacattcacacaaggactgcattcctgttgctctctatcaaaacacttaatatagtatcaagtataagt

SEQ ID NO: 64389 - DNA, 1049 bp, Homo sapiens
aggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtgactgcccttgtatgatgggatgggaagatgaatgactggtttttacaggggtgtaaaaccactctgagcctctctgagaccatgtggttttaaaaaatccataagggaaggtacccacaccagtatctgagttccagtagctaagaccctagaatttggattcatctctgttttttcagtctctccttgtaaccctgagatcatcagaccaagaaatacagatcctgtttatttagaacactgctgtttgacatttataattttgattattctagcctttgagtttgaaagataatgacactatcattttagagtatacattactatgttgtgtacctctgaattaagtgtacagacttgagttcaagaactgtat

SEQ ID NO: 64390 - DNA, 1039 bp, Homo sapiens
attgattcttttatttctcagattccaattgcagagataatctctgtggatagatcccacccctcccaccaaggtgtatgcaaaagccccagaagaggaggacagctctgggtttccttatgggatcagcttctgtgacaggggcctgggagcatgtcctccacagagacctggctaacaggtttatatgtatctgtgtggctttggggagaagggtaggactgagacctcccccactcagctctccctctaggatcgctcctccagctctatcagactgtgcatgctacaggcccactgaacctcccagaagtccactgtgctgatgaggaaacaaaaaagaagagaaatataatgaccagtctgaagccacaaagccagagcgttagaagcaagacagaaaaccaggataggagccaaggtctgtgggctcctagaacttcgaactggcgcaggtggtttatctcattcttcccttgcagagaggtgtcatgggcttccaaaagttctcccccttcctggctctcagcatcttggtcctgttgcaggcaggcagcctccatgcagcaccattcaggtaagacagcctgaagccagaaccacactggtatcagacaattccatgcctcttaagtgtggtgtactgaatgcttaaaaaccgacagggggccggggtaaggtatgtactcatgcacatatataattttttgatataaaaatgtgtggtacacaatttataagtagtgataaatatttagacaatattcttcattataatttttttgagacagagtctcactctgtcatccatgctggagtgcaatggcaccgtgtcggctcactgcaacttccatctcctgggttcaagcaattctcctgcctcagcctcccaagtagccgggattacaggcgcccaccaccatgcccggctaatttttgtatttttagtagagatagggtttcaccatgttggccaggctggtctcaaactcctgacctcaggtgatccacctgcctcagcctcccaaagtgctgagat

SEQ ID NO: 64391 - DNA, 1018 bp, Homo sapiens
cctggcctctcattcttggaaaatgagagggcttaactgagatttttgtagagtggagctgactgttgcccagggaacaattcttcccaacctcagtggtactttatttgctgtaggcaccaggagaggttccttccaaggtccagaggctatttttatggtgacttcagctgccagggaaagagctgagtatagtggaaaagggccaggctggtcactgagaggtggatggacttggtgggtgacgtcaaggaattactcaggatggattcctttaacatgattaaaattctcccttggctcagactacccggatctagaatggctcttcactccctggccaggaacattgttccgtggaacaagagagatagagataggaagcttcccatggtaccagaaagctcattacagagatgactcttttatgggtattgccagggaataataagttacatataaggggatttcttatataaatagactctgactgagattatgaagagtggggctttgaggtcttatgcaactggatttgagtcttggctctaccactcgcttattgttcttaggcagataataatctccctaaactacagtttctgaacatgtaaaatggggatagtaagaactacctaggagggttaaagctattttatgctagaatacctgatgcattgcttggcatgaagcaaattcttaagagtggtggccattattattaaaacaagaacttattccttgaagtgccaaatgacatcagcttaatacagtaaattaaataaaatcattacacattcctctgtcttcttaagaggccaatctataagcctttaattctcagaataaaactaattgccaaggccacaacagaatggctctgcctttcccaaccctctcagattcatgcctggctgcattgcagcctcactgcccagcaggattaagcacctggcatattaccaggatatgtagagtaggcactgtagagtgatggctattattgtcgttatgacaa

SEQ ID NO: 64392 - DNA, 1044 bp, Homo sapiens
cctggtggaacgagaggagacagggattggggccaggccactccaccctctcctgcatttgttccaccacatacttcttgtggcttattggccacgtaggggagggcagaaaagtccttttccttttgggacaggcaatgaagtcctgagtccagagagttgagaggacagacatgcaggagagatccaaagagttcagtccgccaggagcttatccactgcttgaagttgccatgctatgctaggtatctccaaggggcaggatgtgtgctggcctcaggcctccttctaagcagccacaatagaaagtgcctaagaaggcctgttatagccagggtagtctctattgtctcttgtgatttcccctatccccaacccagaattccccaactgtttctgttgtcacaagctcatccaccctgtagtcagagaacatagcccagcatggcagtcccatggggcaccagcattggaagagttttttgagggaggagtgcttaatctccacaaatgaataaggaatcatggtgattcaggcaatagctctaagatggggagatattctgagctgaagaatttgcatttctaaaaagttcccaggtgatgttgatactactgatctggagatcatgctttgagaaccactactctctagaataagagaaagtcagggatgattccagttcaaaactaaatttccaacctaattacagcataaagatgatctcttctgaaagctccttaaatgtacaatcctgggccaggagcagcggctgacaccagtaatcccagtaccactttgggaggctgaggtgggaggataagtggaagctaaaagttcaagaccagcctaaacaacaaagctatacctcatctttgaaaaaaaataaaaataaaaaattagccaggaaaagtggtgtgcacctgtggtcccagctactcaggaggctgaggcaggaggataggaggaagactgcttgatcccagaagttcaaagttacagtgagctatgatcacaccactgcactccacccttgacaacag

SEQ ID NO: 64393 - DNA, 1035 bp, Homo sapiens
tgataaattcaataacatggagttctcaaggaactcaaattactgaaaaacactacttacgtaaactgacacaagaagaaatgaaaatttgaaaagcattttatttatttaaaaagtagaatttgtaattaaacagcaataacaacaaaaccttcctacaaagaaaactctaggccagatcagatcatacagactctccttcttttcccatctggccccacaactggaaatgcttgaaatggctattccataagcccagctccctaagagaatgtaatgggcagagcatcctccccctatcacccaccccaatggctttcttgaaatgaacatgcagcactgtgatttggggttgattatatagcatacctagcccatcctgactgatacaacatccatgcttaatttggtgagattatcttgattggtcaaaataaatcaggggctaagagaaactggattgaccctgctctagttaaaccaaaaaaaaaaaaaaagtcagagctgaaaggtcaattgtgttgtcttcatggcttaagtatagttcctagttggctttaagttttccatgactggtttaattgtggaaatggaatgttagagcccaaactcttaaaatgggtcacttcaaatcaggagatggatgcgtgtgaatcagagaagggaatatgactatagtaatttctttattttccatatggtgggccaatacataaggtttcatttttaagtttgccagatcaagcaatatgattttttttttattatactttaagttttagggtacatgtgcacattgtgcaggttagttacatatgtatacatgtgccatgctggtgcgctatgattttaaaatgcaatataaagttatatagataaccactagcgaataaggaagacttcatagaatcatcaaattgaaggtcatggaggaggaaagaacagaaagaagcataaccaaaaaacaaaaccatatgaaaaagattagaagaaggaaaagtagaagcagcagaaaagaaaggaggaatcaaccag

SEQ ID NO: 64394 - DNA, 1030 bp, Homo sapiens
ggctcaggagcaattctgctttgcactcaaggggctgggacttggtgaatgcaagacttgttttcttggagtgtttccagattggtgatctctgaatcttgtagaatctaggagaaaaatctatttgccccgtaagaggtggcacccatggggacagagcagaagttgaaggccagaggcaccataaaggatgtcctgaggctggaatgtctttggctctgctggctccaagaacaacacctgcacagctgtatggaggagagtgaggtgagggtggctcagaggctgattcacgcgattgttacgggtgtgcattgtgcaactccagggcgcgccatgcatatcctgtctttgttgatttgtatatgtattgtacttttctggcagatggcaggtagtaaatcatcttgatgaaggggtgcctttttctaatctgtacaaactgtctcagggactggtggtgctgatcagatgttgagctccttcacccacccaccgctgtagaatccactccatactccagaacaaccatgcctgaggcatggttgttcttccccttaaggcaatgcctgacttttgaggtacgaggctgagtggcctaggcctagactctacttggccatacagccaacctctgcctgtggggagagtagactcagagtccatacagcctgagttaaattcccagctacaagatttttgaaaacccctttctcccaaaacagcctagggagtaaatgctagctgatagcagcagctcacctacgaacttccccaggaaaagggatatttcactctgggccttctagaaatgtggagtgaaacattcattcctctgcctggagccaggacttcctctctggaactgtgtggaaagatccctgacccgggaaactgacaactggtttctaatccccactctgctcctaattgtggacaactcacttcattctctaggactcagtttttatatacatgcattgatggcagggtaaagtgtataatctcaaatcacccctttctgtattaa

SEQ ID NO: 64395 - DNA, 1007 bp, Homo sapiens
tagaggttgtatttgtgccacttgctgaattgagttttcatgttccttgagcttttgtttttattaatgagaagatctctccagtagtatttcccaattacctttcacagatgggctccctcctctttctctctgctctcctttcccccagcaacaatagttgagacttggctttttaaatatattctttccatcctgtttcttttttctcttatacctggggtttctaaaggggtacttttcttttgtttctgttttgctgcatggtttgagtaagaaaacattcttctaacacctttaaaacaattttcacatcaattactctgtcccagcctttttgggaggttgtacctcattttgatttggggcatagtgaaagataagcctagcatttatggatgagctctgaaagggattatatttggccagactgttggaccctggatcagaactggaatgatgtgctgtcctccatgcattaaaactttgcattgattcaaatggaaatagatatgtgtaccaagaataccctcttttgggactattgctctcacatttcttcagaagcattttatagatttatactgaatttgtgaactggaacacagccaagatgaccttacccttctgaagctttatttgtgtgtgtgtgtgtgtgtgtgtgtgtgtgtgtgtgtgtgtgtgtgtgtagctccaactgcttctaagttttatatctcaggatattttttttattttcggcttaagctctttgtttaagacaaatagcagagattgtaatagttcttcttttctttaaaacacaccgcttaatatgaatgccctctcttaaaaatcctgctcattctttgatccatatacttggaaattgttgaagctttcctcattcccctaccctccctagatccttattcctggtagaaaagattgactctatgatacacgactcattcaaggcagcagaggcaaactgtagcctaatctggggtgggatttaaatgctataa

SEQ ID NO: 64396 - DNA, 1055 bp, Homo sapiens
atgttgcgccatccttgcatcccagggataaatcccacttggtcatgatgaatgatattttttaatgtattgtcagacttggtttactagtattttgttgaggatttttgcatcaatattcatcagaggtaatatggcttcatatatatatatggcttcatatatatatatggcttcatatatatatatatatgtatggctttgtctggttttggtatcaaagtagtactggccttgtagaatgagtatggaagtattctgagagatgatttttatttctttctttccggggtggattctggtaggctacttaataaattaataaattgaaatgacagagcacagaagaatctattcctaaaagaatttggtgtgtaaggttgtgccttcttttttactgttagtttttgtatactggagcatactggtcccaatttaaagcccccctcaattcccattttatcaagctctgtctacttatactttgcatagttcttctttttatcttatcagtctattaatgtggggttaattttttaggggttttctaccatggcttgaagatttggagaaggacattttctagatctgattgtgacacttattccttcaaggtgactggtggtgctgttacctctttcttgtccatttgaagattgtgaaatgccattttagagagtaactgtaagacatttgaaaatacaattttctgtttgagagctcagaatagcagtcacatcataatctttcttctccttggacagtgatccttttctgatgactaggaacaagaaattggtttcattgtggttcactgtgtagcttatttaaaataatttaattttaaaagcagaaagaatacaggcttaaaagtaagattgactaaaatggataataatttctatcttatataataattgtgaagattaaatgaaataataaatgtaaaatatccagcccagtgcctcactgagtttagttctcaatgtatatttgttgaattaatgcattaatgaattggggtgattattggaaaactagatgactggttatgt

SEQ ID NO: 64397 - DNA, 1131 bp, Homo sapiens
agttgaggacagaaagagggtatgtttgtatttaagttttaccttaaaaaagagataaagatggacaggtggggtggctcatgcctgtaatcccagcactttgggaggccaaggtgggcagatcacctgaggtcgggagttcgagaccagcctgaccaacatggagaaaccccatctctactaaaaaaaaaaaaaaaaaaaaaatgccaggcatggcgttgcatgcctataatcccagctactcaggaggctgagacaggagaatcacttgaatctgggaggtggaggttgcggtgagccgagattgcgctattgcactcctgcctgggcaacaagagcgaaactctgtctaaaaataaataaataaataaaaaagataaagaaaactgggaaataaaaatgaaaattcctgaacttggaattcgcatatctagtcaccaggttatgtcaccatcggcaagtcacactatccctatgtgcctcaagtatttcctctgtcaaatgtagtagttaggcctaagctgtattctgggcagggaaggagaaggcatatatatatatttcagaaaaagctcactagagcttctttccaggttagagtcaccagattacatagtctctaaatcatttctgtccctgaaaatctgattttgtgagataagtaaactggatactaaagaccaactttagtttggtcgttcttaagttttgtgaccttggcaagtcacttctcttttggccttacttttattataagccatttatctggcatttatgtttaaaattaaggtattggaaaattggctttctaaaactattgcagttctaaaagtctgtgattctaaagctagctaaatacatgaatattatacatatgtgtatatgtcaaacatggcaaagaacttactgtagtgagacaaataatcattacatttttatgtgaatgtattcagcacccttaagcattatgaaaaatataaaccaaagtccacattgttaaacctagttctaatttttaatgggaaatgtatattttctcttgaacatatgttgaaatgctagatttgtatagtatttgctctcaacttgtaatacaaaaatctaagacttctatatgcttttctaggatgt

SEQ ID NO: 64398 - DNA, 1071 bp, Homo sapiens
taggccgtcaaagtgcaatatatctctctaggaaaatcagcaaataacttacctatggtttaacataaaataactgcccttgaaaattgcaataaagcttagaaaccttgaactttcagtgtaatttgtatattaaaaaatgtgtttgggctgaaatgatttggagtttcatttgtcattccatttgtgtagtatacttgcacacattgacaagaaggacacgtggtagttaactttgagaaggggcatttttgagagggagctgacaaactttaaccaacaaaatgactttcagaagtcttgaaggaagaagaaacaacgtggagacaaatgagtatgcttacatagtatttggtaaaactatgtaaaagtacagaagggattattgctgcagttaaaatctgtgccagaaacaagttttccactggagtaaaggttatctttttttttcttcttaatgttgggggaagggcaattaattgaggacaagagggaaattgtgggggactgatgttagataaactattttgtctttgtgttgacattatattggctacagcctacacgagggaatgcctggaaaaaagtaaggagagagaggcattaatattttttagtgtgcgtgggtgcgccagcagtagaggggcccatgttttcttagggctcagatggcaaagctaagcattcagcctacggcaggaaaaaagtgccttttttgttttctgactgcagagtccaggcattcccaggggaacacaatgaatggcccattttgtccaacacggtttcatagacatagatttcttgttttttcataattattcttgcccgtcattgggtgtgcacatgacatttgagcgtgttttaaagtcttaacacactcatgtgcctgcaataaagttactcataacaatcccggctttctccagacaacagagcagggtctgttgttttcacaagtcacagcagctgggaggcaattgtgaagacaacagcttaatctaactggaaaatacaggaagaagagagtatacactaaatttcctcccatattattcaaacaatgaagaa

SEQ ID NO: 64399 - DNA, 1045 bp, Homo sapiens
tgaatctggagattttttttatggatccaatataccacattctttggtttctatagcacatcaataggaacacatttaacgatggaattttgcaactagaactgagtctttgcaaaagaattcagctcattaaaatatctctgtgagaaacttccttttccagggatgaatagtattatccaattatttgtgtctcttcagactccaattttagagttattcaagtggcttatattgtgagctatataggcagtgtcctctcctcacataactaactaaacaacgatctcttaagaatggactggctggatggggttttatttaggcatttggctttctgggcaagggccaatgatttagtcaattcatacacatgtgtcttttttgggtaaaatcgtgagacttgaaatttttagtgccttgttttctttatgattaatgtgcaatattcattgccctcccctcatcatttaacatatgcattagatggcaaactttatttgtagaaggcctgaactaaatgccattgctgcgtctttgcaaatattctttgtcttatctgaaaactttttcttttaaatgttgaaatacatattgcttattttcttttacccaaaccagtgttcattacttcactgaagttgtactctgttcttaagcatatatgattatctttcatatacagtgtttttaattttgattataatatattcctgtgtgctatttatatattttgtgagtctgtatgtttcccacgtggtagagcatcattaaatgtgtgttatcctttcttcctttttggtaaccagaaagatgctaatattatcagcaaggaagtgattgtccttaaacaattaaacataataacttgagatgtcctctcaccttttaaggagatagaccttaccttttgtttccttcaatatgattaactacaggcatttcaggtatctgctgagcagaataaaggactacctttttatgtgaagtagttgtctaaagatcagaaataattgctttgtacattagccttcatgacctgctt

SEQ ID NO: 64400 - DNA, 1087 bp, Homo sapiens
catatttttgtgtctctttagagataattttgagttacatttacagaaagtggtagaagtaagtttggacttagactttctcggtcaggatcctacttctactatatattagctatctggacttgaggaagtttcccaacttctctgacctcattctacatacttgtatattttaatgcaattcatatatttaaagtacttagtttaatgtacatcatattatatcaagtgctatcatatcagatactcaaaaactgttatagtatttattccactataggtaaaaagagaagaaaagtctcccagataactacaaatattacaatatgaatctatttatatttttgatcctttgtaataaagtgtctaagatgatattcacttcctgatctgaggaaagctaagaagtacttgaaattattacatgtgataacaaaaagctagataagttttccaagaaaacaaatgcatatatggtttctatgtgtaagttgctactccaattccaactctattgctatctctgtctaccctttctgaaatgtcctattctctaaaatacctatgcttccttttcccttatcaaataggccctttgtataagtgatcttaggtgataggaggaaaaatatttgattaaggtattttaaattcgattaaaataattcacaataagatgttaataaccaattggcttaactccccaaaggaagaggtgtttttttgttttgttttgttttgttttttgttcttttttgagactgagtctcgctctttcgcccaggctggagtgcagtggcacgatctcggctcactgcaagctccgcctcccaggttcatgccattctctcctgcctcagcctccccagtagctgggactagaggcacccgccaccacacccggctattttttttttttttttttttgtatttttggtagagatgaagtttcaccatgttagccaggatggtctcagtctcctgacctcgtgatccgcccgcctcgggctcctaagaggtgttttgttttaaagatgagcttatgaaataattgcgaagaatccttactttgtgtaatatgtaaggg

SEQ ID NO: 64401 - DNA, 1030 bp, Homo sapiens
atttttggaaagaggaattaagatactttggagaaagtagtgcactgtgtgctgacattccagatggccaaactatagtagtaccaagcccaagtttttgagcctttcgtgccaatgatgacctcatgaggtccagcctggagaaatagagacatagttctccaacaatgatgaagaatggcttcttcctttcatatttctattgagtgatctccagtgtcctcctcttttcctgtctctgacaaaattagccttttataattaacaattgttagttttttggcttgtctttcagacttctcttagagtccctttcaccccatctacttattgtatcctctctaccaaacagaaaaacttgtgatatttttctctttggcattcctgtcttttcctagcaggcttttttaatggggactgtgggagattttacacttgatttgttgaatctgaactctttgctgtaaactctcaccacacagaagaaactatctttataaatgacagaatggacctggcctgaatggcgctttgtttactgttttcctaaaaggggcccctctatatttcatctgtcaaagttgcttttctttctttcaacaatgcttgattgttttcacaaaaattcaggttccatagacaggagaattctgtattatattttcctgccaaattccgatctctgttttccttcccctgtgctcacaaagggctcataacttactgtcaactgtgaggcaaaccacaaagctccactgttgctcagcaaataggctctattggatgatggcttgactagcttgtaaagtttgcttaactgtagcagcagtggcagaaggtatgtggggtactgtatctcccaacaggccaagagatttcacttctttcatttacttttatgtttttaactcctttaattgttgaacaaagttaacagtgttttgtttagcaaattagatgttgcttaaagttatggctacaattggtagcctgagacttggcagagattaattagctgtggggttgggtt

SEQ ID NO: 64402 - DNA, 1029 bp, Homo sapiens
tagaaagtattcgataaaagatggttactattgctgttcctcttcctgcttcctgttcatcagtgaagctttatcttatcaagcctcttatatgaagccttcctgaactacttatttcccaagtgattgcttattctttattctttgtacccatattacttttttgcatactttaaaataaatttttaatttttgtgggtacaaagtaggtgaatatactatgggttagcatacttttattgcaacatttacaaatctatgttacaaatatttttctgtgtcttgtggcagattgtaagctcttagagaaatatctgccttgtctacccatccctagtttccaacatatagtaagtgcttaaatatttgttacataaaagaaaaactgagtgtcttatgccttttatgaaatcttcaggaatagaatttttgattgggaaggaaagagaggtggtttggaaatctaagaacatttgagtaaatgaaagcagagaggaaagtaaggttttggggcaccagagagcaacatgagagcaaaaggtggttggttgaggtgtgtagtatatataacatcattatatgatatatattatcatcatcgtcatcatcattatcatcaccatcaagttcctgtgaaggtgagagtatagtggaagagatatattgtgatgtgtcaatgaaacaattttgtgataccttcagcacaatgctgtaatatacatgataacattggtaacattacaaaatgcaattgtgtgagtcagtataacttcaaccattgctgtaagggcttttaaacaaactgctaaaactcaacatactttttggagtaggtggaccttggaagaaagcggtggggatggataaactaagaagcaaaaaagaattctaaataatagaaaatagcataaatgcaaacatggtgtaggctttaagtaagcatagtatagcagcaagaacaaatggaccttggagttgaatacactagggcttcacttgatgcaactctgatcaaattacgtggcctga

SEQ ID NO: 64403 - DNA, 1890 bp, Homo sapiens
tatattggagacctttagaaagttctcattcattgtaactatgaccaagaagcatctttatatctgatagatcaaataatcaggtgaattaggtttctaatgtggtatatgatgtttttagttttgggggttgggaaactctttggaatcatttttctgacaagtgacttacagtgtaatgaatattctttctcctttttcccttccccttccttttcctttctcccctcccttctgtccttccttttttttttcatttagaaagagattgtttctaattagtctgtatgctatgtgctgagttgtgtgatagtacccaagacatgtatcttaaattgtatgcagggtcacctttttgattaagaactgaagagtactgattgggtttcttatataaactaaaggcactctagtccactttgggcaatcaaagaaactaaggaactgttggaattagttttactattttgggggtgatgaagataggataattagaaagaaattatagtctttattgggccagcagtttactaaacttgaattgggatttgtgaaattttaaggcttactgaatatttgctctctaagaacaggatagagaaataatcttgatcttaaaaggagaattttaaattttttagaaagatctcttacagtgagatatcctgtataaccataaagttataaccatcagggatgtccctagttgtgtttctctggcatttcttccacacagaatgagttcatctcaattgttgatgttggtcatttgttgagtgtaatttaacttagggataaaagggataaatatccaactgaaccaaaaaggtaaagtttataaattatctcaaggatactacacaaaagataaaactcaaatatgcctgaaagaaggttgtggattggttgaagttatgattatatataagactgttagaatggccagctgtgaagcaatttgaaatatctagagggaacagcctgcacctctcccacaatagtacctaacagtgctccaacacttccaagtttctgtggtggggaaagaatgggagagaatagacagtcgagggtctatacttggcatagagaagttaaccaaaaaacagttgctgcttgtgttaagaacctgtatgtgctagacattgtgctaagcacttacatgttgtttttaatcctttcaactctattgtaagatagcttcctcccctgcaatacccagttggtttctctaaattctgatttcttttttgccttcttagcacttaaaatgattggtatttatcacatatttgtatatttatttaatgtgtagtctctacactagtctaaaagctctgtcagggaagagaccatgactgttttgttcaaacttgtatatggagtttctagcacagtgcctgatgtatagtatgttcccaataaatgtttgttgaaagaatgagtaaatgaacaaaaaatatataaagacaaggaaggaatgaatgaaaggaagaaaaaggcagaactgggatttaaacagttgatctgagtttggaaccaatttgttcccattccggtacaccagcagggttttatttcatttagaatattctcaattacaaatttatctgataaaattttcacaggttgagctgtttcagagcacctcaaatatttggccctagaagtgttatatcttagtctgaggctgaatgccatgaaaaaggcctgcctagtccttttctcatcctattggaatattgcaaccatcttatggtgatagttctctctagaaatacagattccagggtcttgatttttaggtttctgtttctcctactcaaagagagtgcacttctctccctctttctctgcaactgacccttaatctggtccttgggctgctaa

SEQ ID NO: 64404 - DNA, 1037 bp, Homo sapiens
catgcttcagctgaaattttttgaattacatagatttttagggaagcaaacaaacaaaaatcacaaaatcatgtctttgtggcattttaaaatggaaagaaatctgtttaaaactgagcatagcccagaccaaagatccctcagtgagaatatctgtgattttaaggacaagtaggtctaagtgcgttatctttaaaaaatattattccaggctaatcttgacatagagcaggtaaataaaaaagatgagctgtgaaaatccacaaatagggcttgaatgccattttccatgacaacgggagctgccccatgaaagcattaatgctgggaatgtaaggaatttaaaattgtgccttctcagttttacagttgtgtgctcatgttaattagagatatactgacatttgaagtatctacattaatacacacagctactatacatttgtgaaatgtggccagaaatctactttaattgaaaggagtttgctaatctgaatgtgtatacccattacattttaagcttttaaattttatatactaggtcccttagatacttgttctttttgccctctctactttctgtttctaatttatacctgaaaggacagcctggcctatttttaatctcttagtggtgttttggagctgtattgatggaattttgagaaaaaaatatttttaatagtgctttttatttgctgtagttttgaatctttttttccctctctgactttctgaattactgttttttcttgcaaacctttaaaatggcctgccaccaaaataaggtaggatttaggtgtatgaaatttgcttcactgactgtgtttaaggacaaaaatgctactctttattgtcatactatggttttagtcagaaaagcccattgttggagaccttaatggaataaacagtgaagaggaattctggtttttccagtatagctgagttttatctttcagtcttcatgttaagccatgtgtcttaatttttgatttgcaaataggttcacaatagcttgatgactttttgaggtc

SEQ ID NO: 64405 - DNA, 1095 bp, Homo sapiens
ttgatgggaaaggccattattttttttaatttaaatttttgtgttcttactgtccagtgtgatctttaacccatggtcactcttcgctgaatgtataaatgagcaaatagagaactggaacaatccatgggtgattaggcgttctgaggattcattttaccaaacagattgagattttccagaacacgtaatgatttgctctggcatttccttctctatcttttcacatttgtgctgccatcaggaccatagtgactgcttttgtttttggaaatgtctttttaagactaaacttttctagttcttaaaaaggtacctatttcaagttgtgtatatattaattcttaactctttgcccctcataaaatgttgcttgtttagccttcagttaactgcatgcagaactatgcattaaagtcatttttaaaattatataatgatgaactctttgaccataggaacttattattttttaattctttgctgtaaatttcaccaatagtgcaaatccattgataatgagattcacagttgcttttaacatatgtagcacgactggactgatatgatgaataagatttattgactttgtattggtgtatgtgaaaatattatttgttctaaatgtctggaatctgacttgttccaaaattaaaaatatttctagagttagagatcttaattcaagatagttcattgattaaaaaattaaatctatgctaaccacaatattttctggtcacattttcttttagctccccattctttatgtggaagtgaaggaataggatgtatcatgtatcttgcataattccaattaatgcttttaaaaaagtagttgccagaaaaacaaggtgtggtattttaaaatgtataagtactaaaaactctttcggattcttctagaatttagacttttggatatacagcattttgctataaaatttattttgtgggtaacttctttataaggaaattataatttataactcagcgggggatagcacgtgaggatggtttgaatcagaaccagtactctttgatggttttggataatacacacagtgtgtccaggtaggcttgtctggtgtccca

SEQ ID NO: 64406 - DNA, 1052 bp, Homo sapiens
ctgatactccattttgcagccaaggaaattaccttagttttttcaagcatacaaataagaggcaattatacctagcacagcaagtataatatagtaaatgctgattaaaattagtttctctttcctccttcccaaagaaagaacaatacttgtgggtggaaattacaaagtggtaggttttagttcagtccaagataaatcttttttttttcaagttcacaaaagcactttttatttgaggcaaagagaagtcttgctgaaaggattacagttacaagcagttaaaactcaactgttagtggcactactttaacctggtagattttgcttccctttggtcagaaaagggtattcaggttgtactttccccagcagggcaaaaagaagggcaaagcaaactggaagagacctctattctactgacagggctcctcagatccaacatcaagctggacacaccctcgctggccactctacagtttgctgtcccactgctgagtgacacaggctatactacatttgcaatgaaaaaaatgaggcaggaaacacaggtataggtcacttagggacaagcaggcaaccacagcttcaaaactcttcatggaaggggtaatccttgtgggaggcacagctcaccaaggcacagaccctccagttcctgttgtagttgagtgaggtggtcatatcctggctgctcagttcaaagttaaagaccttaacgttctcagcaaatgcattctggtgtcacagacttggggatcaccaccaagttcctctgcatggggagccagatcaggacctgggctgtagttttattgtgcttggctgtgatcaccttgatcctgggatcctccaggaggcaaggtcctcgggcttggcccagggcctgtcgggagagccgagggggctgtaggcagtcaccacaatgcctttggacttaacttctcctgaatgaggtacaggtgacactcaatctggttaactgcaggcttatcctttaagccaggtttatttaagatcctctccacctggaaatggttgaagttggagat

SEQ ID NO: 64407 - DNA, 1048 bp, Homo sapiens
atcaaagctagttttctcatctatcttttatattctgcatctctactacctgagaccatgattattccctgtcctggtcctccagctttttttgcactgagattaagtttcaggtgtctacttctttatgacattctatgtccttcaaatctataatctaccctacacatgactcaaagggaatctttatttaggttttgtctgggggtcttttattaacataattttctacatctgacttaggcatttttatatgtcatcctgggtgactgaaactgttttcatcttcaacaacctttaaaccacccctcttgaaattgtttctccaaatcttttcctctacaaagttgaggtaatatacatatatcatccactcaatcccatacaatgaagacttatccatataacagtataacaattgtggaattgttttatttattgccgtgaaagtgtaataattttttggtgatttgtacatgtcctgttatttataataatttgaatccataaactatataatccatatggcctccagaacactgccacctacatatgttaggaatctcctgtgtgaattgctttttcttttttttttttcaacgcctcctcctccatcgtttaaaatgtttctcttcccccatttgctgagatcctactaagtggtgtgttttcatcatctctgcttccttcatctctttcttttctctcttttgactacttctttttttcgttttccttcatccttcttattgttcatcctaatatccacccttcttgtcttctccctggcctgcctgtccttccccttctccgtttgtctcgtgactcgcttttgtggtccagttctatctcttagtacttctcaacattcagcccatgcctccttctgtcacctaacttttccaaagcacaagctaccattcatacattttcctttaccatttgacttcctcactttctccagtttgctccttttttttctccccgagttgcctaccttttccacgctacagtttgcctttctcctgactcctcctcccagcagccc

SEQ ID NO: 64408 - DNA, 1039 bp, Homo sapiens
aaaaactattaaaaaacaacagtttttacatttgtttcaaaatgtagggaaaaaatacgctcactaggattccatcatatttcttagatttataagagttcagtggactcatttgataattgcaagatagcatgagttttagtctgttcttttaaaaaataagttttctctttgttctttggaagacttttaagaaagaataaaagtaatgacatctcaatcctaacaagtaactagaactgctaaaaaaaaaaaaaaaaaggcaactgaaaagttaaaattttctctcttaaaagttagctcactgataaaggcagaatttttaacttcaactaacaactgtggctgccatctaagttcagagtactaggtgctctaggaccctaccctgcgaggcagtgggtctcaaagtgtggtccccagataaatagcatcagcaatcatttaagaatttgttgaaattcaaatcctagagctccaccccagacccgctgaatctctggggctgtagccctgcagtctgttttaacaagccctctaggtgacgctgatagaggcaaacttttgagactcagctctggctgtaggagaactaaaggattctgctgtgaggtaatagaaaaggagtaaatttgaatgtgatgaatatgcttaacttcctaagcaagaaaaatgaacgctgtttatagttacaactgacaggggaaaaaaacttgagagttacaggtagactttagatttcgtaatacttatttttatgcaaaaaaaatttaatcaaccaattttttttctagctgggatctagcaattgggaggcagcagacttgggtaatgaagagagaaaacaaaagttcttgagacttatgggtgcaggaaaggtaagcatcagatggtgtgcatttttaccttttctgtgaaaatattgccatttttatgtatgctaagtaagaaggactgaatatacttggattccattttcctgttctgtgtgatttcttttggctttgggaaatacatgtggcctaaccaagcacataaa

SEQ ID NO: 64409 - DNA, 1045 bp, Homo sapiens
ttccacaaaaccggtgcctggtgccaaaaaggttggaaactgctgctttaaacttttaagttgctctgataaacttgataagcaaagaaaggcataaagaagagtcagtacatgaccattttatttagccatttgctgaacagaagtgcctagcttttttcactgtttttgttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcaggggaagaagacaagaaaattaatgaagaactggagtctcaatatcagcaaagtatggacagtaaattatcaggaagatatcggcgacattgtggacttggcttcagtgaggtagtaattaacttattttcattgggaagataattagttttcaatttggtaccatttattgctgttagattaccctagcaatcaagaatcccatgtagaaagctttctgtatgtagttatcttaaaaataattttgtatatgccctactggtcttgtagataatcaggagagatgtttctaaggattttgtgtggggttgttttttcctttttttttgagatgcagtctcactgtcaccaggctggagtgcagtggtgtgatgtcttccacctcgcgggttcaagtgattcttctgcctcagcctcctgagtagctgggattacaggcgcctgccatcacgcccagccaatttttgtagagatggggtttcaccatgtaaccaggctggcctcaaactcctgacctcaggtgatcccacccaccttgggctcccaaagtgctgg

SEQ ID NO: 64410 - DNA, 1118 bp, Homo sapiens
aggctggaatgtagtggcatgatcatagctcgctacagccttgaactcctaggctcaagcaatcctcccacctcagcctcccgagtagctagaactacaggcatgcaccaccatgcctggctaatttttttcttttttctttttttttttttagtttctctctctctctctcccttttttttttttttttttttttttttttttttttttttaagagacagggtctcactatgttgcccaggctggtctcaaactttgggcctcaagcaatccccctgcctctcagcctcttgagtagctggaatcccagccacaggtatgagccactgggcccagccagacagagctctttcttaaaattctactcaagtcttaaagctgttgttctaatggctacaaagtagagtgtttctaagaccgacagaacttacggtctttctcagattttgtatgggctaatgtttatttttaaaagagcctgttgattgatgttttaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaa

SEQ ID NO: 64411 - DNA, 2740 bp, Homo sapiens
atccgcttcagcatcccaaagtgttgggattacagccgtgagccaccacgcccagcctgctttcatttttaacagtacacattgaaatacagaaaaggtgagaggaagcaactttcattgtatcgtagcaataaactccacactgggtgacatctacctagaaatcccttccctctaaccaggccatgatgggaacctttgctgcctgcccttggagaaccccggattggcttccctgggactcaggtctggtggcaggagggcagcagtgtgcccccaccatccctcatggcctgccgccagcagggccataatggcaggactttgatttgacttccagccccacatgaggaggggggctaccaagccaggtgcagtgtttgtggccctttatttaagttgttttcttatattattctgcatataaacaatgacgtttaaatggaaaaaacaacaacaacgaaaacctccattgggtggagccacactttaaatgaaaatttctctttgactatgctcagaaaaaaaaatagaattttgaatatatctagcagttgttgtctatttttaactaactccatatgctgccagtatcgacttcatgacatttgccaaaataaaattttatttttgcctttataagattttcttggaaaaaatgaaatgaatattttgcaagaaaaagttaatttaaaaatgtaatggtttgcaaaaaaaatgtgatgtacagattaaaatattaacctgatacgtttcctgtttcttgctggctatagtctctggtgagtggcctgtgtacgtttgtttccatttctttggaaaatccccactgtcagctctcggccctgcttctatttacctatgaaaagtttcttctggtgacgattccttgacatttgattgactgtagaggcctggattgaggaggcctgtgcttctgggcccctggctaggcttccacagttgctcaaggcaaccccctaccccatcccagtcaaagagccaccaggctgtggactcccttgtggggctggtttgtcagacagactgcagtccaattcaagacagcgcagggaacgctgtgggcccccttccaacccacatgctgccggctcgctcctgggaggcagcttagtgacggaccattgcaaactggatttgtatttaattcattttgacttgtgatgtatgctcacaacagaaggcaagaagccagttccattgaggggtgtgtatatttctgagctgtggttacggcagtttttctctactgccaagaagagcatccgaggttcatggtgactttccaactatttaaactggggaaagtagattccaaggcattccgaacagggggtactgctgcttttttagctactgaactctttaattttaaaataaaatgtactctttggttttaaacattacttggagatgtcaccataacagatgaaggggggtggtggtggtggtgagaatgatttcataactgagtacaaagcccctcaaaccaaaaaagaaaccacacaggggataatacccaccccacagggtggccatctgcagacattttctcagtgaaaacatgccagtgggtttattttttatttatttatttatgtatttatttatttactgttggtctcactttctgtctcacacatgcaatcctgtgtaagagggaatgtggaacccactaccttgctgctctttttagattgtgctgtcagggaggaggggtagcctgttctataggaattgaggcccagatttcaatctacagagtgagtgagtgactgtgtgacaggccctcaactcggagtcgacggagactaccatggtcagaaaaggcacactccagctccatcctgcgtaggcaggtgacgtggcccagccttgagagcactctcattacctgaggtaagatggggccacctgtgatggtgctggctggctggtgacactacagggtggggaggactccagggaatgccatgtggccccgtgattccaacttcccttccaggagaccccagggccttaaacgagattgcagttgacgaaggggatgtgagcacacttctacatccgtttgctggtgtccactcctcaattctgactttaacgcaggtccaggttgagccccggatatctagttttagcaagaacgaacaagaacattttaggatctagtatgaaacgggttaggaataacatcttttcctaatgccttcttgaacctcctgaactgccaagattctcaacatgttcagaacgtcgttcagatgattacaatcatatgtaggatttgtgagtccatatgaagtagacatgcccagactagtgtagacgatgaaaacaagcattttgttttctccatcattcactttcctgcctgccttggtgtctgtgggagtgtaagctgcagctagcccctccctctctctctaacccctgggctgccttcaggtcagctgggttctctagaattttcctggttattttaggttgcagggcatggccagggaatcatctctctgcccacagtttcattccagggacctgaagggatgggggtggggtggagcagaacctggctcaggctcagccagacaggagcccattttgggctttgggaatttcccacaaggacagcggaggactccctggcaagtccttttgtgttcttaccaagggtgggaaagaagaatcaaattatttgtataatccccatatcaca

SEQ ID NO: 64412 - DNA, 1040 bp, Homo sapiens
tacccacattgaaagaatgaagggcagggccagactgcacctttattagagtctttgccctgtcgggatggggacccaatttaggggccagcatgtgtctagcagtggaataggggtgcagggagggtggggcaagagccccatgtgtcctggaagctgagggtcccccagcagcggccgcattgccagagccccctgctctgctgctctgcctgtccgcctatctgccattccatcatgtgtgtgcagacgtgcctgctccctggatgccagcctctcactgtctcctgtgctttttgccagcccaggcagtgactgacccgtgacccagcatgcaaagaagcctggagccaggggcccagtggaaccagcttcctccaaggagatgacctttctgcccccaaggaaaccccttccagctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcagctgcacgtacagattcaggtacttctgggtgacaggtgttgtgggggcaggaagggcggggcaagccgaggctagtccaacttccaatgacctcaggagaaagtgagatttaaagaggtgttcccagtagactccagcaagaggctggttggcgtgctgtctgggagaagaggggcccttggctgcagagatcagctgtccctgacctgatgaccagctctgtgtgaaactccacgaggatcacacgtggagcccaagtctgtgccttgccccttgggtttggcttaggggcaacagtgtgttcaagaggactggggcccacaacctgcccccaggcttcctccagcaaaaggctcttgtcagaaagaaaaaagcagtttgctatc

SEQ ID NO: 64413 - DNA, 1005 bp, Homo sapiens
gccaaagaaattgaagaactgtaagattgggaaaagtccagttctacagatgaggaaactgaggcccagtgaggggctggggctcactccaggtcacaaagaattggtgtcagcgcagagactgggactgcccttttggtcactgggcactttaagagggagagaaagggaagcccagggcaatgtgaaattggccctcagccaggcagaaagctctggcaccaaccctaccaagttctccccatgtgggcatctagtgatgagaggcagtgtgggatgaggagggagccctgaaacaggaggctggcatctggtccagtctcaagtgagttcttggcctgggcctgttgcttttgagcccagcggttcacctggacaggggaaggtcagactaccagtctgggcagtccttaccctgacatcccatcccactatcattttgcagggctttcccctctccttcctttacgtatacttgtggttaacattgttgagtgcctgctgtgtgccaggcattgtgctaagtatctctttcgatccacacaacaaccctatgaagatattcccccccccctccccgttttagagatgaaaaaacaaaagctcagaggccttgagggatatgcgcaaggaatcgcagcttgttaagtgctggggtttgaacccctttgatgtgagttcagagcctttgttccccatcaccactcatgggttcatctgggccgccccgagcagctctaggtgtttggagaaagaagtgaaaggagggagagagtatttgtgctgcagggagcgaagcatgattttttggcaggtgtctatcctgggtgctccccgtgcctcacagcagagtcagcaggtccccgccagcctgagcatgagaggaagaggtcagcctccttgggccaggctctgaggaggtgtggagtagaggccccgtggttgaggagccatagggaagtgctctagccacgcccattgtgaaggccacatttgagggtgtgg

SEQ ID NO: 64414 - DNA, 1099 bp, Homo sapiens
ttttcaaggtgctgagccaaggggccaaggtttctgacctcatgaagaagggggcaggaaagtggttgatgcttggatttcttgctggggcaaggcagaagggggcccctcctgccttccctggccccctgccttcgtctctaaactaaagccagtgttcacctcatcacagtgtactgtgccagaaagtacaggacttggaaagtgggactttgcagtccaattggaaaaaaataacaccatgggatgagaacgtgtgtgtgtgggtgtgtgtgtgtccgtgtgtctcaatgtgtgtctatgtgtgtgtgtatgtgtgtctgtgtgtctgtgtgtgtgtgactgtgtgtatgtgtgtgtgtctgtgtataaaagggctgctctttctctcagccaggaaggagaccgcaggctcctccttccactcacagctcacctgcttgtgtgtgccttgtgccttcacaattcacccagtaccatttctcccccagtgcagaggccactgtgtgtctgggtggtgctcctggccaggtgtgcttcttctggggagggaacagccatagagcctgaagtggtgtcatggcccctaccaattctccaaccctggccaaagtgtctagaagtagccaaggatgtggccggcagggtcctcagatgcctgggcctggggagtcttgtctggagatcagagctttgctgtggccccagagggccatgagagtgactggcaacaaggggaggggccatagtcttagtcaaaacctgttctctgtcccccacagcctgatcctgcacagagtccttgaaatcttggctgtcctctgtcccttcgagcacatgctgaatgggctgagaggtggccggtgtggtgttctgggattagggatgcaggagatggctcatccagacctctccttctcatgacccaggggttcatcttagcagcttttgagcttctcctggggagggttcgagcaggggcggctcccccaccataccatgccctcctctcgccttgcttgctctaaccctgagggggtctgccatcctcggcctccttattgccagcagatgagcgctcccagccctaacatgctgc

SEQ ID NO: 64415 - DNA, 1045 bp, Homo sapiens
tgaatggaaagtgagggggtggaggggatcagagaaggatcctcaaagtgaggttgaaaagatgagagtcaagggaacaaaaggaagagcttcccagacagaacagaggccccactgtgggcggggaactggagggactggttgatcagtggctggagaggtcatcaggggtcagatcacttagggccttgacggtggcattaaggatgatcattttttatcctgagagcttgtagtctagttatttcgcccttcccttcccccagcctgtaggaggttggctggtggagtggaaggaacatgagctttggagtcggactcaggttcaaacctggattccacaactgactaattttgtgatcttagcaagttacttagtctctgtggactctgcttgcttcccatggtgggaggggacagaggtggggaaagcgagtcctaaacccagacatctgagcctctccctctgccacctcctggcctctccccagctgtccaaaccagagaaggtgtcaatccctgagcgctacgtggagctagatcccgaagagccacccagccttgaggagctgcaggcgcggtaccgcaaagccgagaagatccgcaacatcctcgcccggtcaaggtcagccctcgcttgctcaagtgttggcaggtcaccctgaccccaggtggcgtctctaccatgtgggccctgggccgggctggctggggtgcgtgttttgccaggtcttcgtctcaggtaagccctactcattggagggggcaggctggtacatcgccagcagatcagcaagggagcctgcctgggtcatctggaaagacctgcaacattcgtagaggcttcttgtcctgggctgtcacccccaattctgtgtcccaagtgaccctagcaagtgtggagaatggagccaagcgtggccgtgaagtggaccccgttggagatcagctccagtgatggcctgccagcattcgggcctgtgcaccctcatgcagaccagcggatcagagccaagggtgccagccttgtccgtagggcaccaga

SEQ ID NO: 64416 - DNA, 1735 bp, Homo sapiens
ggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttggaacttcagttgcctaatcctttccaacaatagttggaaaccatcacctaagagtgattacattgatttggagtcattgagagcttgtgcatgaatgggtgaaatgtgcgaatatggctctgggtttggggttctggagggacttgaggcatcaaagacaatcaggaccatttggggctttgaggtggatggatgggagagagaagatggcctgggatagataagcatctgctttggttttgctcaggggaagagaggctttgagcctgctctgttctcaacaacctgctcagcggtcaaaggcctgtgaggatgcaggtcctgggtcaacaggaagtcaccacggagctggacagtcatggttggatcttatcggttagattttccctcttgggaagcttgttacaaagttgatactgtgaaacagccttagaaacattccatttgatttagcatttcaattttatatgatttagtttttttttctaatttaaagaaaacatctatctcaaatagatgggtctcatacagcagtttttctgcctcattggctccaagctgcttttgcttgtacctccccagccctactgtaagtgcgagatcccccacctacgaatgttatcttgttgaaaattcccaatagaaagatccttggttattcttcttgcttagcagggccttgaagggcgtgtttttccattaattctgagcctgggacgtatgtctcctgaaccagctgtagagagtggaagggacaaatcccttctctagaactctgtcccaagttgtttggaggtcaccctctctgggagccttctatttccctggggaccactgtgagcctgaagtcatgagtcttagacctgtgccccaagggtgtatgtttgaaacctctgggaacccagatcagagagcacttagcagtctggaacagcccatatgaaggggacagcagcttcattctctattgcacatacagcttttccctaaggggatcacaggttcatcttccaaaggaccccatggaaaaaggtgaccagccgggctctttcagcaatcaggaagcgactacgtttaacctcttgttctgttgccagtggaagcgtgagcaggactttgacctgcagttgctggaacgggtcgtgcaaggggaaaaaaaggacaaggaggagaatggctggttgaaagtgcaggccatgcctgtcactgagttggacctggagcctcaagactatgacttggacatcagcagagaggtgagggcaggcacttccttcatgtcctccaggagacatggccttcaagttcccagcctgatccaccttcccactgtggggtat

SEQ ID NO: 64417 - DNA, 1080 bp, Homo sapiens
tgtctctcttgcctgcctcctcttcctcagagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgact

SEQ ID NO: 64418 - DNA, 1317 bp, Homo sapiens
gtgctgtgataagcatggaagtcagggcagggttagcagcctgcctgcgatgtgcactccagatgagcggagggagcagttcagcacagcaccgagggcatggacccaggagacctgagtcctgggtttcaggacacagttatacaggtaacacttggaggaatagaaactgtatacctctgaggggatagaggagcagagcatgtcccttcttcactgctccgccaggggaagtgtgagtgctccttggctgaggcagtcatgttctgtggctctgatgtggcctgttcctaccctttaaacctccactgtggcagtacctagcagtcctccctccagctccgtctcgctgaccactggtctggttctctttctcagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtgagcgggggaccctggggctgccactctacatgtggggagaggtaaaggggtgtgacactggcaggtcacatcacctgggactctgcccacaggtggagctgcggtcgtatgtcagtgagcctgagctggcgaccctcagcggggacatggcccagccctccctaggacttgtgggccctgagagcaggtaccagacgctgccaggcagaggtaaggcagggccctccctggagtttctctgggaatcccaccacactgcttccagccttcagctggtgcctcgtacccttctgcctgcagctctaggcctaggagtgagcagcagctgtcaggggggtctgggatgccaagagggaggacctggcctgtcttcctctggcccacatcctgattctcttcctcttttgttacatctgtccccaggaacaatgataatagcagttactagaaagcctggcactgtttaagcactttatatagacatgatattcacaacaatcctatgaggaaagtactgtcatccccattttagagacacagaaactaaggcccagagaaattaaataacttgccaattagctggtcattggtggaaccggaagacaatcccagtgctctggctccagagtcactgcaccctgtaggccggagtgctgggtggctgccaccaccttggccatctcagaccttccagagtgccactctaagactcagtgagccctttccttaaatgctttcttgcca

SEQ ID NO: 64419 - DNA, 1457 bp, Homo sapiens
cctgagcctcctcattttcccttttgtagatggtcacagaggctcctcctcagcttggtcatctgtggctctcaggcagggctttctcagcttgggtgagcatcaggatcaccaggagaggtcctctctcctaggaatatatgtgtgtttgccagttttaccatttgttttattacttacttgtttttaacacttataagatgggcgtggtgctgcttgcctgtcgtcccagctactgggaaggctaaggcaggaggatcatttgagcccaggagtttgaggctgcagtgacctgtgattacacaactgcactccagcctgggcaatacagcaagaccctgtctcaaaacaaaataaaacccatttatatttgtgaaacaataatatccatcctgaaaatgacataaaacaggattatataatttaacaaataacaataaagagaccacctgttttataccaacagctagactaagaaatagaacactgccagcaaccagaagcctgtgggttctttcccaggccaagctgcttcctgtctgccagaagtaaccacaatcttgactttttggataataatccccttgcctttttttttttttttaattttagtacctgtgttgactcctaaacactgtgattatgctggtatataattctatatactattttgtgtcttgcatcttttcttcaacattatgtttgtgagatttatatacattgttgcatgtggctatagttcttttatttttatttgacttattttcttgagtttaatgtctttttaaaaataaattagataatattctcaaaagatacaaaagcaaaagatataaaaaagtacataataacatgtctccttcccaccctctgcctccagacattccattcaatcaaaggcaatcaatgttttatgtttatctttctggggagctttttagaaattggtgattcggatatcttgtcaggattggaaactgtggatcctcagagaaccagtgcgtatcttaggcagatggcttaactttcacacatcagtgaagattgttgataaacctttgctttggagtgctctttcctgaactttccaagagcttggagtgccctttcctgaactctgcaaaattcttaaaaacaaaaccaaattagaccgagaaagagggaatttaggaggtggaaggcatgatggtcgttagtcctgcgagtgggtgttcatggcaaccaggggccggtctgttgatatgtagaggaaccacagccctcacagaacactgtggacagggagtttcaaggaaaatgttgcattcatcacattctagggaatgaactgcatggtaggcagtgagtcactcatcctgaccgcctgttctgtctgagtcaggaaggaggaaatattttgtaaccatgcacatttctgatagaaaggccaggaggatgtagactctgtccttgttcag

SEQ ID NO: 64420 - DNA, 1183 bp, Homo sapiens
ctctctccagcagctatcggtccacattgggacctctctgcatagcacacacacaccacctgtctctgccactgttagctccaccctccattttcctggtcagatctgcaaaatagagctcagtgaggtggtttcccctacattaggcaaaatagacttggttctccctggccttatcttggccatgggagggtgcatctgtgaaagtcactcccctcagcccctgcatgacttttggcaagaaagaaattgggggaaatggaaaaatgggataagtaagatttagattctcaggagtcagtgagagacaggcagcatattgcctactttgagtcaagtgagggatgggaaatgtaaaatcccattggcccgcaagtttgggtgacttttgtatattgctttatggtttcctttcttgtaacttacacaagtacagcctagcctcagttattcagggaacaattaaaaacccttgctgggaactagccaggttcctttttaccttggccaggtcttcttcccaaatggtaaagggtaaggaaggctggccttacccacggggaagtgggctgctcagagacttcattaaactaaggcttgacaatggtcaagggatttgtttgttcctctgggtctgcccatctcaccaccctgggcagggggtgatgggcttcgtaacttgtgtttgttcccacgttcagtagtacacctctgtcttatcggtggcaaatcttccaagattcatgctgatttttcacattcattttaggcaaatatatacttttaaaattgatgatcctttaacttgaacatctacattttctttaactcaaaggacttaccagcattactagaatcatcaaaaggttttggttttttcctaaaatgaaataggcatagaaatagcgaagtatggcccaagtttttgtccctctcatactatgaccctacctgccactgccaaggacttccacaccatccattataggatgaattttctttcctgagttctgatctcaaacaccatggttaaatctcttttaaattgttcgcctcccagatgacaggccgggaccttctcaaggatcgaagtctgaagcctgtgaagatcgctgagagcgacactgacgtgagtgagcagagtgacacgctgacccctcagctgcctcctgacccagacccc

SEQ ID NO: 64421 - DNA, 2419 bp, Homo sapiens
ctgtcctaggtaatgaggacaatgttgccaaaaaggagctataagcatttgggaccatgggtaagacataatcatgtagatgcaccacagttctggtggaacttaaggttgagtgggggtgagatgaatgcatggcacgactctaaactagtatcttacagaatgtgatgagggaggacaaaagaagaagcaagttcccttctatcatgttcctccttgccttctgccgcagaaccaggaaggaaatgaacactgaaattgcactcccacaaaaaccagcctgtgcaaaagtcccttcagacagcatataacattttataaaaaggagagagctgcagtctgggaaggtcccatggcccatgggaggagcatccacggtcccatggaagtagcatcaccaagattcaggcctggttgtttgaattgcatagcacacagcctccttaaagttttccctttgccagttccccaaattctggctgcttcaagtgtcatttgatgtctcacctgttacgttttgttgtatctgcctttttgtttggaacagattaaaaataatgaacctttgatcaacgtgctttacaaagtgctgaagaagtcagcacggggctgtcggcccaggagaagcgtaagatgatctgatccgtgtctccaagcggggtcattccattgcttctggctcggtgccgacttcatcacttgcttaaccagttgctctcctgaccgccccaggcttcccgcaagtcattttggtttattttctttcaactgaagctctcttcagcattttggctgatgcaccaggctgagcctctcatctgcagttttctgtgactccatgttttgtgctgccaagggtgggggagcttgcctggcttgccaccagcttgtgttgtgtttccatcatcacgtgtctgcctccatggcgagggctcacccagacagagttgagcatgagtttcttgggagggaacagcagttattggtcatcttccaagagccagggtatcctcagatgccacggtggccctgagattaaggtggcactttttgggggcaggcagttggtatttggataacagcctggagctggactagaataaaatgccaccccctgcccataccctctttgattgatgcagaagtagggactgcaatgtggccagctctcacagcattccaggggaggatgcagatcgagaagcaggtgttgtgtccaaccatcgtgagccctgagaaagtgggttgggatgtggtggaggggagggaagatgcctgggtggcctttgattcccctctgatggagagactctttcaaatggatgagcacccacagacttttactttttctgatgacagagatgctggggggacccagagttgatgttttaagtgtatttgaacatggctataacaaacacacttttaaaaggaaaattagatgtaatacgctacacgtggatataatatttcttagcagcctcggctgtctggagcagagctacattcagaagcttaacggtcctctgagctgtagaaacagctctcatcaagcccatgctctaaagcctgtgacctttcgtccataggagacagagtcagctcacattactttgatacattcatgaactcactgagcaaacattgcccgaatttcttcaatatgctaggccctggctgggctttgaggatacagaggaaaggcatccatctccacagtcacccctaattaggttactctctagtgaggagagacaaatgagcaaacggaacattgtactctaatgtgctgggtgctgtagtagcagcagatgcaacgtgtggaaagagcaccctgaagggcatcacccccagttaaagggagagaagagatgtaagtacctcgtgtcagtcgagcttatagtcctttgaattcctaacctacaacacctagtaagcagcagttttttttgtttttgtttttgttttttttttttttttttgacatggagtctcgctctgtcacccaggctggagtgcagtggcgcaatctcaactcactgcaacctctgcctcccaggttcaagagattctcctgcctcaacctcccgagtagctgggactacaggtgcgcggcactgtgcctggctaatttttgtatttttagtagagatggggtttcaccatgttggccagactgatcttgaactcctgacctcataattcacccgccttggcctcccaaagtgctgggattacaggtgtgagccaccgtgcctggcaagataagcagcactttaaaaagggacaagagaaatctacttcttagaaaaagaggtagtactaatatcctgagagagagaaaaaaaaggttgaatgtatattcagtattccatgaaggcagcaaagggcatacttttagaaagctttccatcaaaaa

SEQ ID NO: 64422 - DNA, 1223 bp, Homo sapiens
gaccattctgggcatggaaatggagataagcacagcccctctgggaccagctgcttatgagaggtcccccctggttccttggaggggggtgaggtaaggatataagcctctctggagaggagtctccctgcttggcatctgatctgctgacctctcccctccatgtgccacgttgacttggtgtcccccatgtccctgttcgagaggccaaggacttaaggatccagagcccatcttcccctgccccccaatcagctgatgctcagcttccagaatcaggggtgcttgtgggcccacgttgagaagctttaccttcctgaagtgagcgttcctgctggggtgccaagtaatcatacaacgggacactctgctcttgggacccacttacattagtgtgcttttttggaaatgtttactttgctggcattttacttgatggtgccagggtgaaaaggactcacattgattaagcatctgttcctgccttggcagtatttgggcacttgatgttcatttatctcattgaatcctctcagcaacttgagcaatatgaattattatcccttttttataaccaggaacccaggtgtcagagaaataaagtaacttctgcaaagttacactgctgggacatgtacgcagcaactgacttcacacctgccttctttcgtccatgcatcacacgctttgcccactctaaagtcgtgttcgttgaattgtattcttggcattgaagttctgctcttcagaaccctataccttagctgagtcagaagggtggggtgtggggttcactgttgttgacactttaagttgtctttatgctgcggtgaagcacagccaggaagatgagggtacctgctgtcactcgtggagcctttgtagatagaaaaggttgcagtcagccccaaaaaggcttttgtcttcagtgagggatgtgccgtcagtggcttcggggttactggaatctggactcttcctgactgtttgaacctgagatcaggacttttctgttcaggctgtttccaaaatcagcttctgggacagtttttaaagttgtaattggggatgccgcatacttcagaatcacctgggagcttgataaaagcacagacctggagggttctattgaattggacactctgctgcccagaattctgcatttttgtcaagctctggggtgattcttgtgcacactagggtttgaggtctattgttctgga

SEQ ID NO: 64423 - DNA, 1053 bp, Homo sapiens
tagtcagctgtgggtctgaaaaggtgggtgaggggccatgggacactcaggtgactgccacgaggggtggcgtgcctccctacagtctccagtgtacctggcttgggatatttttaacttggggatcttcatccagcctcatagaagcaggtgtatgaacatcaggtcctaaggaagaagatggaaagggggtctccccacaatgaaaggagatcagggcttttgattagaaatcaaccagtgcaattctgtgtctgttgaacacttgctgtgttacccagatgacatggggagatgcagaaaaaaatttgagtctgtctggtcttgagatacttccagatagtcttgggttggtgaaagaaattatccccaaataacagactcctctacaatgactagacaaagatctgtttggcctggttctcagagctgagatggtgagaatctctgtgggttacaacactggagaggcttctgggaggaggtggcatgtgtttgaagctttgaagagccaggggtgctggggctggttgagatttaaagggaaggatcagtgagagccaaggagagccagggcacagtggttgtggccagggcagcagaggggaggtggcactaggtcatgcaggctgttgactctatcctaggctttaggaaggaaggtggatgctatgagcaaaaagacctggctttagcatgtgaggagaacaaggagctttctctcaaggccaggactgtctaactcacttgacagtcaggtcacacagagcttgagtgactgctctaagtatggtggtaattcctcaggattcaaaatgctcaagcatagctgtatggaccaaatgtggcagcccagcccatcctcctgcagcctgtggggacagacagggttgttcccaccatgcctatggagagagatccagcagcccccagcctccacctgccctgcgcagcaccatatccccgttcctcagcctccctgacagccagtcagcagctgcctgcatagttcttgtcacccctgacccagggcccaacagtccactcagacat

SEQ ID NO: 64424 - DNA, 1020 bp, Homo sapiens
gtgacaaagcaagactgtctcaaagcagaagaaaaaaaaagcttgagtctgggtgaggttgcactgttggttgttgctttcctgaaaaaaacttcctgaagcccttttactgccagtgcctttatttgtcctaatgacagaattgacacagtaattgcttaacggtgtcacatcagtgctgtcctggcactgacaccggggtgaagagcgtaattctagcagtgtgctcctgcggtgctaacttccttgtgctgtgtctacacatctgcagctggaggagctctcgttgcttctcacccggttaaggcggcaccaggccaagttggccagtgtgcgaaatttcgccatcagccagttactgcagcaccagctgacctttcccacctgccaggtcagcactggtgggctcctctcagggccgggggcagggagtgacatgctggctcgcgttcgctcgtgcccatgctctggtctgtctgtgctttctggctctcgcgtgttcgctgcctgtttgcttctggatgctactgccagacactctgtggtggtggaagctgagcctacccttctggcactggggaggggggctgcatgtggtgtaggggccctaaactgtcgcttctctggctgtaagtagtgactgccaggctggtgtatggtcatgttcaaagggctgtgctggctgacagccttgttgcccccgtggccactgcttgggatgtggaaaggcacatatgcgtcagcctggagggagatgcagggcgccctctcttatctggatggtgccctgctgcctcacagagtgtcttctcatctcatatcttgctgaacctcacagtaagctggaagaggttaggtaggagaggagtaaggatcacacacaaggcaagtggaaccagaaggggaagtgacttgctcaggatccctcagctagaagcatgcaggctgcagccaaaatccaaggcctgcatgacacaatgttctaaactgttgcaagaacgttgggctttgcaggcaagc

SEQ ID NO: 64425 - DNA, 1051 bp, Homo sapiens
taataatagatgccaggcacagttcccaagggcttcgctttaaattctcaccacaaccctgtgaggtaggtgctatgtttatgcccatttcaaagatgagaactctgaggcgctgagagacaaagtaacttgcacagggtcacacaactacaagtcagcttccttgcatcttgaaaggcaggaaaagacatctgtgtccagtcagttaaattataacaatccagcttaagttttcactttccaagaggctttcacagtttagtgttctaaccctgagagtaagatgtgtgtgctcatttcatagatgagaagtctggggctcagaggggacatggcatggggcggcttccctgggagtgagtggcagaggtttgggctccagtgtgacttcttgtctccccacttgcagaactcatctcatgtggaccgacgctccatgccctccatgggttacatgacccacaccgtcagcgctcccagtttacatggaaaatcggtagggtgaatgacaagacatagcctgcaaagccctatctcatcaacattttccttcctctgagttagtacaatgcagtccagagggcagctattaacccccatattagagatgaggaaactgaggctcagagaagttgaatgacttgcttagggtcacctggctgtcactgggtccccagtgaaggggaagagcgtatcagggaaatgtaggggaatattaggcttatctcctctttcaagatgaattttgccagaaacatttttcagctacccacctttttccacaggcagtgcctctcctttcttccctgatctttgattagttaactagttaactcaatcttcaaagctcgagtctgagaccaggtgtggttgttcatacttgtaatcctaccactttgggaggccgaggtgggtggatcatttgaggccaggagttcaagaccagcctagcaaacatggcgaaaccccgtctctactaaaaatacaaaaactatctgggtgtggtggtacactcctgtgatcccagctattcggaaggctgagatacgag

SEQ ID NO: 64426 - DNA, 1026 bp, Homo sapiens
cctgtctttcaagaatttttcaccttggcctgggaaaacatgtcttggaagtatgaaaagatcacatcaatataggaccttggaaaagttacaggcagtgtgatgacgaggtcaaacagagttggatcactgagggctgtggcactacagaaggtccacgtgggggaaggcatgagccagcatcctagagaatgagtaagacttgggtaaatagagcaaggggagaccatccaggcagggggagggaagaacagtgttataagagtaagaagggcaggaagggtacacacgttagtgaaggaccttctgtgtatcagatgtgggggttgcatttcctaacctgtctcattgattcctcagaagagccttatgaggcaggtaatactatcctcctgttacaagtaaggaaacggaaggtcagagcagtcaggtgagctgcctagggtcacaaagccagcaagtgtcaagcttggcttcaaacccaggttagactcctttttcctttttccgttgcaagatgttgctaaggtgtggaggaggctgggacgggactagggtgaggctgtcaggcaccagcaggtgtaggggtgaccctgagatggagtacttccttcagttttgggccctaggcatttggcgtggcccgtaggaagagcagtgagaaaacagcaggcctgcaaggtgggtgttgaggtcagctgctagcgagctgtgagtaccaggctgaggagtttagactttatttcagaagggacaaggagccatggaagtttttgcagcaaggaactgatatgatcagagcacttgactgtggacaaagtggaaacccattaggagcatctcagagttgtctggagggagataattaatcagtatctggactagaagagtccagaaaaaagagaactgatgccaaccacttcctttatgaacctctggaacttggtgctaaggataccaggcagagagaaaatcttggtaacttggagaattgtgaggcctttcctataaatatgcatagccatt

SEQ ID NO: 64427 - DNA, 1060 bp, Homo sapiens
tccaggggatattttccaagaatttctgctgattttcagtaagacatgcacaggttccttcttatcctgtttttttgtttgtttgtttgtttttgaggcagagtctcacactgtcacccaggctggagtgcaatggttcaatctcaactcattgcaacctccacctcctgggtccaagcaattttcatgcctcagcctcccgagtagctgagattacaggcatgtgccaccatgcccagctattttttttatttttagtagagatggggtttcaacatgttgcccaggctggtcttgaactaacttcaggtgatctacccgccttggcttcccaaagtgctgggattacaggtgtgagcccctgtgcctggccttattctgttcttattggcacatttccaccttgcttaaaatagaaggaatccttcctgtgatagtgaatgatagctgatacatgcaaaggaaggatatcaggtttgcttcagccactatagggatccttggctgcaggccaagtttgcctagactcccttggcactgagccagatggactcagatatgtaaatgtcagaagcaggcccatatttactatgcattttggatctggattttaagagggcagggaggagaagtaaatgctgaaggttcatttgagaggttttcatctatgaccattagtgattccagaagcatgtcattgtctagtttttcattggttctcattttgttttctctgcctggtccttgcatggggtctgcctttcatgctggattcagagtattgaaccagttatctgtgtaatcaccctcacttctggatagaacctgggagcaatatacagagaagcctggacttggagtcagacctgggctctaactcttcgttctttcaacaaatgtttattgagcatctactatgtgctaggcactcttcctggggatatagtagtgaacaaaatagcaaagttcccactctcgtgtagcttacatttatagaggaaggagacagatgataagcaggtaataaacaaatgtgtaaaataaatagcatcaggtaatg

SEQ ID NO: 64428 - DNA, 1920 bp, Homo sapiens
aacacaacagcagaatacatcctatatggcacagaactgagcatagtctaatgaaaactttgcctcacttaattcattaggtaacttaaactcttttcaatagttcagtgtaaattcagttttccagtcagcataaatgaaggtattttatagcatagccacctaaataagaaacaaacaaacaaaaactttttgttaagaactgattcctttcttaatttactttctagaagaaagtgacttataatattatatattaatttgcttctaggagacaaaaataaaaaccctgctttcttaggataaaccatcatttaatccaagttctaatgtcctattcaaagaatggctgttcagtaaaatggtaatttattaaaacaaagagtgaatatgggcaaatatttggttctggaatcaggttgtgcatgcttggaaagggacaacagtatgctcagatattaccctgactagttttctttgctttgcaggacagttctgggatgaggctgtggaaaaggaggtggtttgtgcttgctgattactgcttattttactataaaggtgagctaacaagtagcctattaccctgccgaagtgttcagttttacatatgtggatggttggtgacttcaggtttaccagtcctaacacaggaagttcaatctgttgggttaaaataaatagaatccagtttgcctgctactaagggtctcaggattcagagtcatttccgtttctgtcccatttgggacataggtccacctttgaggtactctggagaggtgagaagtgtggatcattgattgtgttttgtaacctgtcatctggatttattgaatgttggatgagcaactggtgaattgaattggccatctgagcttctgtggagccccagaacataaagttagggactatgtgttgttaagagggagtctcaaaatgtggagaaagagcttacttttaagataaggctagactgctactggtgctttcaaagcagttcagggggcctgagaagtgaattccatcattggagaatctgaggaggcttcttagaaggagagaagagataggcttttaagaatgggtagagctggctgggcactgtggctcacacctgtaatcccaacactttgggaggccgaggcaggtggatcacctgaggtcaggcattcgagaccagcctagctaacatggtgaaaccctgactccactaaaaatacaaaaattagccaggcatggtggcgcatgcctgtaatcccagctactcaggaggctaaggcaggagaatcgcttgaatctgggaggcagaggttgcagtgagccgagatcatgctcttgactccagcttgggcaacaagagcgaaactccgtctcaaaaaaaaaataaataaataaaaagaatgggtagagctttgcctgtgtgtgggttgtgggaggatggacattacaaggggaggaaacaacttggctgaagttctggaagcagtgggacagatgagcccagggaaactgcccagaaggttgttctgatgcatttttccattcaaagacagccgagaagaagcggtcctcgggagcatccccttgcccagctacgtgatctctcctgtggcccctgaggatcgcataagccgcaaatattcctttaaggtactgcccctgcacctctaatgcagccattctgtctaagaaactgtgttctcaaaatgtcttcataaaagcagttgcttttgtcgggagggggaagaagctagagagtttcagattccggttaacaaagttgtaagttatttaaacaagaataatatcacatgaccggtactgtcatttgactctaagctttggagtcgcccagccatgttcaagtattcagacccctccttcctgtcactgccagtcttgtggttacctgtcgaa

SEQ ID NO: 64429 - DNA, 1010 bp, Homo sapiens
cgtttgttcttatgagtggactgtctgctcaatggttacagcttctctcccaaaacccacttgaccactttggcccctggtgctattggctgtcctggggcccaggccgcagtgtgggtgggtcagcttgaatccagccttcctaccagttctctaccagcacttgccttcctggtgtcaaagagtctttgttattatttggctgaaaattttcatcttttcctctcccccttgtctagcatgcatatccacctaacgtctcaaattccaaatcagccaaactcagctcattatctcctcaccaccttggcctgccatttccccaagactgctttttccggatcttagtaatggtaccaccattctcccaggcactcaggttagaaacctcagcactatcaccagattctccttccccgacatgcattcagtcagaaagccctgtcagctctgtcggctgaggccattcttcattggaatccccactgccagttgacctgcctggggttctctgttcatggctgggttgtgagttcccagagctagagaccctgtctcttttgctctccttctctccttgccagtcattcattcattcatccattctgcaaagtgcctgccatgtcctaagttgctaagagcaagtatcaagagaaagtaacgtggttcctgccctcgaggaactcatcagctaccaggagaagcagatagcatatctctcacttgtcacattgtcacccagccctgtctctcacctagcatagcatctaaaaatatcagagcagcaatgtaagttttggtgaagctttgtgggaagacagaggagggcattacattgaacagcacacaggagaaatcccaaaagtccccttaaaatcttcttctgcagctctggccccatggcagctgcaacagctcccggcctcttctgttggacactcctggtaccaccgtctcttgtgcccacttgcccctcacagccctgtcgtccctctcttttcttacatttg

SEQ ID NO: 64430 - DNA, 1058 bp, Homo sapiens
aagcaagacagaaaccaaagaccgtccagcatggtcagtgaaacatccacggctgggaccgcctccaccctggaggccaagcctggacccaaggtgagctcctggccacttgttccttccttcccttcttttatattttgccaagcccctttgtaaccagaagtccatttgatcttcactatagttttgtgagagagacccataagaagtgttctccccaaatgacagatcaggaaactgaggccaagagggatatgtcccttgtccagcagaacaggtgattgctgacagacccagcactggtgtctataggtccttgagcatgttcttcactttcctcgcatggttgggagggccacgtttctatttacatgtagctgtgtgttaaagcaagcctggagagatttggtgacatgaggccctgagaaagggtgcccttgggaaggacccagaagtttctgtgctccaggtgtagaaacactaaggatcagggtaaagaaccagcattgaggagaggaggagagtgctgagggttgaacccagataggaggggtaaatatctggaaattggcaaaaagctgtgaccaaaaattagctttgctccagaaagccatggaacatattacagccaacagctgctgctgaaagttgattgaaaaattccttttaattttttttttcagtgacccagctgggaggtttgccaggtcttgggcttgccttttaattagaatgctgtggccatgtgcacgcccgttccctgtcttctggctgttcatttgatcaaagggtgctgccatttagagtgaggcagagagagccgacggtcctcctaacatacaagtgcttttttgtgtcaccttaaattccctgttgctaaagttcagtctgctttttcatagatcataaagtccagcagtaaagtccacagctttgggaagagagaccaggccattcggaggaaccccaatgttcccgtggtggtgaggggctggctgcacaagcaggtgaggaagccgaggagtgagaatcctggaggaaatggctctggctgagtt

SEQ ID NO: 64431 - DNA, 4064 bp, Homo sapiens
tgccatgattcaattaccttccactgggtccctcccatgacatgtgggagttatggcagctacaaattcaagatgaaatttgggtgggaacacagccaaactgtatcagacagtttatagcatcccttgtttcaagatctagaatttcctctttaacattaaatgaagtattttacctcctagaataagagttgggagcttttaaaataaataatattaatagtattgctagtattattattatttttatagctaacacttagcacccttactattagcaggtacttttctaagtgctttacatatatttaattttcacagcaatcctgtgaggaagataccattattatcatgaatactaaggcacagagaggttaagagtcttgccaaaggtcacacagagagtaagtggtggagtcaggatttgaatccagatagtctggtcctagatgccatgcttctaaacactatgctatactgcttctcatttcagaggtcttctggggacaatcttcttccttgtccatactcagtgcgctgagtgagtaggctactgctgcagagagattgtaattgtatttgtagcaatgaaatttcatctgtaataactttgcacttgtttgaaagatgccaagcctcctcagtagtcttttctccagaaaatgttctcaaaccttttatcttggggcctaatttccagttattggatcattttgctcccttctaagcctctttcctgattctcagtgactttcttgaattgtgagcttgaagccagaccctttctggctaaaagagccacatgcagggcccctcctaaaggggtagtccttgacacagaacttccaggactgtggttttgatgtttggtgcccgtgtacaggagtgttttctcctcagtgctgggctgcccagggagccactgacgaatgcctctgcagctctcggggaagaggagagaagcgttcccgagcagtgacgctagcatttgactgacagcaggctgtgtacaccgatccccaggctctgccaagcatttgatgttgaggtggggcctaaggttgagagaagacagtatgcgcttaggaagttcaggggcccgcttgtgtgctgagacgccagctgcaaggcatgcaagatcactttggaggctccaaacctggagggtgcccttgcttgacctgcctttcccagcatcccagtgagtttagcttgttgtttccattggggtctgagcagccttcagttttctcattggattatttggaaaagaaacacaagttggaatttcctggaatgttgtgagcggtgtttggaggatagcacttaaagaagatactgtctttccaaaggtaagaattatcttccagatctttgacctctttgctaaaggcggttcattttgcaggttgcagggtgagactcatctatggcatgtgctgattatgggttcgggggcggggtatcacttgctgctaggagatggctgtctcctattccttctgcagctacaagttggtaaagctggcgtgagatttagagcactggagaggggagttgctcctaaactcccacaggagtctgtcctgttgctcatctgctgagccctgggctgtgaggctgatgctttgctgtctgcagctgacatagccagcaccttgtctctagatgctggcagtcttgggctagctttgcctgttgtatttggttgccatggtagcagaaaaatgaggaaaaatggaaacacctggcaagcagatgcagaaacttgactgttcagttttcttccctggactaggagacagtgtctatgatagtcgcacgtaggggaagagatggtgatggggtctttagttcattcaaacacctgggtgttggctgggcctttggtattgctgttttgaagggcatcagcactggggatgcagtcattgccacacagcaaccatgtctttggctctgtctttggctctgtctgtgctgggcaaaaatgctgcagtggtggctttgctgtgtgaggaagggaagctgcttcctgtaagtagtaattttgtttcttcctgtgacttcccttcttgtcctcttcttttacctcctgctagtcttggatgtgctcagatctccagtaaaaaatatcattatgtaatgagagaagtagctgcttgttaagctaggaggagcagataggctagaagagggctcaccaaaggcactggttagaagagactggtccagggtcatacaacagaaaaggacttgtgccaggttcggggcaatactccgatttggggaacaggcatggggaggtggggatggcggcacacagtgcttatgggttattttcatgccaagtgagaggctgctgtttgggctggtttctagctcctggggtagagtggggtgaggaactgcagcctgtgttcaagaaaggacttgagggggaaggagaaggaacacaataagccatagttgagtagtgagaccacagttgctgaatgaaaacccgtgtcagacagcctcccccaggctgttgggagtttacagtgagcgttggcggtctgtctgtgtgtgtctctttctctgagaagagggggtgtggagggaggtgtctgcctgtttgggataagagctttcttttgtttcctagttttcattgtgcattgctttccccaaacccttagctgatgggtgtaagctactaaaaaaaaggtgctggtgtttgtgaatgtgtcctcttctcatttacttttcctctataccagtagttttagccgagctctctgtgtgtagattccttgaggacagagcatgactttgggggccagctttcccaggaattaatgggataaaggtgtcatttaataaggtgttctcagtaaaagatttgtgtttccttatagctttctaacctcccatcatagtgttgatgacttatttatttaatgaatgagagcaagccttgctctgtgccaaggctggagtgaagtgacgtgatctcggctcactacagcctctgcctcccaggttcaagcagttcttgtgcctcagcctccctagtaggtgggactacaggcgtgcaccaccactctcggctaatttttgtatttttcatagagacggggtctcattatgttgcccaggtcttgagctccttagctcaagcgatccgcttgccttggcctgagattactggtgtaagccactgcgcctagctgattttttttttttttttaattttaatagagacagagtctcaagaccagactggtcttgaactcctggcctcagatgatcctcctgcctcagcctcccaaagtgctaggtttatagttatggagcctctgttcctagcccttgatgattcttgacattactgttctcctggggaaagaatgggaactcagtcctccagacacagaattactgtgctttaaacaatttatttttataagatgctattgggatgtttgtaggagatgactgttgtttagaagttaattgtttggcaccttgagctttctggagacatatgccttggaaataaagtgtagctgggatttaaattctggggtcttcactggtaacagttccaaataatgctttgtatgtcatgggtgctttatggttttcagtgtcatttcaatccacacaactgctttgtgagatgagaggtggtttccacttaatttgcaaaactggacaccaaggtccagagaactgatgtgacttgtggaggagtcagtaagctgcaggacttggctgagatccagttattctgggctcttgctctttccaccaccacaagatttccttgacctgggggttggtcttagggctgaaaagagcaaaagcctgcttctctcagaccttgggacctgccatagggtctttctgtggcaaagcccaggttttggagtccaatttctatctcgaataagttatttgtctctgtgagccttagtttcctcctctataaatagagataccaaaactgacttggcagggttaagtgagataatgcaggccaagtgcctggcatgcatgcagtaggtgctcaacaagta

SEQ ID NO: 64432 - DNA, 1008 bp, Homo sapiens
ttgggaggctgaggtgggcggatcacctgaggtcaggagtttaagaccagcctggccaacatggtgaaaccctgcctctactaaaaatacaaaagttagtcaaatgtggtggcaggtgcctataatcccagctacttgggaggctaaggcaggagaatcacttgaaccctggaggcagaggttgcagtgagccgagatcacgccattgcactccagcctgggcgacagagcgacactccatctcaaaagaaaaaaggaaaagctgggtgtaaataaagcctaacccttgaacgtggtgcaaggatttttaaaacatgtgttaagaatgcctgcttctgcttcttgtccttatcttagatgctcagacttaactctgcttttttgggaagactagtctgctgtctgccaaatgaggtcatagaattccacgggcttgcctgggaccaggagcagggaattcagaggctggctatggttgggaagggtgacagtatggtgaggtggtacacagttgcaggactaaggaacagcctggcctcatggctggcttcacatttggcttgttagggttcaggctgctctaaccttcagtgcccagtttaccccagacacctggacatcagaggttctgaccaggcattagggcagagtaaaaaaagactttgtaggcctagagagtttttcttttataacctttgtgctatgctgatttagacatagtaatctctagggaggcttagtctcaatttggagatggggctaatattttaacaataccaactgagatgatctattgattatgaaagcattttaactctctgtactaggaaccttaaaaaatgaccatgctctttgattcagtaattttacctttgagactttaacccaaggaaaaatttgaattggaaaattcaaattacattgaaagagatatagattataatagtgggggggaggcacctaaaatatctagcattagaagagtataaatctttctagaatgtaaat

SEQ ID NO: 64433 - DNA, 1046 bp, Homo sapiens
agccattactctggttcatctcttttctcaatgtatgagtctttttgaaaaaaaaaaaaaatttagtattctagtaacatcccataacctggaacctcagtttccttatgtttaacatggggataaaaatatctgccctgcttacatcattgggtagtttggaggggcaaataagatgatgaatgtaagcatagttaaagctgcttagttaaagctccttgtaaattgcagtagttggtggtggtgatgatgctgtgactgacaactcttttggcaaagaaggcagcatccatattagggaaaaaagtttgaagaactgtctctaggtctgatcaaatgacagctattttgtgttggctttttaaaaattacctttcttctaatgttagaatgtaaaattcatcttagtgcctaaactctgcagctcaagattcatttacttagaaccctgggtttatttaagctggtacaggttgggacggggagcccaggagttgctattaagattgtgcagtgtatatgaagtggtggtcactggctgctggatctgccccaggcacatagaagatttgctctttaacctcatctgccagagatccatcagctgatcttatggtagaactgaaggctgtttggggactactgagtgccacacaagtgctgtcactcagaactttggccctggacaaaagaggaaagggggagataaagaatgagagggagtggcagctgggctgtgcttctgatgccttgtgtctttagggctttctcatcatggccaggaagctgccccaattcagactcctaagagaaagggaaagcaggttatcatacagagaacatataatttagaaatagaagacctggagtcatgttccagtcttatcacttttttgtttgtttgtttttgggacagagcctcactctgtcacctaggttggagtgcagtggtgcaatcatggctcactgcagccttgactcctgggctcgggtgatcctcccaactcagcctcccaagtagctgggactacaggtgcgtgacagca

SEQ ID NO: 64434 - DNA, 1021 bp, Homo sapiens
tgccagaacttcttgccatgccaaaaaaaattgctgtgccaagtaattggaacctttatgtttaaccaacaggagtcactgctcatattacaatcaaaatacatacgaatagaaaattaatatggaaaaatgctgcaagaaaccataggatgcatttacattttgactagccttgtctgtcattgtaggttgactgtcttacattgaacttaaatcagtctccagttctctatggtcctcactttattctcttatcaagtcttttgtatttgctgtcagacttctttagggcttaacccaagtacttcctggcccagggcttgtgaagacatgcttatttatgtggatggttacccacagcctgctttcacgggaatcatccttccctgccatcttctgtccatgttccctggtcctttcctaagtgagactggctgccattcaacttcaaggggctgcttctgggaggaagagcgggatttgaaaatggaggctagcttgtgtttacctcatttgccaaattactttctcagtagcctgaagagaaacagaagcccttgtgtggaacagagagagtttttgttctcccctgaaaccagccacttggctctcagccgggccatctctatactaccatagagcaaggtagcaattcaggtctaagaacaggtatttcaggggatgtgtctgtgcctgctaaatacttcttgagacacagtgataggacatgagactcttcatgggtgttagaatcaggaaatggagctgactgagggcttttgtggcgggggagccagggacagcgagtaaagccagaggactttgcaatctccaaatgggtttggggagccagcgtttaataggcagcctttgtttggcaaggatgagcctggagtagtggaaagagatcaaaagggtggtggtgtgcggggaacacaggagctgactgaggttataggtaaatcaccgttctttagggaccttactttcttcatttggagcctggtgtggtgatacctaa

SEQ ID NO: 64435 - DNA, 1941 bp, Homo sapiens
cctggttgattacctctagccactgctccccttggccacagtggggcagtgactcagagctggaactgtgttcctgcctggttgccagattttgtgtggggggtggagaggaacgagaatgaatgagcaggaacaagtggctgctggatttgtaacaccttgggaggcagctgctcaagaaccgaaattgagagacagcaggcaggctgggagtctccctccctgtctgacctgaacctaagatttaataaggtggtgcagctggggaagacactatccgaacgtggagcccaaagggagggtgagtgtgtcccctgccttttccggtaagaacaagaaagcaggttagtcctgtactggtttcatagggattcagtttgctgtggtatattctgattcatgaaagtcaagtaatgactgagagaaagggagttttcgatggttgggagcacctacagttaaataaaaacaaccaccatccaatgtaattgggcataaataagacataagtatcattaactacacctccctgatgttattacagagtattttgttggcaagtgaggttggggaggacaactggtctgcctctgtctctgtgtttgcagttgtgtgtagtgttgttacatttcagtctgtagctctgtggatgacagtctgagatgaaccgcagcatcttaaaatgctacagctggagggaacatcctggaaacatctcctgctccagccttctcattttacagttggggaaactgacttatttaagtgtactaaatggaagcataaaactgggtgttctaagattaaaaatgtttcacaggacaggtttgaaaacttctatagaatgcggcttttctcgggccgcagtttctgaacctgtcggggatggaagtgtggctggtggaaggtgcctcttgatcttaaaccactttgcctgccaggtgagttctttaaatagaaatttaaacaggaggctgggtgctgtgccttaactcaaagggaagaaaagaaagcgtgttcttgagcctctgtcctagagcaggctgaacatgctggagtctgcaatgtggaaaaaggcaaaacaactctattggagtgcagttttagagttagcagaagataaatatagcaggcactgaaggttgaagtgtctactgtgggctgggatgttatcagtgttctttataacaacaatgcagagtcggaattaatcttttctttacagataaactcagaaaagccactaactcgctcaaggtcatgcactaccagtgtgtggcagagctgggatttgaattccagtttgtgtggctctgatctgcctgggcttcctgcaggcctgtgtggcctttctagatggagaacctacctgcaccccccattttacagatgaggaaactgaggcccagggaggttgagtagttgcctgggctgtagagctagctggtagtgacaaagctggtactcagctcctgtcacattgcccctctgccaacttccttaaaaaagaaaattaggaaagggctctctgagtttgatttgctcattctatcagaatcttggctttaatgttctcatggctgctgggatcctgtgaaatcaaaattaaaactttctattcaccaagtagcaaccccaagtcatggggctccatgtgggaactcaggggccagacagtcttgcggtgttggtgactcagtcagaagagtactttgcaaaatgaattggccattgagtggatctgcagaactctggagaacttaagagaacctaatgaaatgtagaggtttgcaaatcatgccagaagactgttaaatctagagcttggaaaagacggacttccctctttgcaagttgtgagggctttaagtttgctcagttaattttgtgactccctcatgcccagctctgcctgtgccaggctctgttccctttggcaca

SEQ ID NO: 64436 - DNA, 1054 bp, Homo sapiens
agtccagcttcgactcggcatcggagggagaccgtggaaagagagggagagggagaccgtggggagagggagaggcagaccgtggggagagggagaggcagaccgtggggagagggagagggagaccgtggggagagggagagggagagggagaggttgaggtttatatttttagtagagatggggttttgccatattgcccatgctggtcttgaactcctgggcttaagcaatctaaaattctttcttctgcttggcctagcctattgttgaagctctttgactgtattttgtgattccttcaatgaaattttcatttccagaagttctgtctgatttttaaaaataatattgctcttctttcatatcctgaattgtttttctgatttgtgttgtttttcaattttctcaacttggcttaataaactgataaactgagaagttatagctcctaagacaggttatcatttgctaatctgaatcagaaaaactgttattttgttcatcttttggcaggatatatagaaactaagctgttacacacccttaacgcccctaatccctcttattgattacttgcctttcatgtgtaagacactaggggattggcatctagttggctctcaaatatttgttaaatgaatgaagaaatacactgttgtcacatgttattgttgggggcaagtaaatcaatatcattctggtctgaccatgtagtaattgtgggctttttttttttttttttttgagacagagtctcgctgtgtcacccaggctggagtgcagtggcgtgatctccactcactgcaacctccgcctcctgggttcaagcaattctcctgcctcagcctcctgagtagatgagattacaggtgcctgctaccatgccctgctaatttttgtatttttagtagagatggggtttcaccatgttggccaggctggtcttgaactcctgacctcaggtgatccacttgcctcagcctcccaaagtgctgggattacaggcatgagccactgcgcccagcaattgtgtgccttttaagatttcttt

SEQ ID NO: 64437 - DNA, 1041 bp, Homo sapiens
gtccatgcctgattgctgggacttctagacacaaatgaggagggccagtgatttattttcagaggatggaggcccctaataagatagcttcttatattaaacccttaccctgtactggagttttcttcttgccttagaaatgtaaggaatcggtttggccgtgttgtcttcatggggaatagttcaacctttgactccacctctggagtcaaaaagcctggatttgaatcctggctctgttcctactagctgtgtaaacttatataaatcccttaatttttctgatcctcagtttcttcatctgtaaaatggaaataataataactacctcctaggatggtaatacgatatgagataatgcctgcagagtgcctggagtgtaatatgttatgatgtgatttgtatataatatgctcactgaagttatcattatggatctctctcttttaccttgtgtggttctttatctactcccctcccctgcccccagttttggatatctgcaggagaagtctcgtgcactgggatggcgggctctctgttagggttatggggagtcagtaggttttctgtggggagaaggggccccaacaagaacatgtacccttaccattcaccttcttcattttgggcactatttaggagatattttacaaagcttacactacgagtgtggagctatgattggaacctagttcaggctccaaagccacactctttccactgactatttgatacctctctcctgctcaccctgccatcttgccttgcatcctgcaaaaccaaaaagaaaaagaaagaataaaaccagaaacatctgctgggatattccatttgggcacagtggtgtgctcactggaaactccaggtacgtgggatcctgtgggtcaggagccttcttcctgctctgttcctctaactgggactcccttcctgaatgggcatcattaggaaattgaagaggaaactggtttgggtggagaatttccgaaatcatcccattttgccctttcctagaagtgagatagtgagagcccctcc

SEQ ID NO: 64438 - DNA, 1132 bp, Homo sapiens
taggactgtgagaaggtagaggagccaacacatgccagaaacacttcctaggaagtgtggacaaggccttcttaattctttcagggcaaaataaggaagaataataatacttgctgctattattagtagctcactatggactgggcagagtgctaacttgttacattcagccttgcttcttcttgaaatgctccaaagtaggcactattacttctgtcctccagataaggaaactaaatctcagagaggttaagtaactaactcaaagtcacacaggattacaaagcaggtattcaagtccagatctgctcctttccaaaggccactgaacactcaaatctaatcttgggctgtctcagtttattgaaaatactttatgaaaatataccagaccttttgaattttatgactgaaagaaaaatgactaaaatcctgttctcaatcatagtcagaaaattgaattggaatgtttccctagtttcataatgtttgataaaagatccagacagatctgaatttatgagatctataaaaattcgagttgttgaaagagtgggagaatgtgggctttggggatgccgggatggatcatgtgacttcatggaaagcagcaaaaatatttttgaattctgaaagtgttcctggtcatgtatttctgggtaacgttttgtggatgtttttcttccatcagtcagaaaaaaaaaggaatggccttaattaaaatttctattgtctttgccatagaggaaggaagccttttggtggttgtcatggtgatatctgaatgacactgtggaagtgggtagtgattgccacccagagccctgaaatgagcgtttgtcattttccttgtcccctgagaggcttgcagcaccgaactgcacatttccttaatcgccttttacattcacatttgagccaaatgtgtgtgtgcaggcaaatgctctccgctgcagctagttagagtcataaagtctgaaaccttatttctaattgctttgtgttcctgaagcaaaatggcatatgtgaggtgttcatgaaaactctcagaaagtaattaggaactaccagcctttcacgtggcacagcgggatagcttgcaggcctcctccccctcactgcctaatacacc

SEQ ID NO: 64439 - DNA, 1057 bp, Homo sapiens
tttatgaagcctaaattggcttgttccagctctgttgtactgatttctgtggaggtgattaccgtaaaccccacctgcctgctcctcttctccagccaaatttgaagcatttgatgtccctgtgttagtctgctagggctggcgttacaaaataacacaggctgggtagcattaatgatagaagtttattttcttggctgggcgcggtggctcatgcctgtaatcccagcacttcgggaggctgagccgggtggatcacctgaggtcaggagtttgagaccattctggccaacgtggtgaaacaccatctctactaaaaatacaaaaattacctgggcatggtggcacatgcctgtaatcccagctacttgggaggctgaggcaggagaatcgcttgaaccccagaagcagaggtttcagtgagccgagtttgcgccactgcactccagcctgggctacagagcaagactctgtcttgaaaaaaaaaaagaaaaaaaaattattttctcagtctgggagctcgaaacctgagatcaaggggtcggcaggtttggttccttctgagacttctctctttggcttgaaggctgccaccttctcactgtatcctcacatagtcatctctgtgtccaatttccccctcttatgagaacaccagtcatattggatgaggatccactctaaatacctcattttaacttttttttttttccaattttcttttttttttttttattgatcattcttgggtgtttctcgcagagggggatttggcagggtcacaggacagtagtggagggaaggtcagcagataagtgaacaaaggtctctggttttcctaggcagaggaccctgcggccctctgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagagcacagggttgggggtaaggtcacagatcaacaggatcccaagg

SEQ ID NO: 64440 - DNA, 1300 bp, Homo sapiens
tgcttcttattagacttagagcaggtcaacctacttaccaatctgttttcctgtctgtaaaaggagataagaggccagcctgcctcagagatgttgtgagttcagggcaatgttgcctgaaggcaacgtgtctcagacacctctggagagggccttgatagtgaaccccatccccttaagggtcattgaggtgggttggggaattcggccacaggggatcattgaggtgtccacatggggctattatatttgcatctgtgggtagtggtggagatagaaagtgggcaagaaacagcagagtggcctgtctcagggcactgggagtggggtataagtctaggagagagaggtgtggcctgcatcatgttttctccaaagacatgaatgctggaggctgctgaggagaaaaacctttcttgtcttggggtcaagtgacaagcatttagtcccagccctgccacttaaccatctgtgtgatttgaggcaagttggctggagttccgtaacctccattttctcatatgtaaaacagggctaatgattcccatgttgcagagcatgtgaaagcatcctgtccctttcctggtatgcagtggacattgataaatagtggtgaactctagatcactttagtatttcccggggttaatccaataagtcccaattctttgcaggattccacatttctcccttgcctttcagactcacttaggcacattgtagttggatgtgaaggaaggtctggccatagaatgagacccccatgaattattgagggggaagaccctgtgcttcctggaaggagatgctgatcagtgtttttctggtggctgcagtgggtacgcagggccattttggaagcgagaatgtttgtcttgccaagtacgagattgagtgtcaccggtttgctttctgggaataatggctgtgccgatgaaatagatttatggcgctgaggtacgtcacagatgagactgatttttttttcccactttaaatgtcgatgttttctaattattcaaataatgtgcttattttagaatattgggaaagtatcaagaaagaaaaaaatgtctacttctaagtccaggggtgattactgctaacgttttggtaaatttccctttcttcttttttcaaatgcacataagctttttttttaaatatgctttatgcacttacgatatcatgtgtatttcccagatcattacatattccttaagaacatttttatttggtacataacagtctgtggtgcacacatgccataatattcttaatcattccctgttccatagtt

SEQ ID NO: 64441 - DNA, 1010 bp, Homo sapiens
cagctggtcagtatcaacgggctcattgtactgatgtgtatatattgagaaagctcagagaagttgattaacaagctcaaggttacagaggataggttggagagtgaaggttcagatcccagcttgggctgcttcagttgccccttatagccacctgctgccttccacaaggtgagtgagcctaggacctttctcctcctaggtctgactcctgttgggatttgaaggtaccaggctcaagtggaaatgaacgtggttgggttgctaggttgttgctgtagcctgctaatttaaggcttgattttgatagaattttaaagaatgtgcagtatttatcaaatctgactcatgctattcagtgacagaacccttatcctgcttctgtccgtgttgtgatgacgccatgtgaattgtgagccccaggaagatgtagattgtgaatgactcttgagattgagtcatctatccatactttcagagttcagagaatcaactagtaggcatttacctagagtggagctgtggaggtgagatgtgggctgcttccacgttagctgaagaaacctggagctgtaggttatagagagaagaatgactttcagggccccttgtgggacattttgtctagaacaatgggatccaagctttgggtccctcctaaaccaaccaagaaggttcaacttcttagtgctttaggactacatggagcatggcctcttgcacaaggcaaacagtcactgtgcatctgccatgtggtaagtgctatgatagtggagtgggccagatgatgggctcctccaaaagatgtccatgtgctaatacccagaacctgtgaatatgttaccttatatgggaaaagggactttcggatatgatgaagggaaggactttgggatgggaagatcattctggattatctgggtgggcccatgtaatcagaagggtccttataagatcagagtaagggaaggaaatatgaggagggtagtagaggttggagcattgtgccc

SEQ ID NO: 64442 - DNA, 1370 bp, Homo sapiens
tcacttgcatgggattgtaaccctttttgcactcaccctagctagtagttccttttaagaaagaggttgctagtttgatttgagtttaggcaggggaaatgtttggtctagagatgactgttaggctcagagttttcaaggtcccatctttctttctgacgcatctggtaagctgttttgctctgttccagatgatctgccagtgaacagaggtctgaagttctcaatgtgttagaaaaaaaatgtaaaaggaacaacaacaacaaaaaaacgccctgcgaaaataagggctcccagctggtggtgtttcagacacaggcattgctcattaacggagttatgattacagccccgaattcattctcattacttttgtagcatgtttataagattacaaaaaggctgtcactttgtgggttattttctctttttattacatgaacaacatttatgcaggtgtgacaccaataaagcaatacaggtctggtttggaataaaaagtgagataccacgggtgaggctctaggtgtgcttaagagattctagggctctggttagcaaagaaagagtttccacggcatggagctgtgcactctgctcctgtagcagcctgctggtgtcgtcagagtgggcatagttcctgtcactttactggaacttggagtgacacgtctgaagtcaggtagtcagatatgtaatggcagagactggactccaggtccctgacttttcggactcagaggcaagtggtcttatttgtcctgacaataatttaaataatttttcctattatgtacactttgtgggaaatttagaatattatactacaaagaagatggaggaaattaaggaccaagcaccaaagacaaccactgtccatattttgatggattttgaaaaaccttttctctttgttttgtttgtttagaaatggggacatttgtttttgtcaggggagatttgctatttgcttgttatttatacatctctgggcatatctaatttcctcccttggaacaggcattctttctgtaagctttgattctctacaaattcaggtgaagctctttattttatgtaaagcactgtgctaggcactgtaggggaaagagatgagcaagccattcctctcttcggaatttacaattaagtgggagaggcagatgtgtactcaaccaattagtacaggtagagtagtaataacaaacatttctgatagccagccctttccatgtgctttatacaagttactcacatttaatcccccatcaaccttgtgaaggaggcattgcccattttataattgtagaaactcagaggttagtttgcctaaggtgataaaactagcagccacccaagctgtgatccaa

SEQ ID NO: 64443 - DNA, 1076 bp, Homo sapiens
gaggtacttggttgatggtggttactgagttcctcagtagcagctgtggcagggagcctttacctgggatgggtggcaggagaagctccctaggctaagagaagggtgctctgatggtttgttctgactcaggcaagatcgggaggagaaatagactaaagaccctggcagcacttgcagtcttggtttgcaaaagcacaaagttccaacctagggtttgtactatatctggtgaagggaaaagaagccagtgttccaggcctataccctgtgagtacccaggaatgaggggagagagaatgaggggttaattgaagcagtgtggcaatttctttggaggcttgggctcaaattcagtctctgctacttactagctttgtgtccttcagcttctctgagtctcagtttctttgcctatttgttaagtagggacaaggccactcccccatcctcaggacaattgtgagaattgtatgagatgattgtaaaggatttaatgcagtacttaccaattgatagctattatttttcattaattaaggcagctagagagtccttggatcattagctgagaggtttttttgttttgttttttaaatgtagaaaataagaatgtattttgtgctgctaccagaggccatacctgggctcctaggttcagatgagacaactgtcctagaagggtttcatctgacttccatatcaaacctgtttccagcctccagatattcaaagaggccttggagaaccctgaatctctgacgcaggcatacagcatagctgaactggaaaggtcacctgctcaaactcctgctgaagcagccttctctggtccagccaggattagggaatattagtcctaagagcaactggatacctgtcacattttagctgcgtgactctagacgagtccttttatctctttgagccagtgtcctttgagaataataaaacctgcctcacacagttgttcttatgctcaaacaggacaacgtatgctcaactgtaatgcagcattgcatattattgatagctaactagataccagacagtgatctcagtatgttcatatatta

SEQ ID NO: 64444 - DNA, 3052 bp, Homo sapiens
gaagaatgggaatggcatttgtatatttatccaaaaggaagtatggtttaaaaaaatatatggagaaacaatgtcctaatccaacctctcattttatttttattttgttttgagacaagatctcgctttgtcacccaggatggagtgcatcacagatcaccgcagtctcaaattcctgggctcaagccattccctccctgcccccacccccgcctcagcctcctgactagctatggctgcgggctagcgctaccacgcctgacccaacctcttattttagatagagacactgataccagagagtggaagggatttctgtatggccacacagcaaattgatgactgagttggagcctcaagtgaaggttcccaaattcctgtacagcgctcttttgcagaggtaggacagccatggatcagggagagatgagaaaacagacataagggcctctttggacagatagccaggctctcttctagggcctgggagccaccctatgccccacctggataaaagcccagatgtgcctagcatggcatttccacttctgcctaatcatctccacctgtgaatggaagcaagcttacactttaatacccagtggttttgcctgaactttcccactcactgggtaacgtctcagctttgtcaagtatcacttcgtcagggatcctttcttgactgccaagacttaaggctccctggtgcattcttataacacctctgtaatcccctcgcaacaatggtaattaccttgttctgtatttaatataggtctccctgactagagtagaagcactgtgagtgtaggaagattatctgttgctcctggcatatactaacccttaaatgtttgcatgtgtgaatatttggacgggtgctaatgaatgaattagaagtgtgtgtgggctgctgagaggtgctgtagttctgattgcctgcaggaccaggagagtgatcccttattgccaagggcattgagaaaagagagaaagaaaagagacatagttgaggttgcgagggcagagacaagccagagggtatggtctccttcgctgggtgcctgatagcggcctcctgggcgatgaggtcgcagtcacatccaaccaagtcttcattcctggcttgtcagaatccgttcccgcaatttaccagggattgttagaagactccttgaatcattgtggggaagagcattcaaggtcaggactcttggaggggagacgacagcaacccgggtctcctgcagcctggtcttcccagccgatgggcacttgcggcaacggatgacaggtctgctggtgtctggctagacgccagaacagcgcagttctgaggccgcaggtcctgcccctccgcccttttccctccccctcctcagcctctctacccctcccacttgcagcatcctctacgaggaaaggaatgtgctgggctcggacgcgccgtcctggccgaacggcagcacctggggcgcgctctggaccgctggggtccgctgtctggcgctgcgccacgtgctttgatcggtgctgatgtcaagtgggtgtgggctcctcggaaaggccccggcgaggaggaggagggcgcgcgatgcgccgcgggcgagctgaggccccggcgcgctccgtagcccagcgccgctgaccggtggcccgcccgggctcgcgaagcagtcgcatggagccgcggagctgtcctccctgggacgcgtgccccgccacgctgggggtctggcaggagcgaccaaggggggcctgcaggtgtgtgtgcgcgctgtaactttcggggggtctgcgggttgtcgagccgacagggcgcagggtgcacgggctccttttgggggtgctttgtgtctgggcgcgggcgtgactggagccggctagtccccggccagccatgagcgagggagccgtagctggccgctggagtttctgcaagagaattcattgagccggcgcccggctttgggttactcctcgggaaggacgccaagggagccgttgttgtttttaaaaatcgggtctccaagtacagactgcgttcttgttaacaggattacctcagcagcagagagcgccgcttcccaaaatcggctgtggttggggaccccacggccccgcaggcgtgcgggctgcggggacagcaactggccagcagtggagagggtggggaccgggaggtgggcaaaggcgaccccgccaagcgttccgccaagtgtgcaggggcgcctgcccttcctctacacccacacttgccaggagccggctacggaggaggtaaggggtcagcttctcgcctgtgacagctctggtttcagacacaccttcccggaggaatgcagaggctttgttccaggcgcccgtcccagccccgagccctgaagcccgcgggcatagggctgggactccggtgccattactcatcttttatggcaacgccggcaagctcctaggtaggcaagttaattattaatgtgtctaagctggagagaggaaatctgaaaatgagattggtgggttgcaggcctccccctttcttttttggctttggcaaggcaaggtttaagcccaaggtgttgcagtctatttccctagaaggataagggcattcccccaaggcaccagcactgcccccgaagggttcccctttcgttgtcggtgggacagccccatctcctcccagagggcagaaagggtgcatccctcagtttttaatctactttagaacccgtctgtacccctcctcctttgccttcctaaatgcatctcactcccatccccttcctcaaggcagcttccagaccaggtgtaggagacctgagtcctctcagcaggtagagtctgaaacattctgaaaaatagaaaaatgttgccctgtcccagccatggtgcctgaaaacctccttgcgtgctccgccagtgccctcgggtgtattttcaggcctgggggctgtgggcagaggaagaggtgtctgtcaggtgtcacctgacttgtctctcccaggcccctcagtaggaggggagcagaaaggtccaggtgggaaataga

SEQ ID NO: 64445 - DNA, 2023 bp, Homo sapiens
aacagttttgggttcttaggaccaagagtatatgcagtatatgctctcggcttattaagaacccagaatatttggtagagagttttgggagtaggggacagactcattagctgatggtcatggctgcttcatgttggaacctttagtttaagcttctgagcattattataagcatagcccaggaggtaaatgtaaaaataattttcttgccagtttttcctgcatggtatcctagcgacgatgtactttctgtccttgggtgttggggcaccaactggggccgtatcaaagcttgcagagggaaggaatatgaagggcatggtcagtcacccctttaaaagtcaaggcatagtttctttttagtttatcttttggagagttttttaaatgcagttgtttttaagcagcattttatgttgtgattaccaaagtactatatgtttattgtctgacaacttcagaaacacagaaaattccaaaggaggaagtaaaaatcaactgtaattctgacattgttaacattttggtaaatatccctctagtagtcttttatttatttatttatttattaactgaactttcaaacaatgattaggttctaaaattatagtgtatggtaaaaaaaaatctcataaagtcaaatgtaccctaaactaccatggacagtaatttttatgcacactaaaattaggcttaagagcaacaaaaatctacatgagggccaggtgctgtggctcatgcctgtaatcccagcactttgagagggcagggcgggaggatcacttgagcccaggatttgaaaccagcctggacaacatagtgagtccccatctctaaaaaaatttaaaaaaaaattagctgggcatggtggcacatgcttgtagtgtcagctactcagaagactgaggtgggagaaccacttgagctctgggaggtcgaggctgcagtgagctgtgattgtaccactgcactaacatgatggagcaagaatactgtgtctcaaaataaaaatacaaaaaaaaaaaaaaaatctgggggcaaaaccaatctacctttaagattactatcaaacccctaatggtgagtagatggtagtagaaaattgaattctgttccagcttgcctgtaaggttgatttcattctgtttttttgtttttgtttttgagacaaagtctcactccgtcacccaggctggagtgcagtggtgcaatcatagctcgctgcaacctcaagctcctgggctcaagagatcctcccacctcagcaatgcccaaagtgctaggattacaggcgtgaaccgtcacattctgttttaatgttaaggttcttctatactttaatatgggttgataaatttacttgttgtgaggatgacatgccatagtggcatcacattttacctcagatagtaggttctgagtcaaccagtaagaaaaataaacacaggtgcttaccacctccctccccaacagacccccccttccccctccacacacaattgggatgatttgttttgtaacattttgttttattcaacagtaagtatttaaaatatcattttaaaagttgtatgtattccatcgtaagcatgtaccacagtttattaaccaatttcctgtcgtacaattagatcatttccaattacttgctcttataaaaatgatgagatgaacatccttgcggataaatctttgtgctcatccacaatgaagtattctggataaattcttggttgcggaattgatggttcacaggatatgagcattttaaagccttttaattcatattgccaaattgtccccaaggtcattgcatgcttccttcaaagtgtcttcttgccaacattactggaagttattattcaaaggagtcttgcatagcatgccttttttgtttttttggatgacccagggcttctattcattgtctggccaatttatcctggaaagagtacatgaaacgaggctagagatgataagtgctggtggctgggttgtgggggagggtggggaaagataacag

SEQ ID NO: 64446 - DNA, 1290 bp, Homo sapiens
agcttttggtctctggccatggagcaagtaggcttttttcccaccttaatggcccctaggtgccaggtgctaggcccaagttgtcttccttggtggtgtgctccatgtttccagcttaggtgcggcagggagcctcatttctgtccctgagctgttgcctggttctaaggcactggccagctctccagtgggtggaccttctgatgcatttggtcccgttaaaattatttttaaaattcaggtttgtttctgttactttcctcccagaagcaattctggaatgatcaaaattcccagcgtttaatgtttgtattttcctcccctctgttcactctctaaataaaggcctcatgttttaatagacagaataacagtaaaattagcttgattagactctaggtggatttaaaatgtaacctaatggcagctctgtctggcttggaaatcatgcgttttattttgagcagagaatgttggtatttgcaatgactggtaagggattaaatgattattgaattaaagtggtcaaataatacaagcatcccttatctttagatcctgtcctggtggttttgcctattgtatttttattttttatttatttgattttgagacaaggtctttctctgttgctcaggctggagtgaagtggcacaatcatagctcattgtaatctgtagctcctgggttcaagagatcctccttcctcagcctcccaagtagctggggctgtaggcaggtgccaccatgcccatctacctatactgttttgagaaacttgggccctcagcttggagttttaatcctatctgccttcagtccttggattaagagttcctgggtaatgccacaagagaaagtcaacagagttgtctttcttacctctgttccttcctctggtctatgagccctctaggttcttggaaagctcaaaatgtgaagcaaattgtagtttaacagccttgcgccaaagcatccacaactggccagctccctgctccccaaaatatcccagcacatactttatttttatttttatttttatttttttttgagacggagtctcactctgttgccaggctggagtgcagtggcgcaatctcagctcactgcaacctccacctcccgggttcgagtgattctcctgcctcagcctcccgagtagctgggattacaggcacacgccaccacgcccagctaattttttgtatttttactagggactgggtttcaccatgttggccaggatggtctcgatctcttgaccttgtgatccacccacctcggcct

SEQ ID NO: 64447 - DNA, 1051 bp, Homo sapiens
agttgacaggtggggtgtggcagctcatgcctgtaatcccaacactttgggaggcccaggcaaaaggattgcttgagtccaggaattcaagaccagcctgggcaacatagcaaggtcctgtctctaccaaaaaaaattgaaaaattagccaggtgaggtggtgtgcacctgtagtcctggctactgggtggggaggctgaggtgagaggatcacctgagcccaggagttggaggctgcagtgacctatggtcatgccaccacaatccagcctaggtgacaaagcaagactttgtctcagaaaaaaaaaaaaaaaggaatgaataatgatagccatcatttatttagtactattgtgtcccatgctattataccattctgttatttaatcttcataataatactacagaggtaggtatttttaatcccacattagagttgaggaatagtggctcagggaagaaaaaaaattatccagggtcccccagctggtaagtgggtgagcctagattttaactcacatctatgagagttcatggagtttataggtgataacactggtgagttgagagcattcatacctggcttatgagtacaagatgagactgtgcaggtgtcaaaggtataccatcttcatccttttaaaatttaacagttttatagaccttcctgtgtggccaatgctttctttacttgtattttcctctttctggcacctttcatcgtgccctagttttgtaattttggagaactaagaatccaaaagatatcccaagaggttccagttggattctgttcagcttcttcttcttcccttttttttttttggggggggggggatggaatctcattcactctgtgccccaggctggagtgcagttgtacaatctcggctcactgcagtctttgcctcctgggttcaaggcattctcagcctcccaagtagctgggattacaggcgcgccaccatgcccagctaagttttttttgttttgttttgttttgtgttgtgtttgtttgttttgtatatttttagtagagacaggattttgc

SEQ ID NO: 64448 - DNA, 1987 bp, Homo sapiens
gcccagcctcacattcgatatttatttgtggatagatttaggttctttttcccaatttccccacagtagctttgacaagtcttatttggaagaagtaacacagttactgaactggcgtcttgttcctagtttgaatggtaagagccagaaaatcgcccattcacatgtagtacattaagatttcacctactttccccagaaattattgtttaggcaattagggacagaaaagtatgaaaaatacaggtgctaattataaccagactcttttttttactgtaagagataaaaatttcaaagtattttacatattaattaggatatttcctccccttaacctctaattaatatccacagtaaacaacctttattaattacatgaatctgaacatttaatatccaggaatatgaagaccatacactgagtattcatttattgcttatcctgttccacagtggatttgaggtaacttatgggaaaagggtgaaatatggataacaaaataaaacaatcaggatcaataggaatataaattatattaggagattaagcctaaggagacaaggagaatggcaatagcctggtactgtttctgtttaggtaaaaagccagttcattggacaagttgatgtagccattttttaaaaagcgacttggaagctactctgggttttggaaagctctgtgtaaacatgggctgcttcatgttcctgacatttcagctgaactttgaaaattgctttttttttcccctccaaacctctacctgacccccagcacacacccacttcatctgagccaaggaggtgtcaattctaaaagtattttatcaagcgaggttggcatttttctggaaatgctgtagcctgagtgccagcagggcatttgggaagcttattttggaaaccctttcattatcatggcactcaggcccttataagtggttccaggacctcataccctgatgggctgcagtgataggaggaccaaaaaagggagtgttgaagtggaaggggacggtgaagtcctcttctcccaagccggcaggaggcacgataacttatctttcttccacgtctcctgtctccagcctctcctccaggaccagagggcttcctgttgctttctggaggcctggtttgctggaggtcatcctgaaagaatgctgctcagataggctcccaggaagctgatgcagaggatggggctgggaggcagactttgctggatcacagagggttgcctgggcagcgtgctctcagccttgaacaagttacaatcttgtgctgcgatttggctctgctcttgcttgttacaagccactgaaggtctctagctgggagagccactttctccctatacccaggaaggattcacaagaccatgagatgccactgattacatcttctgccccctccctgaatggagaccaccatagctcactggctttgtgacttttcctcttggacgtttaatcaacatgtcaaactaacatgtccaaaatagagttcttgatcaattttaacacctctcctcccctttgacttgtacttctcccaggcttattcatttcaggaaacagtgctggcatccactcagttgctcaaaccaaaacgctggaagtcttgtttttctctttccttctctccagtcataaatcccatcagtgagtcctgttggcactaccactaacacacttggcaaagctgaatccctcccaggagtttcactgttgccattttggccagccactgtcctctcctgcctgtactgctgcagcagtctctttagctcatctccctgcttttccccacttcttttcagaggcattggcatggaactgtagtcagactggctttgcatactggatcctccacttactgtgataggcaagttacctgacctctttatgcctgggttttgtcatctgtaaaactgggactataatagtactcatttcaaaaagttttcatgaggattaaagga

SEQ ID NO: 64449 - DNA, 1789 bp, Homo sapiens
acaacgactccaggttattaacctgctataaatccaatcctgtaattggtacttgatacatgttgctggtagtcctcaaagatgagggagactgaggctcagggggagggaaacagcttgcccaaggtcacattgctggaaggcatgctctttcctttctgcctgctgtttctgagccagagctacaagtgtctgtgtgagttatgggttcttatctcttggcaattagagcagctcagcaaaggtatttctggcacaggccattgctgctttctgacagctgctacattccaatatcgcctgagtttagggaaaagaaagcccacacctggggttggcaaagatagtctcagaactcattttccctggtttctgcacatggtgaatgtgtttattgttcttgtcacactgtctcctgaagtgcagatgcattaaagttgaatattattttcataaaagccactggagagaaagggagagaagaggcatgattcgggtgtctccaggaatataattggatttgcccaatgattgggagagtggaggtgggaaatgacaacatgccaggaagtacatttgatggtgcttttgattccaaatttgttaggcatgtgtttttaattgctttgtccctgttgtcattattctaatagagacctgatttttttttttttttttttttttttgagacagagtctcacgctatttcccaggctggagtacaatagcataagctcggctccctgcaacctccgcctcccgggttcaagcaattctcctgcctcagcctcccgagtagctgggattacaggcacctgccaccacgcctggctcattttttgtattttttagtagagacagggtttcactatgttggccaggctggtcttgaactcctgaccctgtgatccgcccacctcggcctcccaaggtgctgggattacaggcatgagccactgtgccctgcagagacctgatttttcaaaaggggttcattatcatattaaactttctctattcagcaaggttggcaaatgggatgttctcctggctcagtgttgccacctaccgtgtgctgcatagattgtcagtcttcaaaatattagaaggcagtaaaacacatttcaaactgcaacaaggcataatttgatccgtctgttcttccacaaggttgcaagtcttcagggtgaacattataagcatctgtcatcactgtgtgctcttggagtgccaagatactggttatagtgaattctggtgataaaaaaaatgctagacaaaaataccactttttctttggtcccttgagaatgagcctcaaaaacatgtgctgcttgcacatggggatctgaataattgcaacattcaggattatgtagagagagtatccctgaagaaggcacttagggtggtgtttgcaaatgtcacaaggctttcagttctatctttggccccctagtctcagtaaggattttggctcatatcagtgatttggaaaacctaataacttttatgtctccaaagttgtgtttccagactgctggctatttcatattttaaagcatgtttctacctttaaaaggacaccagagaatagcagtgggcactgacatgcctttacccctccccacactagaaaaggaccgacacatttaatcttttttttgagacggagtctcactctgtcacccaggctggagtgcaatggcacgatcttggctcactgcaacgggttcaagcgattcttctgcctcaacctcccgagtagctgggattacaggcatatgcc

SEQ ID NO: 64450 - DNA, 3403 bp, Homo sapiens
ggttcaagtgattctcctgcctcagcctcctgagtagctgggattacaggtgcctctcaccatgcctggctaattttcgtatttttagtagagacggagttttgtcatgttggccaggctggtctcgaactcctgacctcaggtgatctgcccgccttgccctcccaaagtatgaggattgcaggtgtgagccaccacacccagcctctatttttaattttttgaggagcctctataccattttcaataatggctgtacgaatttacattcccaccaacagtgtacaaggttcccttttctccacatcctcaccaatacttatctttcatctttttgataatggcctcctaacatgtgtgaggtgatactttcaggtgtgattgtacaacccagtagctgagaaaacagtagcctagtcagtggtcatgaaaggtgtttaaaaatgccaggtcctgtggggcccaggcctctgtattctttataggttcccagggggtgctggcgcagctgcgttttggaaccagcagcccagatgacccaatcactttaccctttcacctggggattaggggcctgcaaactccaaagttggaatgagagtttttaaacttgaaaatttctccttcttcttccactttgatcagtggagaggaaaataccttaccgagcagaatggtggccgagggagtgtttcccctaggttgtctctgtgggggagggggtgttgctggagcccgagtctaacagagtctaacagaaagctcattaagacccacagcaagttgaggcctgtcagtaatgagtacttttatgctgttttctacagaaatttcacttcaaaacctagagccttcagatatcctgatttgccattctaattaggtactgaaggagggctttgtgggcaggtttgtggcatcctctgtgcatactgattttgcaaacctcttgggaaacacttaaagtgaaattctttgaacacatcaaaaaagtcagcataaacaaactaaaatccctgtgattcccaaaccctaaaaatattctgtgaccaatttcaaagtccccccctcccctccactttaaggttggtataatcctgcctggtcatagggagtgagaaaggagggtttcacacgttcgttcggggagaggtcccagggttgagggttctggtgggtggggtgtccagtcctctttagggcaggttatccagtgtctagattgtttgggagaaggtgctgggagaaaggccagaagcctcagcctggctggacatgggctggcatggacgccatctctcctggccagcattgcccacctttaggtctctagcaggaagagcccaggagctagaagcagaagcacccagacggggaaagatcatgggtggcgccacagcaggctcctgctgcccccatgaggagaggttgggaaagtgagtggcttcccactaagtgaggaggaaacgacagtggagggcatcttgcctgtttgtgtctgtggctccctcatgagcaggctgggattttgaggctgggaatgtgttataccttaaaagcaaagcaaagagcaccggttacctagatgggaaggcagagcagcagtgtcctttgaggccagagagtgaaagtatgagactttgtaggacttttgttcttaatcaggtccctagcgggcccacttcttgggcccagatccctgatgcctttgaaactgccatttaatatggcattactgcctcccagcattgggactccttcccttcagatctgctaaggacctcctaactactcccttcccctcatgtcccctcaccacccctcacctccacagagtgccagatattcctggatcaaagtttttatcctgcccctgcttagaaactttatggagcttctatttgcctggctgataaaatccagtgatctagccctccttctctgcccttcaggctttcatccatctgtccatctgtccatctatccatcatcccttaccaagcactacaggactttgtgaagaggtattgtccttaaggaactctcagtcttttggggaaggcagacaacagtcaattacaggggttgtgaaatcacagaggagagacacctgtgtgaagggtaggccaacacagtaaacacactattactggctagtagaatacactagatgccagaaagaaaccagtattagtattaggaggaataatgataatgaagcttttgcattatatagacctacttcaaattaaccttgattaaaatattaactcttttggggccgggcatggtggctcacacttgttattccagcactttgggaagctgaggttggtgaatcacttaaggtcaggagtttgaggccagcctggccaacatggtgaaaccccaactctactaaaaatacaaaaattagctgggcatggtggcacatgcttgtaacgcagctactcgggaggctgaggcaggagaattgcttgaacccgggaggcagaagttgcagtgagtagagatggtgccactgcacttgagcctgggtgaagggggaaaaaaaagtgaactcctctgatccttaaagttcttatctgtgagttggttaaggcttaacaataacatgaacttcataagattgttgttaaggattaacaatcattaatgagataatgtatatttgtgaaacatagtaaatgcttaataaatattggttattaacgttattatcagacagagaagaaattttctccaggattcttggagcaaagtcactgaaattacagagaaaaacatctccaacaatttgctcagcatgaattcaacaagtcttactaacctgtctgttatgatgtacctcacatacatagaaagaatgataccagcagtccaattcagtgaatgaggtctcctgggtgagaatagtgccctgttttgtcaaatatgggtttttgcacattgaatttttttttttttttttaaggagaagaactttaatttttttttttttttgagacagggtttcacactgttacccaggctggagtgcagtggtgcaatctcagctcactgcaacctccgcctcctgggttcaagtgattctcctgtctcagcctcctgagtagctgggattacaggtctgtgccaccgcgcccggcttattttttgggagacggagttttgctcttgttgcctaggttggagtgcaatggcatggtttcagctcactgcaacctccgcctcctgggttcaagcaattctcctgcctcagcctactaagtagctgggattacaggcgcccgccaccacacctggctaacttttgtatttttagtagagacagggtatcaccatgttggccaggctagtctcgaactcctgacctcaggtgatccacccaccttggcctccg

SEQ ID NO: 64451 - DNA, 1061 bp, Homo sapiens
ttgtttttgtctttgcaatatggatgataaacttcataaaattatgaaggattaaatgagataatacagataaattctgtctgacacgtagcaagcactcagtaaatgttatgattaaaagaatagaaggatgttggggactggttcctggcccttggggagctaacagttttgaaggtgaggcaggcctgcgatggatgctttctacacagtgcaatgaatgccaaggtagaaggattcctgagtgtcgtgaaaatgcagtgcagagaaagatgtagctggggaaacatgaacgaggaagtgaggtggggaggaaacactttatctatagcataaaggcctgggagttaggcaagggtatctgaatgaggggaaaatgtttgggaaaatgtttggaaaaagctgttccatgcagggcagccctatgtgcattggcttggagatgtgaatggctcaggctgagggaatgggcaggtggagggaatgtggctaagggtaggcatgtgaggctaagatatctgtggggccacaatggcgagcagatcaggctggatagtacttgagcattagattgtggaaggcctgcggaccatgcttaggagtcaggactctattctgtatccagcagagatttccttttatgaaaaaaaaaaaaaaagtcttatctcttcccaaaggagaggaagtagggacatacataccctcttctttgtgggtatgcacagccttcttatccctttgtttccagctccctggaacatcaggggacagctttgcaccaggaagaactgggatccctgaaacttcctgattgggatctctttccatcattgctctgggtgttcttctttcatttctttgaaggctagtatgccttaatttgagacttcacccgtaatgatattcatgtccatgcccattggttctattttcttgcctcacagattctagggcgtggtatatagcaaaggataaaatccttctcagctcttggaaaatggttctcagcgctctgttctcccactgactcctctccctgctccctcccttctctgtgctcc

SEQ ID NO: 64452 - DNA, 3127 bp, Homo sapiens
cactgtgataatgcccattcagagtgagaaaacataggctaattagccccctcatggccacacagccagcgagaggcaaagatgggattggaatccaggcagtctgtctctagcactttgccaccatgtacatcagtcatttctgccaaagccacagggctgcctcctcatctgaagcacagggcactgttttaggaaaaagaatcgattaaaggttgacttgcttccccccatttcctcccttctgaagtgggagtgggatcagcttgattttgcaacgtaggctcctgctttatacctggtgtgttgtggtcaggccccacaggacatattcgtcatgcacttactatgtgccagacccttccataggtgttttactcatgttatctcacagcagccaatgaggcaggtggtactgatcctaatttacaggtgagaaaactgaagcacggagaagtgaaagacttgcctaagttaaatcacgaattaatggcataacctgaatttcatctcaggaccatctgactcaaaagtccatggccttctcaccccctctctggaagatgccatgggtctgctgtgaccttccacacaccgggccctgccagaatcctgtctctcactttgatgatgccagggtgtgtctgaggaccaaggttgaaacaactctgtccccttctggggatgatgctgcccaggggagaataacagctcaggatgtcaccctccaggcacagccaggggtgggtgcagggttggagggcctcttttctgggccacttctccggttgcctgtagcccgtaattgtaaactctctggagctcttggctgcctggctggaagctgaggaaggctcatagcctttgagaggccagggctggtgtgagaagcaggtacttttcccatctttgagtcttactctccgatgagctgagcatagcctggcgttaggaccacctcaaggcgcttgggcggcctttccacagccctgcctggctgagtcgccaagattctgtcctttcttctggagccttggtcatcctagtgagtggcagagaaaccagctgggactggggatggggacagggtggtttggggacctcactgaggaaacttcgctgaatgacccgatttttctaaaacttgagggttttgtgttttggatttggaaaaaagctgataatgaggaggaatgtttcagagaatcaagctttttagacagagaccccctcttgggcacggggcagtggccttccttgagtggggtggagggggacttgctggctgggtctcttgttgtggaggaaagacaggcaggggctgacgtggtgaaacgaagctggaagtttcaggatgagcttgggttcaaggagttgtgggtaactggagtgagagctgctttcccagcctaggccagccccctgtgtgcctcggtgtccccatctgtctgttaggggtgaaggtagggtccctcatggcagtgttcccaccctaaggcattgggaggcctcagccatggggtgtagctgttacacagtcgttgttgtttgttatttattatttaagcacctctcctgtggctgagcagggacccaggggttgagtatcaccttgggctgtggctcccctttctcctctttgccctgcagtcacctgtttatagttagcacctactgttgcaggggactctgtgctggatacttcacatgggaaggtcacagatgagggaagggccttcctagaacccctagggcgacgcttgcctcatctgtgaccttctgcagtgcttgtttctgcccatggcggtggaggtgggtggggtgtgtatgtctccttcttcccctgccccccaactcagagctcaggcaacgtttgagtaaatacagggagaatttggaatctagatggcttatctcattcccacttcctggcccagctcaggcttctggggcccatgcctcctgctctgggtgccaggcacttgggaacagtagcatgtttctccagggcgggtgggacttgagtcctggacttgggtcctggctgtggaagcaggggagctggtgggggtgctatgcattctggacaaaagggaacagggtcagcgtccgggagtgaagggggcccctgaaaggaacgtggcctaaagtggagagtgaagccggagcagagcagggcgtgagaacctgtgtggatgtggaggcgtgtgtgcacacacacagcctgggccagcgaaaggagggcacaggagtgaggttggggggcaggacctgccactgcacatcttctggtctgtcagtagatcccttggggggcagtaggttttagctctgacaatcctgcagccttacctgggctccttcagttgggcttggcccggggaggcaggccctgcctcctggtacctggggggaagtaggtacagtcctccagggctgctgaggggagcccgcaaccccctccagaagcaggttttatgggagagctttagccaggaaccacacactgataaagaagtgttttcattctcaggggcgttaattaacacagattagatttcaactgagtaggccttttgttgctccagcctttctatcaaggtggtttcaataccactgtggtttcacggagccaattcaggttcattattctcatctgttactatcctgggtgttcagacctgatgttacttcttatggctctccttagtccactttttcaaacttgattcactatgggcctggcctctcacacatcaccctcattgggtgctgaacctgaaaaaagataatccaagcatgtaggcacatttcttggctctgtgaattttattaaacgtttacaaacatgttttctgcagtttcctgaggtaatctggcacacacaagacaggatttgaattttctttccagttgtcatgtttttttaacagttccatccattcccactgactggatggagagagattgaaagtggatagacatgggagctcaatgatgggaactcatgagagcaaagaaggaaacaacagacactggggtctacctgagggggagagaggggagcagaaagataactgttgggtcctgggcctaatacctgggtgatgaaataatctgtacgaca

SEQ ID NO: 64453 - DNA, 1800 bp, Homo sapiens
atgtatgctcatttataaattatatacatacctgctgtgctaatgaaaacacacacaattgtaaaaggatggcataaaaataaacctgaataggtgttctactgttttcttctagaactccgtgggtcatcttgagcacctcaggattgagtgctgtgcactttggagacccctggtgtcccccagtatctaaggaatgctctattactgcagcgcagtgccctgtaagagagcgcacagctggctggacctccaatttcaggtgctctgattttcagaagcaggaaaggccctgcccagccagccctcatgctttttgtctggagttttaccaaactgaaggaatcccagagtgaaacactcctagttgcttctctggttgcagtcctttgctgttaccccaaggcccctcaggaagttccaagagtgtgcagacatcctggggtatgagggaaaggctgtttcctaggcttgggtacagctcaaggattggtgaggatgtggagaaattggaactcttgtgtgttgtgcattgctggtgggaaagtaaaatagtgcagctgccctgctttggtggttcctcaaaaatctaaatagcattaccctgtgatccagccatttcatgtctaggtatatacccaaaggaattgaaagcaggagctcaaacagatatttgtacacttaggtgcattgcagcattattcatggtagccaacaggtgaaaagaactcaagtttccatcaacagatgaatggatcaacaaaatgtgatatatacatataattgaatattactgagccctgaagaggaaggaaattttgacacatgccacaacacagaggaacttcaaagacatcatgctgagtaaaataagccaattaccaaaggacaaattctatgattccacttttatgagatacctagaatagccaaatacatagaaacagaaagtagattagaggtttctagggcctgagggaagggagaaatcgggggttgttgataactaagagtgcttctgtttgaggtagtaacaaagttttaggaacatagtggcgttggttgcacaacattgcgaatataataaagtaagaataagaccttaaacataaaagcaatgagaggtggctgggggcagggttggagaaacaggtagttaattcttttgtccaaatgcagtgcacctactgatcagatgccagggtgtccctgtccttttggatacctgctgccagattagggctactcgaatgggacacttgtggccacaccctggtcattctgactggctgtacaaatagctctcctggctccccaggggacatgttcatcaagatttaggccacaaagtagggccgtttgttccccctcttgcccctctccccagtcagctgacgacagctccagtgttgcagcccagcaccccaggatggatgacacacctccctggtgctccattgtcagggctctctgatttgcagaaacaggtaatagtttctgtctatggtttggaatcatgaagtagggcaagacaagtttctttggagttaaatttagggcttagaatccagggggtggctgagtaaagctgtatttaactcctactccaccctcaaaaaagaaaaaaaaaagtcctaaattaagcaaggtacaaggagcctgcagctacctcaaccaaattggaacacatacctctaaaaataaaagatgctgaagtctagaaaataccaaatatggttataggtcaggcacttgcttctctgcttttctaatgtcaccatccctgtcccagtcctggag

SEQ ID NO: 64454 - DNA, 1131 bp, Homo sapiens
ttcgccacttcatgaagccacaaggctggggcagctcttcttgctgtgagatagcccagtgaaggtggtggcagtagaaacggtggcctgaattcaggcaggctccaggtggacgacagcaataaaaccttcatggccagagcaggggtggggctgactgaaggaataaagcagggagtggagtttctgctctgatatctgagatgacaaagtcctgcagagtttgctctggaaaagagaaaaggttaaaaaaaaaaaaatccgaatggaaaatttaaggaaacggaacccaaggctccacttggattctgagtggtgtgtgttactgcagattggtaccttttgttagaggccctggatctcagttacgccccttctgcttaagctcccagttttacttgtgcaccctggctagtgactccagatgcccctgagccttgcttgctcttcccagtaccctagtgggcttctggttcacagtgtggcccttggaaatgggctccacagggtggactttctgcctgactcatatcttcatccctcaaggtgtgtcacactagtggttgcctggtagatgtttgtgagatacctggggtgtttcttataactgtgagcagcctagacacacacacacacacacacacacacacacacacacatacatgcacaaccatgcctccagtcccatttctgcatctgtcctcactctctccacctctatccagagttttccttctcctgtgtcttgtgcatgtgtttgtttgttttagatggagtcttgctctgtcgcccaggctggagtgcaatggtgcgatctcagctcactgcaacccccacctcctgagttcaagtgattctcctgcctcagcctcccgagtaactgggactataggcacgcgccaccactcctgggtaatttttgtatttttggtagagatgggattttaccatgttggccaggctggtctcgaactcctgacctcaggtgatccacctgccttggcctcccaaagtgctgggattacaggtgtgagccaccacccctggccctttctacctgttttattaaaagagctggaatgtgctgggcaggcagtgcactgagtgcttttatctggactctctcattta

SEQ ID NO: 64455 - DNA, 1727 bp, Homo sapiens
ggagctatacatctcttcttaggggagattatgatcccctgcttggaacatgggcctgtcctaggggtagagcgtggtggctgaacagttgcagcatgacgatatgggaggtgtgacttctgccagtgaagggatgcatatgagcaatgcatgtccatcatattgcaatatgtagaattggtgactggccagctcagaatagcatgggatcatcatctgtcttttcctcaatatcatacttgaatcaattcaacctaaaatcaaaataggttccctattaagatgtaatcatattacatcaagcactgctgctcagcttctctctctcctcttaaactgctggtctcaaatttaggtctttaagcttatctctgttagattccatatggctgtattaggtccagagaatcagcttgttaagatcttttagctctaattctgtcatctggcttcctgcttctccctcacagctcaagcactctgcagtcaggtgatatgatgcaactgacatttgggagtggcggggatgggagatgggaaagtgagacagcaccaggcagtcagttgcatcaaaagagccagaatcttctctcacctcctcccacacaccctaaaaccccttcagtttcctttgcatggcccataagctcggccttctgggttcatgatatattaaaggtcaccaggaaggacatcacacattctgcttttttactgaggccctaaatggacttaagtaggaaggacctaggttagacattaagaacttcttggcataggtgggtatggggggcatattagagaaagcagtagtagatccgtttctggaggctgtcaggtactagcgtgttcctgagaagtctgcagtgtatagagtgttaagtgggggatgtgaaatccctatgaggcttgttgagtttgcaggcctatcatgccagccattgcatgcaagcgctgttggtggtgggggagtcatgggtgtactggatggctttggcctccattgctctattgaagactccaaactgtgttgttccgctgcaaaaattgtttttttccattgtaagcaagaaacacaaagcagcccttcaaggagggtgtgcaggcatgcaattctggcagtatgttgcattaatctgatgtggcatggggtgaaccaccccagatggcctggcagaaacagttggacaacagcatccagaggacccctggaggacagagggcagtgcagagagccttgccctggaaggacctgagcccacagacatggccaggaggaggcctgatctcagcgctggcttgcccatgagttgagcaggagtagagctggagagcagccttttccatgtggcccactgtggagcctcgtgtgtgctgtgcatgagtctctgtgcccagagctgagtctggaacagtttcccttgtggttgtttgggaggagagggaggcagatctctactgatgagtgtcagcaggtgtgtgaggcctcctcacttcaaggtacgtttgccaaacccctcaggatcttggcaactgtcctttgacacctagatgacttcctgtgggtaaagcccattagcagtctattccctctgcctgctctagatctcagttggggttttgacttgggctaagtggggttctatctattcttctcccttcttctttccctccgtctctccaggcctcctcctcactttcctatatgccctgagcccctctttcca

SEQ ID NO: 64456 - DNA, 1170 bp, Homo sapiens
gctgaagagattaaatatctgtatttcagaaatcaaaccaaacaaaaaacttttgccacttgttggctaaattagtcatgacacctctgtacagtggattattatgcatctattaaaaatggtgctgtgaaatattaactaaggaaatggaaactgttccctgtacattagtagataaaagaaaattacagaacaggctggcatttggaggttctcagtgagtgtttaaatccacttacatacaaagctatattgtcactctcctccttttattggtgaagaaattgacttgtgtaaaggtcatgcagaattttagatctgggtcttttgaattaagactgaagtgctttctttgtgatactcgtctgtttctgtctattaaaaacacagtaagatattctctaatcaaggactcattgctatgctcagatcagaaaagtccgggagacctgtttgacacccacattattttgtttgcatagctctttacagttgataaagcactttaaaggatatataactttttctgattttaaaagatgacctatttattgtataattaggaaggcagagaaaagccccaagaaggaaaaaatatttataatcctgtaggtttaactactattaacatttttttcttcctgtcttttctcattgcaaatacaaattttataaaattgggatcatgttgtacatatagttttgattcttgcttccttaactaatctgttatagacaattcctcgttaattgttcttctacaatgtgatttcatgcacagtatctagtttttgtttttgtttttgtttttttttgagatggagtctcgatttgttgcccaggctagagtgcagtggtgcgattacggctcactgcagcctcgacctcctgggctcaagcgatcttcctgcctcaacctccgtagtatctgggactacaggcacacaccaccacatctggctattttttttattttttattttttacagagacaaggtctcactttgttgcacaggctggtcttaaactcctggactgaagcaattctccctgcctcagccttccaaagtgctgggattacaggagtgagccactgtgcccagcctacattttctcttttgatccttaaaataacaccttgaagctggtaggggaggattattatcccca

SEQ ID NO: 64457 - DNA, 1024 bp, Homo sapiens
ggtttgaactattttaaaatttttaagtgagtcttaaattttctttcagagtgaaaagtttaaaacaaataaaaatgaaaaatgtgcttgttgaataacattgacactgtaaaaggtatgtgatgataaagaagaaccctttggtagaaggtgggagaggggtcatgcaggctcaagacaatggcaggaatgtcctgggggtgtccaagactgtccaggactgggctggtccacagggaggaagtgggtgatgtggcaggagtggatagtcacccgactgaacagggcctttcatgtttgatactcacagtggatggggaggaacactccagagggagactcaggttggagggcagagtggtgacaggggagggcatggactttggaggcagacagggtgggctcaaggcatagggcccatcataggaagcagctgctcagtctaagttcctgtccctcactgatccccaggcctcacctgcaattgaatgagaatctctgaggttgggtccctggcagtattttcctttaagcccccaagtgattttaatgtgcagcgagggttgagaaccatgtggttagactctttcacatcatgattcagcacagtgcatggcttttaaaaggggcaccaagagaaacttctcttttcacctctgctgccatcaggggagagtttgaggcagttgcatggtggtgtgaagggggtcgatctgggagccctgtgtggtggtccctgccaagtctgatgtctttgtgttggtggccctttacttgggattctggcccccacatcacctctttaccttgtgtggggcatgatttgaacactgcaggtgatggctttctagtggcctgtgttcttgcccatctggagggaagaaggggctggaaggccctgtgagagagctgatctggggcttggcaagtgcctggtgggatcagagggagaccataaagtacataaaagtacacatccaggcactttttgggtcatatggtgctttccaacatgggcccaccc

SEQ ID NO: 64458 - DNA, 4458 bp, Homo sapiens
ctccgtccttccagggtagtaagtagacaagttgcaaaggtatgcatacagggatgttcattgcaacttgcttataatgctaagaaattgcaaacaacctaactggccatccattaggaactggttaatgaaatttcggtaccatccaactattaaatgatgctgcagatctgtttttctaaatacagcaagatacacatgtacatcaaatgaaagaatggaaaaccacacgtgcagcatctagcctgctaccactttgccattattctctgtgattctaaagcccatcatggttgggtttgctcaggcctgctacacctctttccctgtgattgactttctctctcttgttactcatgtaactgttttgcatcaggtctctgtgaacaaggaccatgccttgcttttgtttcccgtgtttccttcaagcaataggagtaggtggccactaattactgcagaatttaattgagggacgtgaacaaaaggccttgttatcagcattaagtgatattaagctgtaggctgattctccctctcttacaaaatagaaactgtgtctggcccataaagaggcttttaaactaaagttgtgttaacaaagacctctttccagagacctccctgcttgaggggagctggagtaaattcaggctttgtttcctctgtcttagggagccagctggaggtgaggggacaggaggtgtgcctgctgtccaaccgattttaatgcacaagatctcagtcagtgggtttttgttggagtggcaaagggggagggaaagccttgcctcaagtctgctgggtgctgggcccctgatgttgtcttgtttcatcctcacagcagaccgaggatgagggaaatactctacctcatcttacagacaaggataccaaggctcagagaggttgaataacttacttaagttgcccagctaggaactgacaaagcgaggatttgaccatactgtgtgccttgatctagttaccaaagatcctagagcagctactgggccacagtctgggcacttaggcatagttgctgagcaggtttggcactgggatgatgggaaaggggtgggaggctctgagttggggcaggatgggcgttaaccagctaggtatttatttcatatctgctgtgtaaacagcatggtgctgggcactgaggggatatggagaagagggtgacaccgtccttgtctatttaaccatttggttgaagtcattcattcttacctaaagaaatacaccaggggatcgggagggataaataggggcatagaaaacaagaggtagaggaagtctgaaaaggcacagttagcaggactgacatgggtggggaaggtttcattgaggagggagacgtgtgagcaatgtgtaacagtggaaggtctgggctgaagtgggggctcttgaagttgagaagtgggagcctgtttggaaagggaaggagggaggtggtcaggaggccttgggcactggatccaggagttctctctgattctctgagtaattaggagctgtcgtaagcttttgaacaaggagttgacatggtgggaaacagtttgaaggtgattcttctggccatggtttgtttaaagtgcagagtggtggagggagagaggaggaggttacctcatttttctagaaagtttacccatctgcaagattagtagtgagagggatggggatgctctggctgaggtgcactgggggatctcaggtcttgacttggacagtgtggtggtaggaagaaacagatagctgtgtgttctgtgtcctggagtgtaactgcacactgccaggtgctcagcttgaatggctggcatgcaagcatacgtgtatgcatccattcagcaattatttattgagtgcctagcatggcacatgagctaggcttatggtagtgagctaagcaggcatgatcccctgccttgggtctggctttaaaagtaaatgtcctatgagaccaaaaaaatgacaggaagacatccgaaccgctctaagaaaacagtttgttccatagcttggttgtgccaatagagggaaagcattacttctctttgcagaagtgtggcttacagaggagggtctgggacagatcttgcctagagggctggggattttagatagcagctagtccaaccaccttcataagagggaagttaaatagggcctcacagaagttggggaaattccttcaagttgtacagcacattgctacgtctctgtgcttgtcagcattctggccccgtaccacaccgtctctgctctatggctgagccagcctttctagcctgttttctccccttgagtgagggaagaggggtgctggaggaaacaaggggaatagggtagactattagaaattgaataagaaaaccattttaaatagggcaaaccacagaggagcactctcccttcttctgtgggctagggagcccccatcagaatttcaaagagacattgcatggcctctgatctttgccaatttcccaaagttcatagcttactcccaggccttatttcttaaggcctaggtggtggggaccaagatgtcactcactctagaatgccaaataccctgagaaattccaggggctttctttttgagccttggggctctggccaaatagctcctggtatggttgcagcctcagatccattgatgagtacctatgcctggcaagggctgagccaaaaggggccagagggatgcagaccattcatgagtacagccccttcctgaggtgggggccggctagcccacaagcagctatgctgagcctctgaatgatgtgagtcctagaatggggacccacacacaatactttgctagctgagagaataacgtgattgtggctggaagagttacagatggcaaaattggagctttacttcaagcatttaaaaaagtcataaagttacttatattcactgttgtaaatttagacaatgcagacaagcaacaagaaaataaaaatcccttgtaatcctatcacccagagataatccctgttaacatcttgttgtctatctctgtgtatctatgtatttatatgtgtgttttaacaaaaatgggataatatatagttttgtattttctcacttaactatatagttttctctctcggcatccattggggattggttccaggagcccccacagatagcaaaatcagtggatgctcaagtttcttacagttggcctccatatccatgggttctctgacatggaacccatggatatggagagctgactgtgtatttgaaaaaatatacatgtccttaatttatgtttatctcatcagttttaatggctgcatacgatttcattatacagttgaattacgatttacttagccagtaatcgataaaattttttggagttgtcttccaaaagggagtatctttattgtggtagctgatcacaaaataaatacatgcttatgttgaatttttaaaaaagctagtctcaaaaggttgtatagtatattatttcattgataaaaaattcttgaaatgacaaaattatagtaatggagaacagatcagcggaagacttagaagagggtacatttctttgaagtggtggaactgtcctgtgtcctgattgtggtggggcacacatgaatgtatgcatgtgatgaaatctcatagaactgtacatatatacatagtatatataaaaacctggcttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaacctgtgaaatctctgtgaggtctgtagtttagttaatagtattaccatgtcagtttttctgtttttgacaattgcactattgtaatataacatgttatcactgagggaagctggctgatcggtacacaagaattctctgaacaagaagattagcatggcccctgcgcaaggatgacacgcaaatttgtgaagcgttccatattttgcgcagtctgtcaagatcatttcagtatctgctaattagcactaaggaactagtgtgaatctaagcaaaaacgggtggcacccaatgacgaaattgtggttttcattaccaaaaaaaaaaaaaaagaattctct

SEQ ID NO: 64459 - DNA, 1794 bp, Homo sapiens
attctcctgcctcagcctcctgctaatttttttgtatttttagtagagacggggtttcttcatgttggccaggctggtctcaactcttgacctcaggtgatccatccactttggcctcccaaagtgcagggattataggtgtgagccactgtacctggccatcttgctggttttttattcccctatcccccccaaaccaaaccaaacaaaaacataactacctcaaagaacagcatgttcttctctgatgtctcatctgctttcatccgccatgccttactgagcattctgccttctgccaggattgccctgtgggaggcggctgtggatccaggaaaacagactggactggggagtgtctggggatttccttaccattctcccccatggggcagcctgtggagagcccacttgccaggctctctctgtgggaccagctctggtttgaatcctggctccaccactaactgtgtggccctagacatgacctcagactagtgcccgtctcatacgcttgttgatgagataatccacacaaagccttgagtacagtgtctgacatgctgcgagggctcagcagatgctagctgttcttgctattgtgattcttcccgttttctgtttggaatgtctgtctttctaggctcaatgctggactgagtttctttgaaggaaacaagcattgaagaggttccatggatcagggaggtctaagtaggggttcctttgttctgccttgcacttcctgtggctgttggtcattactgtgggtcgtacccatttttgcctccctctagtctgcctgtggcaggaccccttgcttctcagccactgagtgtacctgccagtgtggccactccttgtgggatagctgggggtagacacaggttagccttacaagatgtggagaccctgcctgtgtacacagacctgcttgcttatgatggacttgcctgtgagttaatcagtcactagatagccaaatgaggagaaatattggtagaccaaagagaattgctgcgactcaagattagccagagaaaccaatctctgtgaaagaaggaggaaatatgtcttttttttttttaatcttgctgactttgtagggccaggttctcaaagtttgagtattttgcaagtatatctccattgaaaacaacaaaaatggtaaaaggctttagaaagggttggaggaaaaaagaatggaaaattttagtttcagggagctatggtgatgtatggtttatgccacctcagttcccctattattgggtttaatattcaggagagctagggcatcatcctggttctgtcactaactgactgtgtgaccttgagcaaggtgggcctcagatcccatgtctgtaaaatgggaatgtcttaccctgaaggtggggctggagctttgctctgaaggtggtgggggtggaggtggaatgacttgaggcactcgagtaaagaatcaggttgggaggctggatgcggtggctcatgcctgtaatcccagcactctgggaggccgaggcaggtgggtcgtgaggttaggagttcgagaccagcctggccaacatggtgaaatcccgtctctactaaaaatacaaaaattagccaggcgtggtagcgcgcctgtaatcccagctactcgtgaggcaggagaattgcttgaacccgggaggcggaggttgcaatgagccaagatcgtgccactgcgctccagcctgggcagcacaacaagactgcgtctcaaaaacaaaacaacaacaacaacaacaaaagaatcaggttggaacttta

SEQ ID NO: 64460 - DNA, 1052 bp, Homo sapiens
agaggtggctggacacacaggtctgtctctgccctgcaaggtttctgatttatgcagggagcctgcatttgcccttggccaaattctttgggcataaagcttttgtaaaggggcttggggcccttccagggcattaacagtttctttatgccccattcagatatctatttgtatctgatttttatatatttccaaagtactttcccagcttcctgggggagacttgttccccccagcctggccagatcattgggaaccttctggcagacctgcctcacgctgctggcatatggagtgtcctctcaccaccgtctgtccttcctggtgtcttgcatgccgaagggccgagggtggagtggggttttttgttttgtttttaaataagggcaacgtgggtaaacagagcagtgtttctggtgccttcggggagggccaggaccctgcattccggctccatgacgacagcctgtttggttgccacttgctgggctgtgggcagcagcagttcagacggagacaatggtggctctgttgaaatgctgctgctgggctctggcagaatgcattttaattggacattctccaccctggaatctgtggggatctggtggcccactcctcctcattccttcatttttctctttgcaactcaagagccaagttattgcagctccttccccgccccgccccccaaccccgtctactattagcagcctcttgggggaaaatggtgtttctagccagggcatggtttgcactgggctgactggaaatagtgagagaaagggagagggtagggggctggaggggctgggagatatcctgtggcctgttctggagcatcactgaggggtgaagagcagcaggtgttccaggaagctcttctcttccgtggaccagggtggtcaggaacactggctctgaagtcaggccaactgggttggaatcctggtggtagcactgccagctgaacctctctgtgcctcagttttcttatgtgtaaattggggataatactagtgtctactcgtagaatcattgtgagaattaaa

SEQ ID NO: 64461 - DNA, 1950 bp, Homo sapiens
ttcttagatgaatgaggcagaggcatctgcctcaagggcttctgaaggcttccttccttgaggaagaagaacatgcagacagggtgaggaggtgcccagcccgctggcacccaagacacttatggtataggatatccggatccttccttttgatgaaagaagatgccatcacagagttaagggggctgtcaggcctcaattttaatcccacttctgttgcttgccagctgtgtgaccttggacaagtgagtcaacttttctgagcttcagtttccacatctatagtcagtagctagtaagaacatctaccttgtagggtcattcattcctttattaaatgaatatttattgagtgcctacttggagccaggcattgttctaaatgctgggatgggatagtgaacaaaatcaataaaggtctctgccctcatggagcttacgtattagcaggagagaaagagagcaaacgaaatggttaaaatatatagtatcagaggatggtaagtgctatggagaaaaatgagcaggaaaaggagacaggaggcctgggtgtgagagtggaatggtcagaagaggcctctttgtggagatgacatttgggtagagatctgatcaagccatgtaggggcaggacatgccatgacgaggaaacagcaaggaggccagagtggatggagctcagggagtaggagttgagactggagaggtgcaggcccttgacttgagctttcaccctgagtcagcagagaattcactggacggctttgaacaatggaaggctttgaacagaggagtggcatgatctgacttttgctttagaataaggataattattctaaatatttattctaaatattctaattattctaagtacttattctaaatattttaattatttaggataatattctaaaatatacttattctaaagaaaagtcagatcatgccattcctctgttaaattatggttgttgtacgtagaatagactgattaaagataatgtaggtagcatgtttaacacagtacctggtatgaaataagccctcattaaatggtagttttgttcttcatgataatattattttaaaattctttttattttttattattttttgagatagggtctcactctgttgcccaggctgcagcctcgacctcctgggctcaagtgaccctctcacctaagcctcctgagtagctggggccacaggtgtatgccaccatgcctggctaattgttaatttttttttgtagagaccgggtcttgccatgttgcccaagctggggtaatattattaaagatggacctgggtgccttctagtcttggcctgggccctcattccacctatcttctgcccttttgggagctacggcatccagggagccttctccctgaggaggacagtgatgagtattggacttgggaatgagcagggagaaggtgactgattctttggctgttcctgcctggatcttctgtttagtagtcatggtgaggcgtggtggtgcggcagtggagacaggagaagaatcttggcctccacaaatctagactggggagctcaacctgcaggccagaagctgccagtaaacgagaaatgccacatcagcagccctatgaattctgcttttcctatctggttgttagggttcccaggaggggctacagctgtaccccagagctgccctcctcctcccagacttcatggtgggcatccctcctcactacctccatccctggaatctcaggcctttatggaaaggtctcaagcctctcacatggtctgatgtggtttgcctattcacctgatatagagactccttcggcagcagtgctgaccaaactgcttctgctcaatgactttgtataacagggagagttcactacctcacaaggaagcccctcctgtaattgtcacattctcattgataggaagttccatttcag

SEQ ID NO: 64462 - DNA, 1529 bp, Homo sapiens
tttgagttgggcctagacagaggcttcattatgcaggaaaaggagcaggcaaaggttacagcagaagcaaagaagcaacttgtttaaaggggtggggtaaggagttcctgggaggctgttttacattcccttcatttctcaaatgaagatgaggtccagagatgggaagtgggtttcctagcagggatagggtaagcaaaggttagaaccaatgcccagcacctcacctggggctgttttcaccacgcctcaagggtgcgtctctactcggaagccatttctcctggttctgcctcctgccaggctgttctgtcttaaggaggaaaaggagggagcaaaagttgtatttaccaaaggagctggttgggcaggtctcctttccgaggtcaaagtcaaggccaaggttggcctagctggcttctggggggcggagccaggccttggctggccaccaggtcagtggggggtgtgggggatgggaggtcggggaggcttttggttgggagggagtgatcactggtggggactgaggtttttccaaggcattgcccctgtgaacagtgggctgaaaagattacagcccacacattctttctcagcagattagggccatgggagattatggaatacacaggaggctgtaggaggcctgcaaatttcccatttggggcaattaatttgatggattgtaaaacagctcactgcttcctctccgccttccctgggctgggttgggctgggcagtaagactggctggagaatgtggctggaaatgcccttgccggtgttctgcagtacctgcttggaccaccttgttaaaaccttctctgggcaggggctcggcctgcccctttcctgcctcccttcctggtacaaggaagatcatatagtaggtgctacataaagctatgcagagctgatacttatctgattggggcctttccaggatgttggtagaggtggggctcatggtggaagctctggtttatagatggggaagctgagccccagcggtgaagtcacctgcccaaggttactcaggttgttggtgacagctgggactccagccaggtttctctactcctgggccagggcgtcttctccccacttgtgtgctcaaagtgaaagtgaaataaatagtgagcaatttttatggtttctctcccctgacttcctccttgcctccagccagtcagtagggtccccactttggtgactgtgggcaaggtgtgacatggttctgctggcatctccccagcagctttgcagcattcccaggagggctctggtggggctgcacttttcttatgtactcaaaatgtgtctgggctcattcgatgcctcccttctccatggggtcttgcacctgtgatttgtaacagattcttgtgattagtcctttctctggtgcctcctaaagaccccactgtcaccaactcatatctgcagcggtgcagatggttccgactggttttcttgcctccatcctgttctccctacaggggcccaaatacctcatcctgatatgc

SEQ ID NO: 64463 - DNA, 1675 bp, Homo sapiens
gggaccacccccctgagagtctactgtctccatgttgagggcctttgaccagacttggcctccctcacagttcagctgttctcactcctgacttgaaatagggcagctatggggtcatgggtgagcacacaggcttggagccagacttcatggctatggaactctgccaggttatgtaacctctgtaaaatgaggtaaatgccggtatctgccccttaggtcttttgcagagattaaatgagaataatacacgtaaactacttagtctccagaacatagtatggttcaacagattttataatttatttccatgaacagcagatattttgtcttttctctataatggctatggtgggccaaatgtatttaggtaatttcttgacttctgcagggactctgatatacacagagcgtacctgtgtatactgtccagttagctcagattctcagttttgggcattttctaagggagggcaatgaacatcctgataggtttaactaaggttttaaaatgtccaattttacgtgtggtttttaaccacacctgcatcctaattacgaccttggctgttatagcttataggtttaggcaatctggatatagttgtagcaaaggttatttttgattcgagacatgccttgcttcctctgggcagaggaagaaaaagctccagtgatgatggaggactggagaggggaggtcagattcagttttgaattttaagtccatttacctgacatcatatttgttatactctgggggatatcagggagccggcaaagcaaatgtccacatgcttcaggcgataggatggtcaggtggcatgtgactaactgtcaggataatagtgcaggtgctacatggagagtaacactcaggagggagcagttcaggggctggatgagtctcagaagacttggtgtgtgtgcaggggtcttgtgaactgggattgggcggggacgagagacagtgtgggtgttgtaggcaggggaccggcactcattgttcaggggtcccttcatttagcagacattcactgagcactggatgtgtgccaagcactggcctgggcacagtagataccaacaagagtgaagcagagtagagaaaagagcattgaaagccagagtggcccagtgctcaggagcatggtctgctatgtggttgcctcggcttgaatcccagccctgccactgactagcttgtggtgtgatcctgagcaggttgtgtactctggagcctgtttcctcatctgaaaaatggggatggtaataattgtggcagggattaaatgagttaataggaagtactcagaatagtcttgaatatagaaagtactactgtgtgtaggatatttattgtcactggaatattagctccatgacaggcattttgtctgttgtgttcactgctgtagaatacatcttgtacatagtaggcactcagttaatgaatcaaagcaacactggtgtcctcaaggagcccaggagcctgtgctctggtggggacacagccatgtcaatgaccagaggatactgtgcaaatgctttgagaagggaagcatggggcctggtggggcacagaggagggctggccaggggaggcttggggttggagagcccgagctggatcttgagaaacaagcagggatttgttggttgacagaagggagtc

SEQ ID NO: 64464 - DNA, 1764 bp, Homo sapiens
ttaccctcctgaaattgcagatatacgaggatagagggctggttggagttgggagtgagtgggggattgtatggtgaggctgggaggagggggataagtcagtggtcagagtcccagggaagagaaatgatttcctacccaccaaagaaagtgtttggcaagatttttttttttcaacacattttgacctggggatttaaaaaaatatggttgaatgctatgaagctaaatatctataataactgtaccccttaatgcatttctagatgtaattggtggtacttgaaattatatccacttatggaggttttgaatattttttttagctttggtgtgtagatgggagctgaagagagctcagtcggtttttgcttcaacttttccagcccttctcacctgaaaatgtgtagacgtgtttgtgtgtttggcactggatggttttgaaaattcagaggggatattaattcttttggggaaaggaaagtaattggcttcctgttctgtgaatacatagatatttaaattagaaccccaagtacactctttactccaaaagccgcatgtgtctgaggagcctagtgacatacgatgtaagaattgtggggtaatcttgccaggcctttccaggttgctccttggggagggaggtcttggttggtgctgattgcctccttgagtcagtggaaaggtttgagagtttgtttgtttgtttttttcctgaaggttcgtgttgggttttgctcagttcaagggtgctagtgagctgaggggtggggctgtgaggctctcacactgagaagccaatggcttctacttatttgtttattttacaaatgtttatctggtactgacactgttcacacgtacactgttctaagggcttcacagacacagcctcctttaatcctcatgccaaccttataaggtaggtacggttatcatcctcattttacagatggggaaactgaggctcagggaggttgagtccagtaattggatgcacaggtgtaaggcggcagagctggggtcacccagcgttccctatctggggttctcatagtctctctctgtccagcttggcctgtctccaccatgttctgtgacaggctgtgccgtggagactgctccagtttatttcaggaagacactcgagcttcgcacaggtcagagtccatgggcatggtgagggaagagagggtgtagccagggctgttagtctgggactcactggaagcaaactgcatgcggccttctgtcgagtcagcaaccccttttgggtttagtaggaattgtcacctctccccccagcacatgcacctgtagagaagcccccaggtgttgcagagagcccctgagggagggtataggctgtgctggggctcagagacctggagctcagaggctagctgaggcaggctttggggtcttgctatcttgcctcctgcccatcgagtgccaggtgagtgaaggaagtcactgtctggttagctgcattctccctcctgtttctggggtctgagagaggagacagattgccggtctttgttttggacttgactccctctagagatggaacccccaccctagccccactcagacaaagttaagagaatattgggaaaatgggctcttcttcacagtggaagggtttggcattttgagactcagcatgaaaacctcactctaatgctttcctgaagactctggggtcattgctcacctccttgtccatggacatttctgatgggaggaggaggaggtaga

SEQ ID NO: 64465 - DNA, 1088 bp, Homo sapiens
cttgaggagtgtcatggctcatgcctgtaatccgagcactttgggaggctgaggcaggtggatcacttgaggtcaagagttcaagaccagcctggccaatatggtgaaaccccatctctactaaaaatacaaaaacaaaaaaaattagttgggtatggtgatgcatgcctgttaattccagccactcgggaggctgaggcacgagaattgcatgaacctgggagacagaggttacagtgagccgagattccaccactgcacttcagtctgggtgacagagtgagactctgtctcaaaaaaacaaaaacaaagacaggtttcttgtacttaccattgattgacacatttgatttatactccctgtccatatcccccctccagtggagaggattcccacatgtgagtattagggtttgcatctggttcttttgtggggaggcagtaaccctggtgtctgtattagaggattggtaaggggcagtgagggtagacatgaattagagcttctgtggggtggggctgggagtcagcatttatcacaagctccacaggtgattcttatggacactgaaagtagaagcatctctgagcttcagcttctctgtctctagaataatgatatatttttctccctagtgttatttaagaatgaaatgcgatagcctgtctgaagctcctaccatgctattcagcacatgataggtgctcaggcattgtgagtctctttccttgtagaagaacatctgtctaaagtcattgggttaagctgtgcaaaaggctttgagagagtatcagtggggtacagctgtctgaatgtacaccccgttacccaggagggagcctgggaagccaggttcctggggagcctctggttttctcagtgtgggttgggaatgtgctgccttcacctctgctgagatgatgctgtcagtcccagttagaaatggtgggactgagcttgtgagtgaccactgaatgaggcctatgtctgcctgggggtaggtgtgcagctccacatcttggaaccccgtgaccacttagagatcctgcaggcagaggagggcctggggtgacaagttgttctgagt

SEQ ID NO: 64466 - DNA, 1238 bp, Homo sapiens
agagcctcgccctcttgaggtctcacagcttggagttagtgtgcagtctcttcctggggctgctggctacctcttgtagcttggagttagtgtgcagtctcttcctggggctgctggctacctcttgtagcttggagttagtgtgcagtctcttcctggggctgctggctacctcttgtagcttggagttagtgtgcagtctcttcctggggctgctggctacctctcgtgacttcctacatcacactctatggtgcagggaaggggagcagcatgcttgggggatggaggggccagagatcccattccagccctgtaccaaggccactggctgcacagcttcctgtgttctctcccgctgggtgaggcgggagatgagcttgtcctcgtctcggaagaggggagccagagcaatggtttaggttcgttcactcacctttgcaacaatcatatcttctccacttgcaaattgagctgtctgtgcctgtccacagatggaatgagttggccatcttgaggggtggtgggcagcttattagaggagcagtttaattggaggctggttggcttttgatcaaggaattatctgttcagtcaccagactccaattaagcagctactctatgccagacactcggtgctggggagagaaatgaagctcactgtttctgccctccagcagtgcccagtccaagacaggagaggaatgctggacagttccaatatgggtgcctggggctggggagcttcggagggtgaccaaggaaggccaggcagccatggagcagagcagtgagcagcccaaggcaggagagaccaatgcagaaaatgtgaaggagctggggattaggggtgagggccatggtacctgtgtgcctgtttgggtctcagagaggttagtgctgagttgaggagtagggacagaccttagataaaatccttcactagtagcttggctgcaggagtgtggtgtatgggagctatgccctagagggctccctgaattcctttgtctatagggtggtgccacatggtgtttacaaaacatggattctgggatcagagtgcctgggttgaaatcctcactctgcttttagctttggcaggtcacttgaacctctctgtgtctttagatgtttcttcatctgtaagatggggacaatgactgtacctatcaacttagaatggtatctggcaacttgtacatgctatataggaattagccattatcactacta

SEQ ID NO: 64467 - DNA, 1898 bp, Homo sapiens
gagttgtgagttgtgccggatcacttctctgtctcatccagccctcttcaggatactggcctgggcagcagggttggtttttgttgaagcccaaagcacagctaggcaacttcatcatgcagaaaaatgtatgaaaagggcttttgatgtgggtgacagcatgtgtaaagagacggtatccaagtgtgtggactttggagtcagactacctagactctaattcacctccaccacatacagctccctgaccttggcaggttacctgctctctttaagcctcacttcctcaccagtaaaatggggttaaatgtgaggattatgtgagttaattgatggatggaaagggtttagcaagtagtagtgccacgtttactggcacattgtaaatgcccaataaatgtgagctcctcttctgtacatccacacagctatggggcagggtgaagacatgacttctgagtcctaattgcattcattggctgcagaagtctggtgcccttgaactaggattgccggagtcaggggcatgcaaactgtagaactcaactcagaaattggtttggaccaataaaaactgcacaaccttgggctgggtgtggtggctcacatgtgtaatcccagcactttgggatgccaaagtgggcggatcacctgaggtcaggagttcgagaccagcctgaccaacatggagaaaccccatctctactaaaaatatcaaaattagccgggcactgtggcgcatgcctgtaatcccagttactcaggagactgaggcaggagaatcgcttgaacgggaggcagaggttgcagtgagccgaaattgcgccattgcatgccagcctaggcaacaagagcgaaactccatcacaaaaaaaaaaaaaaaaaaaaggcacaactattctggtacttaaaggatgtccttattcttggaaatacacactgaggttatttgctcttaagtagttaagtggtgtgggggaaaattgtgttggggggaaggagtggatgacagagcaaatgggacaaaatattaacagtgggtgagtctgagttaggagtggcccctggtttacctctttactgggcagttagaagtctgcacagatgtctgcttcttaatctgtgcagccacctggttatcggctctgaccactaaaggacaaatgcattgtctggcacgtctcacgtcacaggtgtcaacaataataatcttcgtggtgctttctagttgaaaaatgcatttgttgtagaggcagatattttgattgtcctcattttacagatcaggcatttgaggctgatgggggcagggagtggtggttaatagatcttcccaaggccccagcatcaccgaggggtttaagacttgaaccgaagtcttcttggctccaaattctatgcagtttctacgtggtacatggtgccttgtggctctcatcatcactctttctgttccttttttttttttctttaagtgttgaggttttgttctgttgcccaggctggggtgcagtggtaccatctcagctcactgtaacttcaaactcctgggctcaagcaatgcccccgcctcagcctcctgagtagctgcgactacaggcgtgcactgccatgcccagctaactccctctctactgattcctccctctagggttatccctcagaagcagttctctgcctgcaccttccctgatgactgtgaggcagaagcccccttgggcctccctcagaaaggcagggtagaagagtgatggatggtgcatagtccccacacagaactgtgagccagtcgctggtgctctgggaagtggacctcctcaagctggagaggcaccctctcccgccacagatgtcagctgaccttagcttaggggcctatgagcttcttaagcctgctt

SEQ ID NO: 64468 - DNA, 1049 bp, Homo sapiens
caattctcttgcctcagcctcctgggtagctgggattacagacacccaccaccacgcctggctaatttttgtatctttagtagagacggggtttcaccatgttggccaggctggtctcaaactcctgacctcaagtaatctgcccaccttggcctcctggaagtgctgggattacaggcgtgggccaccgggcccagcctccattctcttttgatgtctatgggagtaaatttggtgcttcctaaattgagaactttggaaaaaaattaagacagcactttaaacagaaacgtgtgcaggggcagggagatgccagtttaccccccccgttaagtctgaggtgacagagggctgtaggaagactgcttgttggcttttcagcctcaatatgtggaatatttggcaattcagtgaggtacctgctcttgttttctatcttcagaggacagcacaggtttgaatctctttgctcagtgtaagacagcatcatctcagcaaactggcaggtatcttaagtaaatattggcagagggaaaaacacggaggaatatggttgtatttgcctgttgtttttaaatggctgtcaaaacatttgcttttcaattttctgaaatgagaaatattttgagttaatgttttatcatttacagagtatttcacgaacattctctggtttgtcccataattattgcatttttttagtgcgggaatttgggctcagaggggtaaagtgacttctctaaagttgtatactgggctgggcatggtgactcatgcttgtaatcccagcactttgggaggccgaggtgggcagatcacctgaggtcagaagtttaagacaagcttggccaatgtggtgaaacctcatctctactaaaaatacaaaaattagctgggtatggtggtgcgtgcctgtaatcccagctactcgggaggctgaggtaggagaatcacttgaacccaggaggcagaggttacagtgaactgagattgcgccattgcactccagcctgggcgacaagagtgaaacagtgtcttaaaaaaaaaaa

SEQ ID NO: 64469 - DNA, 1045 bp, Homo sapiens
atagtcccagctattagggaggctgaggtgggaggatcacttgagcttgggaagcggaggttgccgtgaactgagctcacgccactgcactccagcctgggcgacagaatgagactctgtctcaaaaaaaaaaaaaaaaagcatctttagagatcctaaaatgtaaaattttgttcttctgtagtttttcccttgacttgtcatttaaaaaaaaataaaattgctatttatgggcatggtggcgagtgcctgtaatcccagctacttgggaggctgagccaggaggaacgcttgaacccaggaggtgaaggttgcggtgagccaagattgcaccattgcactccagcctaggcaacaagagtaaaactctgtctcaaaaaaaaaatttttttttctatttaatgtaattctacataaagaaaaattaagtttaaattattagcataaattttatagttatttctatattgtagaatataatgttttaaatgtgaatatcagtgcatttacctcatatgctaggagttgccaccaccatgccccactccaagacaccatagagcacaagcacctgtatccatgcccccctgggcagcagggaggagcagggagcccaggcagggcttagggctccaggaggctgggagtgggcagttaagaacctggtcctccgaggcagggagtggggaccaggcatgagtccttcagaaggttacctctggagataatgccaagtatcaagggtgtgtgttttgtattcagcaacccattttttagtctgaaatcaaagggagttggagagtgaaggatgaaccaaatgtgacagatgttcagttggggattttgtagacaccaggcctagaaggcccttaggaaagccagtgaatactggacagcccaggaggctgcccttaattatgacctcacccaaccgacagtcttctgggccacccctaggaaggagtctgtcctgtcttctatattttcctccctagataaatgttgaacttcatggcagtgaaatttatcttgtagaatgtcaaac

SEQ ID NO: 64470 - DNA, 1100 bp, Homo sapiens
gggctgctcttcaggggtttcatggaaccttgtgaattccgttccccctacagcaggcattaaataggtcatgaggcaatgaggagatggcagagaagaggggctcagccaccttgcctgtgccaaggctgttccttgaaggcaggcatcttattccccacttctgtgacttaggcacccagcccagggctgggagctgagtaggcacttggcatctcttgaggaatcagtgttttaaagagacccaatgagttttctaggtattccaggtcttggaaaactccttactgggaaggagattggggtggaggagaataagcaaggtgagagaagctcaacagccaggaacaggcctgtcaaggctggtgcctagacccaggcttcttggatacagtcgcttgctgttgagaacaatgctcaaagcaggaagctggctggtggaggctcaaacggcctcctctgcgtcttcatttcatatccttattgctctgcatctgggactgggatacctgttggctactggactaggctgtcttccttccctggctgctgggcccttggcatcatctgtgacttggcacaagggtgctggcaggaaccagctgattgcacaagaccctttctagcttcaggtttctcagttttagctttggggttgtgtggagccaccctgtgtaggtactttcttcttgtgggtgcctgtccccaagtgaggacagctagactctgggaaagacatttctgaggcttggagtaaggctaactttcccctcccctaggacctgaagcaggtcctaggggcaggactggctacataatttgcagagcctcagtgtaaaatgaaaatgcaaggctccttattgaaaaagaaggaaaaagtattagcttggtgcaaatgtaattgcggttagtgctattacttttaatggtaaaaactgcaattacttttgcaccaactgaatatctttaggccgggcgtggtggttcacacccagtaatcccagcactttgaatggccaaagcaggaggattgcttgggctcaggaatttgagactagcctgggcaacatggtaaaaccctatctttacaaaaaatacaa

SEQ ID NO: 64471 - DNA, 1351 bp, Homo sapiens
cagcaaatgttttaatactctccagagtccatttcttttctttcttttctttttctttctttttttttttaaagacagctttgctctgtcgcccaggctggagtgcagtggcacgatctcagctcactgcaacctctgcctcttgggttcaagtgattctcatgcctcggccaccccctaagtagctgggactacaggtgtgcacaaccatgactggctaatttttgcatttttagtagagacagggtttcaccatgttggccaggctggtctcaaactcctgacctgaagtgatccgcctgcctcagcctcccaaagtgctcggattacaggcatgagccactgtgcctggcctcggagtccatttcttgaagcagaaaagcttgaggttaggcaggtgaatttttgttttgatttctgcactttttgttcaattttgcattaatgagggacaaaatgtataagaaatctactgttggttctcccagttctagactaagtgatgttgataacccctttaaaaagattttttggctgggtatagtggctcatgcctgcaattccacactttgggaggcggaggcgaggggatcacttgaggccaggagttcaagatcagcctgggcaacacggagaggcctcatctgtacaaaaaatgaaaaaattaatggtggtatgctcctgtaatcctagcaacttgagaggcttaagtgtgaggattgcttgagcccaggagtctgagtttaccatgagctatgattgtgatactgtactccagcctggatgacagagtgagaccctgtctgtaaataaataaataaataaataaataaaacgaagactttttgtactctagcacttctctactatgaatcccttagctgggtagcaaggtataatagtaattgtgataatagtgtcattaacagaagtagcaataatagtagtaataattatataacagcctaatctttttgggtctttgaaaaatgctaggaactgttctgtaactgtcattgatttaattctcacaatagtttgatgaggtaggaactactactagtttcgttttacagacatagaatcttgccgtaatcctggacattcctatagcagatggttttttttcttgtgtcttttcttatttgatccttatagcagcccctggaggcaggaggggaagaatcatccccattcttcagatgatgaaactcaggtccatgaaggttcaatgattttgctgaagtgttagagctgggactggaacataggtctttggtccctcatgtgatagccacagtagtagtggtagctcctaccccaggccatgcatcttgaaggagatgaatgc

SEQ ID NO: 64472 - DNA, 3376 bp, Homo sapiens
cccgggctcgttggcgcgcgctgcgccgcggccacactcaacgttttgtgtgcccaagttgtttggcggcctccgagaggaaggcggtgggggccgcacctacgctggggacctgggccgggggggaagaggccgcagactctgcgccctggaccttgcaatccggctggattcgggtgctggtgtgcgggctgggcacgcctcccctctagggtctggggctgcgccccgccgggagaggcgagtgccgggacctggatgggctcgggtgggaggagtagaacgagaagttctgtcctggtgtgggcctgcggggttggagtggggagagggagagactaggggaatctcgcttaggaggacgccccctctcccgccgcaggctctgggatggtcttggagagtcggaacctcgcccccggcctccatccactgcgcgggcctgcggggagggagggggtggggaagggaactggtcaaccaatgactttcctcgagcgctccgcgtctcttcggccggagctgaaccgggggattgctggtgcttccgttagtccacgggcgacttttccgcaaaagccccggagtgttggcgcaccagccaggttaccctgggtctgtaggatcagtccatgtcagattggggcgcagtaagtgaaggcgcgggtcaggctcctatgccagtacaggctttgctttcccactccggcgggagtctgtgttgcagcgtgtttccctctgcctgctgagctccgggaggccagacactgcctttgaccccttgccccagtgccggacagcaagtaggcactcggtaaatgtttgttcactgaatgaatcagctcgccaaaggtctggacggtggtctgactagtactgactgggtgtacctcggcgactgtgagtcagaactactactgttaggaataaagcagcctatttcaagaaaaccccggaacctccttttctggtttgggttcttgcataatagttgaaaatactgatgggtgagatttacagacctaaggactagggccttgctgcggttctattgccctgcctcatatgtgtgtatgtgaagttggggagttggctggggccatcagagtcttgctgtcagtgggcctctctggctcataactgcatcagttgatgttattacaattttcctgtgtgccacacgttcacacgttgttctaggcattgggaacaaaaaacagaaaagttctaggtgctcatggagcttgcaatctaataggagagggaagggagtagaaaataagtaaaaaacacaaataataatatcagatcgtggttactactgtgcagaaagttaaaataaggtgatgtgacatggagtgactgggtggcttggttgtactgggagatcgggatggtgtttctgaataggcaacatttaaagtaaaatttgaatgacaagaaggagacatcatgtgatgatgagttggcaaagcatttcgggaagagcgaacagccagggcaagggcttaaggcagaaaagagcttggagtttaaggagcaggaaggctggaatgtggtgcacaagggagaaagtggcatgaggagaggtcacaggtaggagaaaggtaaatgccgcaaagctttgtgagccggggtgaggaattttcatactttattctaagcccagtgaaacgtcattggagggttttaagcagggaaatggcatgatttggtgtgtgtttttagaacgatcactgtgaggagattggattgtaggtggccactgcagggggaggcaggagagcagctgaggctgttgccctcttccaggcaggagttagaagtggcttgcctgagggtggtagcacagtagacagggagtagtggtcacattcaggctgtgtttaggaaataggctcttcacaccttcatgatggactgaatagtctgtgggagaaagagaagaggcaaagatgactcctcagggcttgggcacctgagtggatagcattcatatcgttgagatgggaagagccggtttggggtggaggagaatcatgagatcttgttttgccatcttacatttgagatatgagtatgtcagatagtgtgatctgaagcttggtggggagagaggacagaagagacccattgggtataatagatgttattcaaggccatgggattagatgaaatcccctaggaagagagtacagacagaagagagatgttctgaggctttggatggtcaaagcagtgtttagaggggtgagaggtgaagccagcaaggagactgagaaggactgagaaggtaggagaaaccccaggagaatgcatggtcacagaagccttaaaggacaaaatctgactggagtaggtggaagataaaacacggggtgaagacagggagtcagttaggcaaatcttccaggtagttttgttgcaaagtggagttgagacattagccggtaattggagaggatgtgggtttgagggagggttcttttttttggtgggagattgtacagcatgtttgttttgatgggaatgatcccactgagaggaagaagtcgatgctgcagtaaagagacggggcagttgctggagcagtgtttctaagaaggtgagagggatgggatccatggcctgcatctcactagcgtcacccaggggcagggcccatcattcatttggcgggaggaagggctgcaagtgtcccaaagtaccaggtgcagccttgggctgggtgtgtgaggccgcgtgtgggactctggaggctggagcacagccttccacacctttgctgactcttccatggtaacttgtctgtgaggtccctaatgattttcctacagtgagctcctgtgcccccagggccttggctgactcctcccaggcctagaaaaagcaatgtgtgacagtgttccctaccctcaaaggcagggccctgtggcaggtgattgtacttctgacgtccttctgtgacaattttttgagagacttaagggttttgggagtaattgttctctccctcatcccccgccccccacatgaaaaatgttttactgttgtctgatttcttagctttgccgtgagcatttctgaatgtttgatttttgtgttgagggcaggagcctcctctaatctggctcataaagtgagagcgacaaagcattgacatggctgattttatttttcctaatggctccttgcacaggaaagttgtgtgaggttttacaggatgtattcagttgctcctcatatttagcagattaaaacattttaatttttgaaaaaattttaagaaacagaatcttcctctgtctcctagtctggagtgcagtggtgcaatcatagctcactgcagccttgaactcctggggccaagtgatcc

SEQ ID NO: 64473 - DNA, 2661 bp, Homo sapiens
cgtagctccgcctcctgcgtgagaggaagcggggacgtgtgaggtcacttcctgcgtgttgggtggcttcctgcggcgtttccactctcgctctcctttcgttgcctgatcgccgccatcatgggtcgcatgcatgctcccgggtgagctcggggcatcaagccggattgctgggcggggggtgggaggaagacagggagtgtgggcagcgggccgaggggatgatgttctgggctgctctggcactagccgccacctcacctcgagactgcttctctccccaggaagggcctgtcccagtcggctttaccctatcgacgcagcgtccccactgtaagtagcgcgctgggaccggggagaatccggggagggggttggcatttgtctcgggtgaagcgacgccagggtgaggaacttgcgtgtatgaggagcgcggttttgcggaaggagagaccgctgttctgcggcgccattcctgggttctcatcctaaggctgctttctattccataacagtggttgaagttgacatctgacgacgtgaaggagcagatttacaaactggccaagaagggccttactccttcacagatcggtgagtgtttgtgtctaacatagcctatttcgcctgtcctcgtgtgacttgtaggatctagtaggtggtaaagttattttaaaaatagccaaaactctggtctcgccaccgtgctagaggcatcattgtaagcacttcacatgtactgatttcgtttaattctgaccacaatactttgaaataaatcttcatggctttcaccccagtttacagttgaggaagcagaggcacactgccgctggatactaaccagccccaaatcacacagctgtcaagtggaggagttggaattggctaagcagagtgcctgacacagttcctcacagttaggtgtggtttgaatctcagctgcgtgtgacttcgtgcaagtggcttcattcagcaaatgtttaccttctatgtgctgaacatggttctggggcctgagaacatactactctccgactcccccgcccaaaaaagccagccgcaatgtgcctgtagtcccagatacttgggatgcagaggtgagaggatcaccagagcctagaagtcccaggctgcagtgagctatgatgaagccactgcactcctgggtgacagagagaccccacctctttttttttttttttttgagacagtcttgctcttgtcgcccagtctggagtgcagtggcgcgatctcagctcactgcaacctccacctcctggattcaagcgattctcctgcctcagcctcccgaataggtgggattacaggcgcccgccagcaggcccagctaatttgtgtgtttttgtttgagaccgattctcactttgtcacccaggctggagtgcagtggtatgatctcggctcactgcaacctccgcctcctgggttcaagcaagcaattctcctgcctctgcctctggagtagctgagactacaggccgcaccaccacgcccggctaatttttgtatttttagtagagacgaggtttcaccatgttggccaggctggtctcagactcctgacctcagatgatccactgcctcggcctcccaaagtgctgggattacaggcgtgagccacaccacctgatcccacctcttaaaagggggaggggggtgcaaaatatctgtactcctggagcttgtagtctaattggaggtatgacacatcaaaagaaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacgtgattcccttttcaggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattgga

SEQ ID NO: 64474 - DNA, 1057 bp, Homo sapiens
atgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaagaactctgctatcatttctttccttgttgacatactaacatttttggttccagactttgcaatgagctcactcttgatgttctttgcatctcacccaggagtctattaggtttaataatcctgaatttcagaactaacctgttagttgcccctaaaaatgttcaaatagagattctgacttctgagtgttaactcttttttttttttgagacagagtcttactttgtctcccaggcctggagtgcagtggcgacatctcggctcactgcaacctcca

SEQ ID NO: 64475 - DNA, 1095 bp, Homo sapiens
cagaatctctatttgaacatttttaggggcaactaacaggttagttctgaaattcaggattattaaacctaatagactcctgggtgagatgcaaagaacatcaagagtgagctcattgcaaagtctggaaccaaaaatgttagtatgtcaacaaggaaagaaatgatagcagagttcttttattccagaaatattttaatacaatcgtagtacagttatgaagtcacattcaatccactgaatatattcaaggtattaataaaaatattatacatctttattcactatcttaatataattaaagtatttggttcttataggtaagattaattaccatattcattcatatatgcactgctagtcaaacaacatggaaatgaatgtatggattatgatagtgggggttcagtcctttttgatctgaagtctaagtttcaaaagtgaatgttttcttttttaaatgtcacaatatttgaatcctagaaagaataggcaactaatttaaggcaagatattgaaacttttatacaactttaatttgaaaaaagaaatgatcaaagatcatacatgccttaacatttagatacctatagattcatataaaggcagtaataaaaatatcagtgcaagttctacattgggttcctcagtagagaaaataataggttctttgagtgaaccattatcttcaaatcccaaaacactggcaagaagaaataattcttctgatgcaggacaacatgtagcataattatttttagtcaataaaggtgagtataaaatattgtgattatacataaaaattagtgtcttggccagtttgttaaactttttttagatttactttaatgtcagcttttaaaaaatgcttaaaaatccaactgatttaaaatttattgatagtagtagtgcaaagaggctccactctactttttggtacgggctgaagattagcatttcataaagaaataaactatatgtaaaatgtatgtgtgtttgaatgagtaaagaaggcacaaaatgagttaaattaagagaaaacattaccacttgttctgaactcttaactgtacagtattataatatacacttaga

SEQ ID NO: 64476 - DNA, 1037 bp, Homo sapiens
cctcagcctcccaaagtgctgggattacaggcgtgagccaccatgcctggcctctagtttttattttttagctaatgattagtcttgctttgtatctctctatgtcagacatcacaggaatgatagtacaatccaagactcctgaaacacaaaatgtccttctaaagtattcagacaaaacctaccggatgtgtcataatcagtgtcactcattgtggtcactctttggctaatattctcacgttttcacttgaaatgttccaagaaaccaaacaaactttaatttgtgatttactgttcttttttcctttgttgtagcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtttgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaa

SEQ ID NO: 64477 - DNA, 1037 bp, Homo sapiens
tctgagaatgggaggagagtattctttctaagccagtctatttctgaataaatataactttcctaatagatgtgattactaaagaagtataaatcaatgacctatcaggttgtttactcctttttcccctcccttctgtccgcaccacatgtgacagtcttgaaaataaagcaaaatccttttattgcagcttgaaccactacaaccagtaaataaagatgaaaatatttgtattttcagatgcaggttccttcagtcctactccaggccaaataggaggagctgtgaaattatccatctcttaccgaaatggtactcttttcatcatggtgatgcatatcaaagatcttgtgagtgattacaaagaatgatggttgtagaggaaacccttaccttggtaggaagcattactattaagggactgcttttctttttaggttactgaagatggagctgacccaaatccatatgtcaaaacatacctacttccagataaccacaaaacatccaaacgtaaaaccaaaatttcacgaaaaacgaggaatccgacattcaatgaaatggtaagttaaaatcatttctagaagtttccttggtttattatttttttaattttcatttttaagttctgacgtgcgtaagcaggatgtgcaagtttgttacatagctaaacgtaccattgtggtctgcatacctatcaacctatcacctaggtattaagcccagcatgcattagctatttttcctaatgctctccctcccaccatcccatcccccaacaggccccagtgtgtgttgtccccttctctgtgtccattgttttgagattttaaattttaaaacattttaaggccaggcgcagtggctcatgcctgtaatcctagcaatttgggaggccgaggtggatacatcccttgagctcaggagtttgagaccagcctgggcaacatgatgaaattccatctctacaaaaaaaaaaaaagaaaaaaattagctaggcatggtggcacgcacctgtaatcccagctcctcgggag

SEQ ID NO: 64478 - DNA, 1048 bp, Homo sapiens
aagtagctgggattacaggcacgcaccactatgcccagctaatttttgtttgtttagtagagacgtgcttttactatgttgcccaggctggtctcaaactcctgacctcagctgatccacccacctcggcctcccaaagtgctgggattacaggcatgagccactgcacccggcctggaaagaaggttttaaatataaattttatgtgtttgtggtgtgatttcttttcagatttatgtagtccgaattttgagggaaggacagattgaaccatcatttgtcttccgaacatttgacgaatttcaggaacttcacaataagctcagtattatttttccactttggaagttaccagggtatgtattcatccttgtacattaatcctttttgtaggaaacaacttgttatcaaatgtaggtagaaagctttgtgttaacacttagtaagatattatcggccatgtgtggcttattttcctttgtgtcataaagacctaatacaaaagcagacataaacaaggaactggaagtttttgttgaatgaataaatgatcgggatgttaaaatatgagattttcagacttctaactcttattgaagctttaactttgctgtctctaccatagtaagcaacacaagataataatttggcatcttggttttgaaaaaagtcatatcctgccaggtgtggtggctcacaagcttataatcccagcactttgggaggccgaggcagggagataccttgagtccaggagttggagactagcctgggcaccatggcgaaaccccatctctataaaaaatacaaaaattagctgggctggtggcacatgtctgaagtcccagctactcaggaggctgaagtgagaggattgattgataccaggatgtggaggttgcagtgagcgaagatcacatcactgcattacagcctgggtgacagaatgagaccctgtcccccccccccaaaaaaaaagtcatatgctaaatcagtgtagaaataatctatcatgggccatactgagctcctctgctaaaaaaactga

SEQ ID NO: 64479 - DNA, 1086 bp, Homo sapiens
tagcctggatgaaacagcaagactcagtctcaaaataaaaaattaaaaaagattttaaaatggcacatggcactgtagaaaaatatgtttttatcattgaaattacatattaaataaaccttgagatattttgaggcaaataagtatattttaaaaaatattattgcaaatcctttgtatttattagtaaatcaacttttgacagcctactatgtgcaattactatgaatcagaatttgttcctataaattagaattttgataaatagcatttgtttaaactaaggtaaaacaaatcaaagcaatattttatgttccttctgcaatatacttaaatatgctttacctagtaaagaaaattgtagcttctgcgtctgtagtttggggttgaagtgcatctctaacgtatttcaaatcttgaatacttgtaagttctggtaaccctgaaggaatcatctgtagaagaaaacaaaaagttctgtgagttaaattttttaaaacatttgttcctcactccttcctgtgggctgctcaagtaatcagaactaaagcaaacaaaaataatcagtcttgaggggttcattagtgtattggggacctaggtgattatctaacaaataaggaaatggacaccaaggaagtcaagcaatttgttggtggtggtcaaaaacccagtttatagaattaaacctgtgagatccagatctccttttgtctaggctctttttttgggggcggggggggggggcagggagccgggtgcgatcttggctcactgcatcctctgcctccagggttcaagcaattctcctgcctcagcctcctgagtagttgggattacagatacgtaccactatgcctggcgaacttttttttttttgtatttttgatagagatggggttttgccatgttggccaggctggtctcgaactcctgacctcaagcaatccgcctgccttagcctcccaaagtgctgggattacaggcatgagccaccgcgcctggcctaggccactgtttttacttttatagatttagggggtacaagtacaattttggtacatgtatgtatcacatagtgataaa

SEQ ID NO: 64480 - DNA, 1050 bp, Homo sapiens
gtcatgaacccaggaggcggagcttgcagtgagcctagatcgcgccactgcactccagcctgggcgacagagcaggactctgtctcaaaaaaaaaaaaaagaaaaaaaaagaaaaatgttattttaaaattatggaaattcaaaagtgtgtggtattaagtttcctagttggaaatggctgtacctcagatagcttagtttaataatcatgtaatagcactattggagtatcttctgtaaataatattttgtatgtactttcattttaaatagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactggtaactattctttataagcacttaattagttttatattaatgcatctatgtttcaatacttaaaaaagattattttgtgattttggaataaaatttgctttagtcacaaatgtcagatacattattgctcagatattttaaacttactgccgtgtgaaataagccagacacaagagtacctactgtctgactccatttgtataaaatacaaaaaataagtcagtagagtggctccccttgggatgggaagtattagtagctggaccccaaggcaggcatctgatatgctaatgaatgttttgtgtattaatatgggtgtgaattgtcaacattcactcagctgtacaatgaagatttctgtactttcctgggtatatattatcgttaagtaaaaagtaaaaaacacgaacccactatgattattatgagtaaattgatatggtaataaacagaaggctacaattgtcttaagtgaaataactcagaaatagaaagttaaatattgtgtgttctcacttataagtaggagttaaataatatgtatacatggacataaagagtagaataatagacattggagacttgggagggtaggaagggggatggtggatgggagatga

SEQ ID NO: 64481 - DNA, 1057 bp, Homo sapiens
gtggcaggcacctataatcccagctactcaggaggctgaggcaggagaatcagttgaacctaggaggcggagattgcagtgagccgagatgacccctctgcactccagcctgggtgatagagcaagactcagtctcaaaaaataaataaataaataaataaataattgaatataattcacataccataaaactgaaccttttaaagtgtacagttcagggaactgagatatgaagaggttaagtacctttccctagaatgctgcagaaaaataaaaaggcagttcattttataggtgtgtgcaaccatgcccagctaatttttgtgtttttagtagaggcggggtttccaccatgttggccaggctgatctcgaactcctgacctcaggtgttctgcccactttggcctcccaaagtgctgggattacagctttcatagtatgtaatctgttaagtcttttggagatgtacaagtttcattttgtttccttgatttcaaggttggtgaagatcttcggcaagatatgttagctttacagatgataaagattatggataagatctggcttaaagaaggactagatctgaggatggtaattttcaaatgtctctcaactggcagagatcgaggtaagtttattagctgtgtcttgatgtcttatttttttccttgaacttagcttaaagtgtacctgccgtaaacatcctgatgcagataccctggtatcacagttgtttcttattttaatccagtgttactttattgattcagttgctcataattaagtctctttgaaaaataacttagtggccgggcatagtggctcatgcctgtaatcccagcactttgggaggccaaggtgggtggatcacatgaggtcaggagtttgagtccaacctgggcaacatggtgaaaccctgtttctactaaaaatgcaaaaattagccaggtgtggtggcgtgcccctgtaatcccagctgcttaggaggctgagatgggagaatagcttgaacttgggaggcggaggctgcagtgagccgagattgcatcactgta

SEQ ID NO: 64482 - DNA, 1024 bp, Homo sapiens
gattgcagtgagctgagattgcaccattgcagtccagcctgggcaacaagagcaaaactctatctcaaaaaaataaataaataaaatgaaaaagcaattctcatgtgttatttcatttgctgtaattcaaaggaacaggtgtttagctgggcatgttggtgcatgcctgtagtcccagctactcaggaggctgaggcaggaggatcacttgagcccaggagttagaggttgtgggaagctatggttgcatcactgcattccagcctgggtaacaaagcaagacgctgtctctaacagaaataaaaataaaaaataaatctaaaaacaagacacaaaggaagaagtgaaaggggaaatgcgtaggacaaaaaaaaattctaaatccattttcatttatctttctaatgcttaacatgttgtatttgcagtcgtgttccttcttcagttctaatgctgtccccctaaaagtcacaatggtgaatgctgaccctatgggagaagaaattaatgtcatgtttaaggtgagtaaataatgttactgttttttaatggcaatttagaaatttttttatcaaattactttcccaaaattgcaaaggtgattttgtttaatattttttttattatttatttatttatttttacacagggtcttgttctgacgctcaggctggagtgcagtggcaccatctcggcttactgcaacctccacatcctgggttcaagtgattctcctgcctcagcctcccaagtagctgagattacaggcacctgccaccatgcccggctaatttttgtattttttagtagagacggggtttcgccatgttggccaggctggtcttgaactcctgacctcaggtgatccacccacctcggcctcccagagtgctgggattacaggtgtgagccatcgcgcccagccaaaaattttacgtgttttgatcatgatttgtacattttgaagacaggatgaagaattttagtttaattcaatgagttggacacgtggaggttcataaag

SEQ ID NO: 64483 - DNA, 1050 bp, Homo sapiens
cagaaaattcctacaggtgaaatagctgagtcaagagcgacatgtatttttagttataatagttgttacattgctctacaaaagaagctacacctgtgtacacctctctccctaccaataagttatgaaatcgtttcctaacacaggatgttgttttaaattttcatctgataggtgaaaaactgcattcatttttgtttggcttctatttctttgactattagtgagctttaacattttcgtatacattggttggccaaatgtacctttgcccactatatttatagcctttggccattctagttttatagtaaaaattaactctctttagtaacaacctttttttcaccgtttgacaactgggcattttataaattgtatccacagcataacttgtctgaaaaatagatcttcattttcattatgtacttacagtatcacatctctttctataggttgttctccaaagaagtatggaacgagtacagtccttttttcagaaaaataaatgccgtctccctctcaagccaagtctagtggcaaaagaattaaatattaaggtgacacataaaatacttataagttcatattacatttgaaaataataggaagaaggcaaatgggcaggtatgcttaaggcaaatgaaggtaaaacctgcacaggttggttataagcatggatggttgtgattaggatccatatttatcttagcatatttttttacctaaccaccattcctgggaaaaaaaaagtataaaattatttactgccttgggcttcatttttttaaattggtctcacctttttatttatttatttatttatttatttatttattttttgagacaaagtctcactcttgcccaagctggagtgcagtggtgcgatcttggctcactgcaacctccacctcccaagttcaagcgattctcctgcctcatcctcctgagtagctgggactacaggcacacgccaccatgcccagctaatttttgtatttttagtagagatggggtttcactttgttgaccaggctggtcttgaactcc

SEQ ID NO: 64484 - DNA, 1075 bp, Homo sapiens
gggcaacatggcgaaaccccttctctacaaaaaaaaaaaaaaaaaacaagaattagctgagcatggtgccacgtgcctatagtcctagctacttgggaggctgcaatggaacaatcatctgagcccagggaggtcaaggctgcacttagccatagttgtgctactacactccagtctgggtgacagcaagaccctgtctcaaaacaaaacaaaacaaaaaaacgtgttttgttttctttggcttgtatttttgatctaatgattaaagtcaggaagcagttctgtaatccaaaccaccaccttgagatatatttctttgtagaaaatcttcaaagactattcttaaacttcctatttctagaagttgttttctgagtccttaccttttttgtgttctgtcctcaacaccattttccccaagataatgtcctttaattctccctctctttgttcccaccctacatttcaatacatttaccctacacctgaaaagtttcagtacaatgtggagagtgaatccttctgatatgttcttaaagatatcctttttatttagttgatctcatactaacttttcaaattcattacatgtgttgtaaattttgaattgatttttaaaatgaaaatcacattattatttttacatccgtgaaggtttttaacatgtggaactaaacttctatatctttggacttcatcacatacaaattctgttcctggaacagttaccaaaaaaggatatgtcatggaaagaatagtgctacaggtaatggtacttcttgacatgtagagaggtgtacatttaaatttcttcataaaatgtgtgtgtgtataccatgatttgggttgttaaagaaacctaactgatcttgttttagtctcaggatctatcttctattttaatatcaatatttctgagaagcagtaaaacatgcactgtacttatcccaagaaatatgtatgtgctgttgagaattaccaacaatggtaatcaattgcaacaagaagcattaatttaatattcaatgtaaatatgccccgattgctaagaaaaatctgttttcttaaagacaaa

SEQ ID NO: 64485 - DNA, 2639 bp, Homo sapiens
taatttagtgacttaaaagtgatgttttaatttattcaataaatatttattgagcaccatctgtgggcagtattcttagtaccggggattcagtagtacaaggcggcaaaaaacctgtactcttctggaacttggatttaaatggatattgatggtatctgaaggtatttcattacagggataataatcttcacattctccataggcacacacacacacacacacgtttgtacatagacacacacaaatatacatagggacactaatgaggtgaacaaatacccagtagaagacaatacagaaaacggtgataaaaatagaaagtaagtgaataaaatgctgacataaataggagtaaatggaataaagttgagaaaaataaccaaatagtttgcttaggggtattgtgtgaaccaacgaaatttgatttgaattaaatttagaatgataaataaattgtatatatgaacagagtggttaacatgtaaggctagcagtaagttagattaagtagaatacaattttattgaatctaagactcctgctttacaagattacctgactgtatccaaccagctgtgtacttggcaattagtggctgagtcactgcaatctaatgagagaattcaatagcatctgtccccataaatggaagactcccaatagactaggaagattggcttgatgcaagtcaggcacatgcttagctgactctatttcagtagcttagcaaaggaaaatgcacctagggaaggtaatgtttgtactctttctacctagaaatgaataaatacattattcagtgttgttcaactaaaatctgaagctaataactaactgagcacaaaattaaagtaaattggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagccgagattgcgccactgcagtccgcagtccgtcctgggcgacagagcgagactccgtctcaaaaaaaaaaaaaaaaaaaaaaaaattaaagttaattattcagctggtgttattatgaccatgctttaaactgggacctaggaacttacattcccctttttatcccctttaccaaacctcttttctattttcatagaatttgcagtggttaaatttcagatggacttctaaaaactcaaatgaaaggtgaccagattatttcagatattagtctctttggaggaagaactgctaatgtatttgtattagttaactaatttgtattatcatgatagaaatcaagttaaactttcttttctcagttatgaaaaatactacttgatatgttcactgtctcacaatggaaaggatctttttaaacctattcaatcaaagaaggttggcacttacaagaatttcttctatcttattaaatgggatgaactgtaagtgaaatttctggctttttattctttcagtgtgtcctgttgtttactttttccaatgtatgcatcctagctttaatttttattgcaattttcattgaaattcattaacttctgacttatgtcttaagatctctcttctagatatgattttatagaacagactgaaattctcattaaaaaatattaaataccgaccgggcgcagtggctcacacctgtaatcccagcactttgggaggccaaggcgggcggatcatgaggtcaggagatcgagaccatcctggttaacacggtgaaaccccgtctctactaaaaatacaaaaaattagccgggcgtggtggcgggcgcctgtggtcccagctactcgggaggctgaggcaggagaatgtcatgaatccgggaggcagagctttcagtgagctgagattgagccaccgcactccagcctaggcaacagagcaagactccatctcaaaaaaaaaaaaaaaaaaaatgaaatacccttttaagcctttatattatgaaattacaaaaacataccattctttttagactttgtcaagttaaagatataaatttatagttatagaaaggaatgaaagttatagaaagacggtattttatagcattgcttgcttcagtatttattctgtaacactatataacaattctggctcttagattaatcaacacttaacgaaaaaagttatctttttacttttttgaggcggagttttgcccttgttgcccaggctagagtgcagtggcatgatctcagctcactgcaagctccacctctcgagttcaagcaattctcctgtctcagcctcctgagtaactgggattacaggcatgcgccaccacgcctggctaattttttgtatgtttagtagagttggggtttcaccatgttggccaggctggtcttgaactcctgacctcaggtgatccgcccacctcggcctcccaaagtgctgggattacaggcgtgagccaccgcgtctagccgaaaaaaacattatcttaaatccatgtacaagatgatattttgtactattcata

SEQ ID NO: 64486 - DNA, 1127 bp, Homo sapiens
tctgaggcttctatttattttacccatttgatggataaaggagcagacaatagatgggagaggagtcagtttagataattataagcacttttttgagtcaccaaccaagtggtaataaatacagttctagatttttttctttaaggatattcttatgttgttttagagcaactaatggaaaaatactgtacttgtcacttctagatttcaaattagtattaaccaagcagattttgttgtgtttctgtgatatttcacagtagtttttagttattctgattttcttaatactaaaaataatcttggtttgtggttttccctttctttttgcattatttatttatcgttttattaattctgtagatacttgggaggtttcccctggaaagagtttcttggacatagtatttgacattttatattatgtcataggcagttttctgactattgtgtgtgtgtgtgcatgtgtaggtgacttctttgtttggaggagaagacactagcaggagttcaactaggggtatgtgtttaaatctttaaattttagcaataatcatcgccttttcagagaatctattaactttttttttctttaatctaggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaagtaagtaactgtttaagcagccaggcatggtggcttgcacctgtaatcccaaggctttgtgaggccacagtgggaggattgcttgaccccaggagttggagaccagccttggcaatgagacctcatctctactaaaaagaattttaaaaaaattagccagtcaggcacggtggctcatgcctgtaatcccagcactttgggaggctgaagcgggtggatcacctgaggtcaggagttcgagaccagcctgacaaacatggagagaacctgtctctactaaaaatacaaaattagctgggtgtggtggcacatgcc

SEQ ID NO: 64487 - DNA, 1018 bp, Homo sapiens
accttctgctttccttatttccattagctgctctgtctcactcttacttgtggcttcttccttatcttcctgactaccaaacattagcatatccccagggctcagttctaggacctcttctctctgtattcacatcctaggtgatcttggtatatccctatactgattgactctgaaatttatatgtctaaccttaaccttttccacatctccagactcaaatatctattacttgacatctttatgtgaatatctaattaattgacatctcaaatttaagatgtacaaaactgaattttttatagtacccatcatatctattcatccatcgacctttcctttctctttttaagagtttattttttgagagcaatgttaggttcagagcaaactgagaggaaggtacagagatacctcatatacccccttccctacacatgcataacttgacctcattatttccctttttaataaatggcaactttgtcttccatttgctcagaccaaaaccctggagtcatccttgatgtctcaagaaaaagatcttatacatttcacattcagtctaattctggtcagctccaccttgaaaatacatttagaatgtgagcactttcatcattaccaaagctatactctagtcaactgcagtagtttcttactaatttcccagtgtctacccctgccctctacagtatgtcttccacaggcaaccaaaatgatcttttgaaaataagtcactaaatgtaatgtgatatcctggattatattctggaagataaaaagctcattagtggaaaagttggtgaaatctgaataaagtttgaaatttacttaatagcaatataccagtgttaatgtctagcttagacaaatgtaacgtggtttatgtaagatttacttagtctagttttccaacattatatgggaactttgtatttttttataactgtctataaatttaaaattattaaaaggtaaagattttaaaaatgaaaataggaaaattagccgggta

SEQ ID NO: 64488 - DNA, 1045 bp, Homo sapiens
aaaaaccattgtctatattttgttcattatctagcagccaaaaacaatgtttgtacgaaaaaggtccttagaagaaaaatattttttaagacaaccaacttgttatccttttggccattatagttttaggactacattgcctatagaataatttaaaaggtaccattttgtgtaattgtactgtgtggcaaaagatttttaagcagaggacctcatttaaaatgccatttatccaagcatgtgcttgggtagtgttgataatgttaccaaagatatcctggcagtagttcatctcttccttttccttgggtttcttttatttaaaaggaaaatgctggtatttggagtttcaacaggagctcattcattgcagtttcatgagctgcttgagttggacaaagacacagaactgagtggctgtaaacatgtaaagccttgttcagagccctcaaatgaagtttttttaaaaaagaatttaatttcttctttcttgtgaacagattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatggtaggtttatggttcctcaagcctctcgttttgctctgttagggggaaatgtttaaaatatcaatattatcattcttttaataaaccaattttgttatgtgtctttttggcattcatatggatagttttctcgttagaactagtggggaatcaggttacctttataaatagataattatctgaaaagtgctaagtaacttttgttaatcagtggctcttggccaaggctgaaaagcattagatagaaaagctaattataatttaattctttatttttctccttcattttatgacaggaagcatgcttgcttataaagagctgtcagtgaaattgaaattccagatatcttgctaagttcttctgtggagaagataattctcttttat

SEQ ID NO: 64489 - DNA, 1068 bp, Homo sapiens
ttacgagtgctagaaacccatcttgaacttaaaaagggtcatgtattggttcacaacccaaatagcagatagaggaaggatgggatagagttcattaacagcaagattcaggaattcattactataaatcatccccccttccttcaattctccttgtccactccatttcctttccttcaccttcctcacttttcttcctctgcctttcctccatgcaatttaatggtctcagtagcagagaagaaaaaggagtccccttagctagccagataggaaacacccataggaggaaagagtggaacaacagtccttgtggccaagaggatgagagatctgttatctaaaaaagggaagtagatcaccactgggagatttttttctgaatccagcattgtcttcagtgtggtctgctttaagcatagcaggatttggggttcccagaacatttttgagtatgtacattattttaatgttaaagaacttaatatttaatgagattttctggaccattggtgatattttattaaaactctgtcttcctttatgttaccttttaaccagcatttcttttcttcagaataccttaggaaaaaaatattatcagtagagtcactttttcttggcaaaggttactctccccagacaggccttgtattttcctgttaggccatgttaagtaactactacatttaagctttgcaagttgagaagttaggctctctgagacctaccttttttctcccatttgaatcttagagctatttatacaaactctgccactaattgaaaatgattgtttttgtttacacacacacacacacgcacacacttaaatgtgatacgaaactgcaaatggactaaagagagaatgagttctctttgtaattttattttcattagtagactatgactgcaacaaatactagagcagtaagaagtactggtgtttttgaaggcatgttctaggaacttcccctgtggtgaccatggagattgagatgaggagatgtactttgaaattagtggctctgttttttccattgtgctcattttgcagtggatttttaa

SEQ ID NO: 64490 - DNA, 1088 bp, Homo sapiens
ccactggttaatggcagccattttgactgctaaaatgaaagcgtctaaagttcatttactgtgccagctttccagttgtgtcaggaaatggggttaaagtaatgtgtatctgaacatcttctgtaacccaacagtgtataaggtgttaagtgttccttcacccagattttatctgttttattttgtttattttgtagtatatttttctaagtggcttaaagtccaaagtcatatggggtaggttgcaaacaaaatatatttatgtttagaaatctaattgagtgttatgtttatttttatgtataggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaat

SEQ ID NO: 64491 - DNA, 1051 bp, Homo sapiens
tgtaattttaccagaggctctgatgcctttggggtcagtgcctcccattctgtcttgagatgactacataatttagaatttcacaccatcctactttagagagtaaattatcagcctgtcctggtttggatgagtctactgtttcagcctggttcagcccagtgtctcctctttaggtccgtatctctcttatgaaagaagagggtgataaaggaaaggagaaggccattcttactgacctgatagtggaagaaaagtaggttagttctccttcttcctattgcctgtccttatcactcatctctttcttctatatggatatttgtatattttctcattcatgaaaatctgtaaacctagtaaatttgctgttattcctttaatgcagacacatttgacatcttggcatttaaagagacttttgtgtcattatttttctgcctaatgtgctggaatacttaccattttttttttaaatacagttgatgtttatggaggccttattaagaattagagtcagtgtttaaattaattgtcctagttatgtctagaataagcactaacagattagaaactagtagaaaacattctccatcaatcaaaaataaatttaaaaggcaagaaaggagaggaaataaatgttaaagaggtaggataaatagaaagccctaccagcctgagcaacataatgaaaccacaactctaccaaaaaaaaatatatatatatatcaccacgcatggtggcttgcttgtggtcccagctacttgagaagctgaggcaagaggatctcttgagcccaggaaatcaaatttgcagtgagctgtgagctcaccactgcacttcagcctgggtggcagaatgagaacctgtctcaaaaaacaaaaaagccctatagaaggtggtagatttaaaaatcaagatatggtattaaggccgggcgtggtggctcacacctgtaatctcggcactttgggaggctgaggtgggcagattggttgaggttaggaatttgagaccagcctggccaacatgacaaaaccctgtctctac

SEQ ID NO: 64492 - DNA, 1125 bp, Homo sapiens
aatgatgactaaaattgctgggcatggtggctcatgcctgtaatcccagcactttgggaggccaaggagggtggatcacccaaggtcagcagttcaagaccagcctggccaacatggtgaaaccctgtctgtacttaaaatacaaatattagccgggagtggtggtgagcgcctgtaatcccagctactcgagaggcctcaggaggctgaggtgggataatcgcttgaaccaagaggtggaggtggcagtgagccgaaatcgtgccactgcactccagcctgggtgacgggtgaaactccgtctcaaaaaaaaagaagaaaaaacttgactaaaatgaaatggtagaatttaaaaagaggagtccagtatgtttttgccctcccgtaccacttctgttcaagagtatgctatattcaagaatggctttatttacatttttcaagtgaatgtttttatttaacttaaatgcattattgcatttcaggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccagtaaggattgtgactttatgaaaccatttttagataaagatacttcttcgtatcagcggatttttattgtgttattagtacttaaatcttgattcttctgccaagttcctcaaatttatattttgagtctgtacagatagattatattttgttttgagcaattttttaaaattggttcacagggaagcaaagatcaactaaaagaggtatgggaagagactgatggattggatcctaatgactttgaccccaagacatttttcaaattacatggtaacgatttgatacaaatattaatatttatatctgctgcttgaaaaagtatttgctttcctcttaattgatttctgccaaggtctgctattgagttctagtgagagtaaatggttagagtttttctagggtaatatgatagtctttattgctcacctgcagtataaaatgttttagatta

SEQ ID NO: 64493 - DNA, 1029 bp, Homo sapiens
atgagatttgattctcaggactccacttgggaaggccaaggacacgttctctctcaagctgcctcaggtcccaaggcccaagggatatccaccagcagggacaggccaggtgggctcccactgaatgttctagagaggaaaattccagctctgtagacaagcccaggacctctgtgaggcagagcatgaaaagagacaaagctgggacaagtcttcatgtatcaacgctagaaagggccttaggtgcgggccaccctaagcccttcttttattaaggagcccctgtgtgccaaacactatgctgagtactgtacaggccaatcccactcattctgcactgcaaccctcggtgctgagaatggtcatttccattgcacagacaaggaaactgaggcacagagacgttctataacctctctgtgtaaggtgccacaaagcccagacttgaacctatttgttcatgcaacaaacatttactaagccccgactatgtgctaagccccatgccaggcactaaaaagatgagtcaaataagccgctgccctgcaggcgtttacagcccagactttgagcaggccaggataaatccacgtgacaagtattctgaaaaaagcggattcaagggctgtgggagcatagaagagagacagtccgggaaggtttttgtaccagaggtgtcatcagaactaggactcaaaggaggggcaggagttcaccaggctgaggaattcctgaaaacttcagtgcccctgccatcgtctcactaccctgagtggtgatgttggggtggacaggagcatctgaggttgcctggggaatgagggaagctgttgtttcccactccccaagagtctgtctgatctccagaggcatctctcttccagtcaggcaggccagagacccctgacacacaaagttgggctcttttctcatcttcatccagagagtgataataggttatttttagggtggcacagctgcacgaagtatgacagtaaccatgagacaccaagcactgtgtccaggagt

SEQ ID NO: 64494 - DNA, 1528 bp, Homo sapiens
cctgccccagttccgggcccctccatcgatcacccacacccagccatctcactccccaggtgcttacctgcactccagcctctccatatggtgcacctggagaggggccaggtgtgcctgagcattggggcaatccagctcccataggggagagggcaggaatggagggaagggagagagccccgctgccttttctctagctggtgggagggctagctagctctctctgtgagtctccattcgcctggctcctgcactattttccctccaatgataatagttagggctagcatcgactgcgctcttactacataccaggcacagtgccgagctctttgtacacggaatttcctctcatgcttacaacaacctcagtaggtagatattattgttattcccactctacagatgaagaaccaagtttcagaaaggtcccaaggccacccagccagtaagtgaccaagatgggtctcaaatccaaagctgcctaacacctaagtacatgtttgtcaccaacatactctgatgcctccatgaactctggctggcacctgcccaggctaagggctggctggggaagtatgagaggaacaggctgggcaaatatttgaccagccatcatcattactgcctaaaccaaccagcagtggttttccctgcagtgccccaagcacgggttccggctgcagcttttcccactgcacagagatcatgagcgccctttcatcacttactctgcatatttgttcccaaccaattccatccttctagtatttaacctgcccaaacgctgtgtgaagtgctgacctcagctcttttcaagctcacacggtgtttgcttgcacccaagcgggaggcctattaaagccattgctcaccctgggcatagctacccagagactaatgaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattggggaacgggttagtagcagcctctgaggggttttttcaaagccaggacccccaacctaccatgccctgagacactactcaggacaatgggtaactaggaaataggagacattgaaggctgaagagttgcctgcagtaaggtcaaacatgttgttcttgatgatgtcctttgacaggttttcagtcctgcttggagggcaaggtcagcttagtgccctcccaggctggggatcttcttcatttgcaccccaggtatacactgagagcccacacagcactgtgctcagcctggggttgtattgttcctgttcatcctccagatggggtcccctccacaagcttagacgaacaggattctcctgtgactgtcctccttttgtgtgattttaatccctgctgcctctgtctttgtttgtactggtcagatggtccctagcgcctacacaatgaatctttaaagacttggggctcatgc

SEQ ID NO: 64495 - DNA, 1035 bp, Homo sapiens
ccctgattcaggttgccacacatatgccagctcctagtgggctggagggaaggacatgcggttggggaactggaagactcatgctttcagctgtgtgcttcctccctagagtgcaggcagaggaggaatcgaatcccctcagcactcttgtaaagaccacagcaatgagtgagagatggtgcctgccagacataccattctttacttttcagcttaaaacagatacaaagtttggggaggctcactggaggaggcttggggctacactggaaagagaagaacttggattcacaccccagcttcccctcttcccagctctgtcacatttgcaaactctgagtctcagtatcctcatgtgtaaaatggggatagggtttatagggttgtaaggatgagatgatgagttgtttgcaaacaacttctcacagtgcacagtgaaggtcagcaatgagagccagccccgccctttcttctttccaaatgattaatatatctgttaccagcctccattcattatatagctctgtcatgtgctaagcaccatgggggctgaaaaagatgttcttcctgccttaaaattccactggggatgaacaaattacacgggagctgatcagagaggaaggcagtccattatgagggctaattgagcagtgcagaccatgttgcaaactgagttagggcctggagagcttactgtgtgctggggtcctcaggaatgccacagatgcatcaataaccacctctgctactctggaagtagtcacatcaggaagactccagagataagcttatctgggctgtggccacagagctggaatttgtaagctttaggtttctatgtctcatgttaccagcttgtctataaattgtaaattacagccatctgatggttagggaatatgaagtttggttaagagaatgaaatgagaccacgaagattagagaacaggaaaagaggggactggggactacatacccatcagaatcttcattcagtcctgaccctcagcaggagggggatttcatcaggct

SEQ ID NO: 64496 - DNA, 1048 bp, Homo sapiens
tgggctccagcgtcaggccagcccagctctgccagttaatgggtgtgtggccttggatctgttacctaacctttctgagcctcatttcctttgtctgagaaattgggggtgacggcagtgtactttctttgaaaagttatggtgaggaatagataagatcatgtgtttaaagtgcttacttggcacagtgcctgtaacttagttaaattcaataaataaatttcccattcttcccatgatcatttatttttaagggacatttgtctgaccagtttgatttatgagattattggtgtttttcatgaatgttaagacgtacgtgcgtcatcttagagtcatgtactctgatatattcacacgtgcacatccacttactcggaaatgtacacacccaggcacgcttattctgtctccttctctgccacatacttgcacacattatgtgagtgtacacacatgatgcacacacgtctctgcgatcttccatctctcctcggcagccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgagggtaagcaggccacctgggccagggtggggtgggaagcagaggctctggcctctgtcctgccctgggttcaggcccccaccctgcttctcagccaaactgagaagggatcagcttgttttacccgcccgtgtaaaggggagtggggccgtggcggaaatttcaggatagacactgcatctggcccacgtgtgctctaccccagggtcccagagggagaggggggtgatgggtgtgttcgctgaggttggcggatgactttccgtagaaagggaagataagcatcaggcactggcctctcctactttctttcttcgggggtgggggactttgctttaatgtattcatatcgtcacgctggtaaatgaatgagtaagtgttttg

SEQ ID NO: 64497 - DNA, 1025 bp, Homo sapiens
acagagtaaatgctccataaatactgactctcatcagtttgttatcacagcctctggggagggcgccagtgctgacttatgctgttcgtgttaaatggggctgtcactgggtgagttgtggcatacaggcccctgcactgttcaagagaccccagcaacccttgtgcttagggctcagcacatagtaaggcctccagatcatatacccagctctactccatgtactggcagctctgcccagcccataccccaaatacgcccattaactaaagggccctgcagcctataaagtgatgctataaaggttcagtgttcagcctttgaaattcaaggcctgggctgctctattgcagtacttagcatgtccccatcctgtctgtttctctctcccatctcagggtgaccgaatcccaccatctgcacctgtacatgccagccgggatggcgttcatggctgctgtcacctccgtggtctactatcacaacatcgagacttccaacttccccaagctgctaattggtaggtgaggtgtaggagggaggggcagtaccttcattcatttcttcagataatgtttactgaggactcattatgtgccagctattgctctaaacagtagagatttggaatagaaaaagaaaaaaatccctgccttcatggagcttacagtctggtgaaggaggatagacaggcaaagacagtgaataaacaagcaaacaaataggtggtggggatgctatgaagaaaatcaagctgagtaaggggtaggggcaatgacaatgttgctatctacacaggatggtcagggaagggctgtggtaactgtgggcatgcagatatttgggggaaggtattccctgcaaggggagtgacaagtgcaaagtcctctgatagggatagatttggcaaagatgtcactgtgggcaaagccaaatgagcaaggggaagagtgggaggtgagggcaggcgtcaggagaggagcgagcaagagtcccaggctctgggcctgagagcctgggtgaac

SEQ ID NO: 64498 - DNA, 1107 bp, Homo sapiens
atcagtgctgcagcaggaagtgtgagtgaccacacgcccacacagtcagcccagccaccagcaggccccaagtcatggaaacaaacacctgtgttggcttgacacttgtgcctgccacaccagcaccggccataggggggttttcagggccagatctatccacaggcactgtcccatgttctcaccatactatttagtcattcatttattcattcaacacatgcttattgagcacctactatatgccaaggcactatgcagggcactgggaatccctgctggatagacagctgcagtctcccttctcaagacagtctggtggggaacaaagaaaagtaggcacccgccacaccatcagcgtggagacggaggaagcacaggtgctataataaggaagagggctggagtagaggaaaagctcaagggaggcttccagaaggcagtgacgcccaacttaagacctaggaggcaaagcggaagaaggaagagcacgtgcaaaggcctcaaggcaagaaagcctggcattttttgaggctaaagctaggcagtgtgaggagcgtggcgaggagtgagagataaggctgaaaaggaagctagagaagctcatgaaaggccttgggagtcaagccaatgagctcagtagtcaatgcggacactggggagggtttgggggcagggctgtgaactgatttgatacatcttgcccaaaaagatcaagtgggttagagccaagcagacaggttgcgtcagctcccctggatgcctctcttactggtcttcaccccatggcccctagagactatgtgcctaccaactaggaacagcagatgcttcacactgtggtccagggactggaactgtggccaaagagacagcccttaaagacaagggacactggatagcacccatggccactgagagaagggtctgaaagtgtgtctcctgggtgacactggctgctggcacccccaagccaggctctagctcaagcgtccaatttcttagagccgctcagtagtttctgtgatctcagcccacactgtggccaatgggcttctcatctctctgctgaggatcacaaccccaggacctcgagcagttgaatga

SEQ ID NO: 64499 - DNA, 1304 bp, Homo sapiens
cccagaggtgaccatttccagagcacattagcagtacacagaggtgtgtgtctttaggagaggagctaggaagagtccctcagaggtccataatggcccaccaagtccctccagctgtggatgaatgttgtgtgtccattgctagggagctcaattccttattcctggccttggatactaagatgattcagaaaattcaagagcagatccccagaaggcttgttgggggcgggggtgagctcagtgaacagggggtttcctccttgccccagaaattgcccagggtgtgggctgtctctgctgcccctctcctgaatgctcgctctgtcctccacgctgtgtgtgataggggctgaccctccctcctgccgtgtttcccttgcccccagctcatcagggcaccatagaaaaactaggacctcgaagactcaggtccaaatcctggtactatcagttacaagatgtctgacattgaacaagggactttacctctctgagcctcagctccttcatcaaagaatgaggataaacctacataggagatcattggtataaatcccttggcacataggcagttcataaatgatcattctcttcctgccttagcccctggcttccctgcaaccccatgagagaagcagccaggaatgcaggctcggtgggtctaattcctacaggaaaaataaggagtctatttgcctttcatgtccctccccaaatcctctagaaccctgatggtgagtgtaaagcagttaagccattctctccatgccctgcctcccagtcctgcagtttccagctagccctcggtagaggggcacaattcagaggaaactgtgggtctagactctccagggtgaaatggtccagagcttaagcatgcgggtaaaatctgatgtccctgggtctgagcccccaggtctcagtgtgactcctatcacttctagcttaggacgggacctctacagatgaagcttgccagccctcccagattttctctggaatctcccaggatgcatctctgaatctgaacatgagatgatgcagaaggcatgtgccagatactggaaaatcagcacaatgccctttatttatatggcacttatttatttttttattttattttttatttatacagaacttttacaaagttctttcatggatgttatttcattggcactgggtggcaagcctgtgggggaggtatttttaccattttggagatgaggcaaatcaggcccagagaggttaaggaacttagccaaggccacacagctagttagtgaactaataagccagtcttt

SEQ ID NO: 64500 - DNA, 1019 bp, Homo sapiens
ttgctccctggcctggctgctctgctttaccctgcccgcctcctcctgaccgcagtgcagacacccagcttcaggggcccagcatgtgtgggggccaatagagtctgtaaagctcctccaagccccagcttggcccaagcactgtacacaaagcctagacgacaggactcaatgcccaggctggtagatcagctgttgcacactggtaccactgaaccgctggctcgaatatttagatattgccaaattccccctctgctgctctggcccctcccccaggaccccctagaccactctcaaatccagcaactgaggaggtagtgtctggtccagcaggaggctttcagcatcctgttccagcactcaggctggtccggggtgggtaattcagccatcgctcttggccccagggagcttcagattgggggtattactctgtggagctgcggcctggggaaggaagggggctggtgcactggctatctggcctggatgaggatctgttttctgggggcacatctcctgcccgctcctgctggagctgtccttccaagagctgtcccagccactgccttctctttgaatgttgaaagcggaggacttgacctgcactatgagacaagccagttttgttctgtcgaacaacagttctaggcagacacccaggctcccttttgtctcgagccattttttgtatggagggaccagacatgggttagaaaaggccttgttctctttcaacaaggctttgtatgtgaagactgtgatttggaaaagctcatccttccacaaggggttttctctttgatgttctggccctgacttctgaaaccagtgttctggggagaggcatttgagagtgacccagggcctgggaaccggggcttttctcggtggtcttaggcctgttctgcaaccaaggcaaggccaggtaagccgagttggacagagggtgcagttttgctgtcggatctgccaatgctgtttatctcacaaagtcatgcattccttgggaaccc

SEQ ID NO: 64501 - DNA, 1049 bp, Homo sapiens
cttgaggacagaaactttgtcttatcactgaatccataaagtctgatacagtatgccttgcacatagttggtgctcagttaagtgtttaaatgaatgattgtgtggatgttttcctgtggagggaggtataaaaggggcccagtgtgtgaccatttgagagatagagaacctgaggcccagagaatattacctcatttcctgcctgcctgtcagtggagtgcaggatgtgaacatgaaatgaattataaaaacacccacaaagggatgaaattaaagttctgggttgtgatgaggtgggggaggccagtgtttctcaggctggactctgggccatctgggttccatctctgctctgtgtctttagataacctgagagttgactaccatttttattagtgttatcgcattctgctactaaccttctccaacctgagcctctgcctgcccattcccagacgagggtatttggttggatgatccctgatatctttggggctctgtctgtcattctgaggaaactgtctctcaagctgggctggggtctctgtccctagagggctctgttgtatccagcaggagggtcagaccaacactgccccattgacctttctatctctccagaaccaagatggagcctgtgtccagtcagtgtcagtgattctgcaccaggaccctcggaggcaggtgaccctgacccaggcaggggatgtccttctgtttgaccagtacaagatcatcccgccatacacagatggtacggtttggggtggacaacagacctagttgggaactgagggtttggacctctcttcccaggatcctctggctaaaagcactgctaccctggcaaaaactcatattctagtactgggtagatcaggataggggacactttggttgcaaaaatgtggactccaaaaatgtgtctttgtcccacctcaacaggacagtggacttcctagtagcatgatggcttctcctaacatgaacatatacatgggtgtttcccatcctgactctcataacttgtttattaactacttgttat

SEQ ID NO: 64502 - DNA, 1020 bp, Homo sapiens
cctccctccgctcaacacctacacctgggtttggtgactcttggagacttgtgatgcctaggaaacatgctcatcccccttcctcccttcactgccccttgtatgacggtttcctactgagagagccaaagggcgagccaaggagttttcaggaattgcccatggagaaagggggaggaaaagtcttacccccatggtgtttgatactcttcatgatgtccctgtttctttttctgacctgaagagctgggggtggggaatgaagccatattcattccccgccccaagtggacaatcctagcccattttgagcccttttgggacctgttaaatgttgtgtgtctgcgtgtgtgtgtgtgtgtgcgtgcgcgcacgcatgcatgtgtacatccatgattctatgtgtttgaatgtggctgtgtggaccactttggctatatgcatgtctggcatatatttgtgctctgtgtgtgtgttgagagtgtgtgcgtatacatgttacatatttgggtgagtacacgtgctcctctgagtgtgtgtatatggatgtgtagattatgactatgtgtgtgtatatgagcaagtaggtgttacctggatctatgctatttgtgccccctgagtccacaggggcaagtgtgtgaatatggctgtgacatggctgcaggtctccagtgggtgtacctgagagcaccccacaactttttggcaattcctggaaaacactttctgcttgctccccgctggtctctggctcccctctggacccctgcgatgtgcacctgcaagccggtgagttggtgggggaagaggagaggcatggttgagtggggtggggaggactgctttgagagagatgaaaagggaactccgggcaggagagtgctggccaaatttgtaggagtgataagagaaggaggagcagcagggaggggaaaggagagacagtgagggccaggcaggcaggaagcctcatattcttccactatcagatatacacacacacctttatactggctt

SEQ ID NO: 64503 - DNA, 1030 bp, Homo sapiens
aacatcaataataaaaataacatgtaataataacaatgacaaaaccttttatggaaggaatcctacctatagggcaggcactgtactggggtctttcacataattgcagtaactctacaagatgaagataattgacctcattttatttaaaaagttttaaaggttaatgcagtgtatattaaaaacagatattccccttcccaattcttctgttcctatctcctgttaaataaccactccagtcagggatgaatcctgcaagaacttttttctgtgagacatggacacacacacacacacactttgtttagtttatgtgaataagattctacaatgtgctttttttacttaagaggatacctcggacttgatttcatatagttggtacacacttttttcttttgaacagctgtgtagaattctacagaaataatgccctcgagtttgctttattttttccccatcgatggacatttaggttgtctccaatatttaaatgcagcagtgaatacctgtgtggatgtatccccaggttcttagaagtagaattgctgtataaaaagctacatacatttaaaatattcaatgccagcaaattcccctgcaaaaagcttacactagcatcaaggatgtatgtgagacagtgcctcttccccataccctatcaacacaatcatccctattatatatttattaatacattcattcatcagatattttggggagtcactacatgttaaacaccgcactaggcatccaaaaccagaacagcttcagagaacagaagtcgcccaaagtcacacagctcagctaacacaaagtagaagtggactgaaagccactccagagagcgtgttcctccacctctgtacctcttggcaggatctcctttctcccttgttttattggactcacttattctctcctcagagcacatcagatgtcagcttctctgtgattgtagagaatgtgaactgctacagctctggcatgatctgcaggaaatttatttccatcaacgttgggaact

SEQ ID NO: 64504 - DNA, 1102 bp, Homo sapiens
ctaactaacccccaggagtttggcagcagttgggctgcagttgaggtaaagcctctcttccaggctggcttatgcccctcactcagatgggcgctgccagcactgaacccggcccaaggtcagggaagagggatgctggtgtgaggtttctcctgcaatgttctctcagcctctgactgcatccctagccctagactctgtcctatggcccaaagatcatgcatagtcttgtctcacaaatccagctgcccaccctaccctggaccaagccctggtagggtggtggagggttgggaaggtgacaaagtctgtcccaggagagatggtcactcatgatgatgcttcccagtgcctggcactaggtctggcacagagaagagaccaagagagactgaggtgggttgaggcaatcagggaaggcttcctgaaggagatgagagtggtgctggcacttaaaggctgggccatgcttaaatagatgaatatatcagagataaggtctctgagaggaagggcaacactagcagagatagaaatgagggggtctgcccaaaggacagtctgcgagatgtctaactgaggctgccaatctgtgagctgtgggggaaacagcactgagttgagagcagtagacctgggttcttgtcttgggtcatccattgactttctgggtgaccttgagtaagtcccattcctctgcagagaggggactgggccaagagagggctgatgaatagatttcacttcatgtgacaactctgattggtcaaaacagactgcttgggagctatgttgagaaacatccaagatctgtgtcaagctcagctggaaggaggactgtgatcgattatttatgtctgccataggagcagcagtggagagtggtgatatgagcgttacatatttgcctctcctggacttagtgatcttaatgccctgctgggaagtacacggagatgagcctatgtagactggggtaagggaagcagtcgtgcatggcctggagttcaactgctccaggtggggcagggctgttcccacagcctctgaaatcctgaggtgggacaagggttcccacagcctctgaaaagtgcgccctaac

SEQ ID NO: 64505 - DNA, 1130 bp, Homo sapiens
atggtattattgacctcaaagaactgtgaggaatacaaaaagtgagagctgacgacatgggagtggtagtgatgatcgtggctgttgggattgtttggcccctttcaggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtatgtgccaactgggtccagcactggggacacctcctgggctggctggggatggcagcacctacctgcagaggctcattgttccttttgggcagggaggggaggagctgggcactgggatatgtgccatccgagtaaccagcactgcctgatgcatatgtccaggtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccgtgagtttgcggggcagggggaccctccattgtgactattgttcccatcccctgttaaagtgggaaaaggctcccggccccaagttcatgtatgctttcccagctttaatcattcatggatttatgtacattagtaaatttataaatatttcatatgtttaatttatatttaatttttatattatataaaagtacattttatactaatgaacacatttattatgattcatatgaacatattaacacatagtaattgtattgttattttagtatttgctttctttgcgtctcttctctgtaagtggagactgtaaccatcgcccccgcccagggtggttttgaggatgtgggggaatgtgttccgagtgctcacatagacctgccccacggacaccgtccagcacaccttaattccctctgcttcctttttgctcacgtttctcttcttccagagtttcccttccttcctgcaggaaggaaatgagatctgcctcctc

SEQ ID NO: 64506 - DNA, 1025 bp, Homo sapiens
tcaatttcggcatgtatataagctcctagggctggcatttggatacgcctcctttccatggttttgaatttccgcttgtattttatttactgtattataggaataccctttcaaaggagatgagcttagagtaagtaaatcaataaaaactataagcccctagaggtcaaggaccattttcatttactttagtgtccccagcacataactcagtatctggcgtatagtagatgctcagtaaatgtttgtcagttgaatggatgaaagtgattaatgaatcagcattcaaaatgacttaagaatgccatctctggtaccttcctttggactttcagataacaaggccatcaaggtggaagctttagaaggtgttccttggattttggaggtctatcattaagaaagtgtgtgcacattgctagacatcggaaataatattggcttagacaagacagaagcattttctctcactgttatggactgaattgtttctccccaaaattcgtagattaaatccctaacccccaatgtgactgtatttggagataaggtatttaaggaggtaatgaaggttaagtgaggtcttaaggatggagccctaatctaatatgacatatcattatgagatgcagaagagacactaggaattgctctccctttacatgcagaggaaaggccatgtgaggacacagcaagaaggcagccatctgcaggccagggagagacttgctagaaaccaactctgatggcaccttgattgtagacgtctagcttctagaactgtgagaaaattaatttctgttgtttcagctacccagtctgtggtattttttgttatggcagcccaagcagactaatacattcacgcatgacaggtctgatgatatccccccacaagattgctataatagttctacagatatcaagggccctaattatttctatctctctgtttcactatccttaacataggcctttgtcttcaagattttctcaaggtccaagatggctgctagcaatattca

SEQ ID NO: 64507 - DNA, 1100 bp, Homo sapiens
ggtaaagtcctgacatatatgatatgcttcataagtagtaagtaccattgtcctgtaaaccagagctttcaaactttttccttcagaacacttaaattctttcacatattctctatcatatatgatgtttagattcctcacagccctggttactttatttgttattattattactattgttacttttattgtaaaatatatatgacataaatttattattttaaccattttaagcatgcagtctagtggcattaaatacattcacattgttgtgaaaccattattaccatccatctccagaacatttttattctcccatactgaaatgttgtacctattaaacagtaactcccactccccatccgtgcagcctgggcactctattttgaatagcatgctccaaattcctcagtgtctttcttcccattgcaaatggaggttaaaaagagcctcttggaagggtttgagttcttcaaactcccactggggagcccgagaattaaaagtctataccagttgcggcaaacttttgggattgcagatggttacaaaattagtgtcaatatagctgctttgcatggagtggatctggcaaagaggcttctaagcactgatacattcctttcagaaatatcaaaggatatggcttggcatagctttggggagaaaccaacagttttcgaattcttgaatagcatctaccttatggtgaagattaaatgatataattcatgtcaagtgtataatacagtgcttggcacagatcaggcccttatatgtaggcttttgttaccataattgcactatggcagagattacatatatgttttggtagttaattcccatgataggtagacaccattttcatcttatctgaggaaactgagtctctgggctgctaaagcccccaaaattacagagctagtaagttatagagtagcagagctgggattcaaacccatactctttctcttataagatgctgcctgttgtgatacaccaagaaaggaaccctgtgagtgaggtgtactgacttcatcttgatgtttcatctttctgtataccctggcccttttctagggtcataccatcttgctgtt

SEQ ID NO: 64508 - DNA, 1019 bp, Homo sapiens
ccagaacccatctggctttgctgttcttgtgattttagagaatactaaatctctaggatgctgagctgctgacttttcatcaagggaacctgtccttgagttcagggggttggcttgtcaggggcttcttctgcagctgcaactcttcaatctgtctttgggggcctctcttctgcagtctccctagacagtaactacatcagttctccactttgaacagggctcagctgggcactctgagccaccccaccttaccactgctatgtgttctggtttgttgcctgaaagcaactctttgtgtccaggttagcaggtgagggtgagagaagtgtcagaggaggtttcgtgtccttctgtagaacagcagaggagagctggactggcgggcaggaagggggtggtgggcagaggtgtgactcatccagccctggcaccatgtgataggatctgtgaatacccatgtgaaatagatacatgctttaagaacatttgccttgtgaaaatctaaactcacaagccacatgaatttggaaccgcgattaccatcacaaaagggagctggtatcctttaaaatatcctgtagtgtatctaaaatacagtgcagtgagtgatgaaatatttatgccagtttaggcactcaggggaagctggcattctctatgtcagtggaacaaagaacttcttataactggagcagatggtgagcccctgtcagggcagatgttcctgcagaggccaggtgaccacatgtcaggtgggacagagggactgcttcccatggtggactgagaatcgcagctttaagattctctgattcttggctttgctttctgtcttgaaaagtaagtctgccttaggcaaatctgccaaggacagatgtgtccttgaagtcagaaggacctaggctaaatctcagctccacctcttctagctatgtaaattaggcaggtggctctctgaacctccctcttctagtctataaaattaggtttataataccttgcagagttttgtgtgt

SEQ ID NO: 64509 - DNA, 1026 bp, Homo sapiens
cctctgttctcatatctataaagtgaaaggtctggatcagtggttttagtcacctggactattctatcaaatcacttgggataattattaaacatatacattcctgggcccacttccagatcaatagatttgggaattgggtgcttagaaatttttagttctgatagtcctccaggtaattaattccaggtgatgtagccaggttttgagtagttgtcttccctgaacccctctggttctgatgttttaggatcctttgccttctttctctcttgctcagtttcccattgttctcttttccttttttccctagagtgctcctctcactagactgtgaacctctgaggaggaggggctgtatcttacccatctctttatccccgtcctccagtgcaatgtctgacacactggtagtgctcagtgaacagtgggtgcaatgaagggaaggagggaatgaatgggctctcatggctttataccacctatacacatccaagtaatgtccttaatgtttcctgcatcctcagtcattatagatttcttcagaacagtaagtggaaagaccacagactttggaatctaagaaaactggatttgaatctcaactctttctcttactgtgtagtgatttctcctaagtcatttaatctctttaaactacagtttccttgattgtaaaataaggagaatggcacctgttgcttgagattgttgttaggattgacttactacatgaaaatatggatgcagagtgcttgacatatagtaggaactcaagtatctcagcttcttttcttcctttacatgcccagtgatgagtgacagtaaaaggagggaggaagactcagaagaatagatcaaccccaagccaggccgcagaggatgacaatatagttcattgtcatctcctggcttcctgtgacactgaggttctcactgaggcccaggcatcttggtggatccccacttgctcaaccctgggcatatcagaattcagacttagaatctcctgactttaagtgtggc

SEQ ID NO: 64510 - DNA, 1050 bp, Homo sapiens
catagaaggggaccatttcactttttctgaaaactgggaatttattacacaaaggatgatgaattcaggatctaaagggtggaatatgaaaagaagtcaacaaagtaatgtgtaattgggaatcaatataagagagggcctagtggtagaaatggtaagtcttgggtattgactgagtcagcttgcactagggaggccagagcacaggggagccagccatgggcagcagagatattgacagagggtaaaggatgagcttgttagttatattgcctttaaattgtcagtgggataggcagtggggtagtctgaagacattcctataaaagaggcctagagaggaaatttgtgggttaggggtggggatgtggttttcagtatcttgcattacaggaccacatctgtgcccacactgcagaataacctttgtccattctagagagagcctgcaaagtacagatgaccatggtatacttgggaatgttgggtttatagaattaaagtgggttggtgctggaaaggatctcagaagccaactgttcccaatcttcatctgtaagtgaaatattcaagtcttagaaggggcagtgatatgtttcagttgtgagccagccagaggacctgcccaggcagactaagaaagcagatctcccaccactcagcccaggcccctttgcttcaaatcgtgtctcagagggagaacagtagttccccttatctgcagttgcactttctacagtttctgttacctgcagtcagccacagtccgaaaatactcaatggaaaattccagaaataatgcaaaagtttcacattttgagtagcgtgatgaaatctcatgccatgtcactccatcccacccagaacatgaatcatctctttgtccagtgtgtccatgatgtatatactatccgcctgttactgtataggaaaaaatagcaaatatatatagtttggtactatctgagatttcaggcatcccttgggggtcttggaacatgtcccctgaagataagggggcactactgtatttaaaactgtgacagtttc

SEQ ID NO: 64511 - DNA, 1037 bp, Homo sapiens
aggagttgctagtctgagctgaagtctagaaaggttactttgggcatccaatgaattggagagaagaagaaacagcagagagaggaaacacttaagaaactattgccattgtccagtacaggtgttttgagggcctgaactagtagagtggcagtagagatggaaaagaggggcaacatgagagcagaaccaggaaggcagaattacaggatttggtggttggccacacttggggagtgggaggaggaggtgattctgaggtaactacaatgatggtgatggcagcacctaacagaaataggaggatcagtaagggaaacagatttgggggtgggaagggatgaggtgggggtagacggtgtgttctgttttgtgcagcttgaattttaggtgcaggtgaattgcctatttcacatctatgttcagtgttcttcaccacgactgccaccattcctggtccccttctctcctccctctttattaagcaaacttttggctccttttacaatgtggctgagtgaaactctcaagtagtctttgtttatctttgaatttctgatgtaccatccatgtcacttggtatttcctaaggccagtctccccattgtatgcttccacacacataaatatacttacaggtatgagcacctggtggttataactggcatagtaacaccagtggttcatgtttgtatgaacgtttatggttggcaaagcagttagaattgtcagaagtatgttgtacttctccgctaatcccctaggtagggtcactgaaccattgactcaataagctaaaaaggttattagagaataaacagtagattttagtttaataataaatgcaattggagccattagcatatatcaaataggaaagttagatgacttttagctgctataagtacatagattttgttggaagagatgatcaaattttaaaatatattcaggatgatagcaatgccgagattgatgttttgtgggtattaagaatagctgtcatgtatagggtactttgtacaatactgctctaa

SEQ ID NO: 64512 - DNA, 1026 bp, Homo sapiens
ttagggcaaggtttggtacaaagtaagtaataatagaattgtgctgaaaaaagtgtgagagctcatgttggttggcttaaatcttcgtggttagattggaaggaaaattatctgctggagtgatgagattagggcagggaggctacctgggagggactagttcactttactctgtaatgggttcttccagcactgtcaggtgactgcctggaaatgggagaaggaagacaccattattggctctgacccctgagtggcgggaagggcagatgctgctgtcctcattctgggggtgaggaaactgaagttgagaaagaaagctgtcactgctcaaagtcacagtacatggcagaacagggacttgaacccggctctcagacccctcatttttctcattgctagccctgaacaccaacagcttcttctctggacagttctcatcagggtgtgaccctgggctctggctttgggtatcactggatggtagtcaggtctaatggagacttggtggccctttacaggctctgcctcagtgtcatatcaggaaaagcaacaaggaaaggaatagcctcagtaagtattgggacagtaagttaattcatgcttctagtaaactcgtgctggctggagttggaggtctgatggacagagtcttaaacgtagagcgtgacttgggttggactttctgttctgtttgtacaatctgtatgattttgggtcattcaaaacctttccaagccttagctttctcattcacaaagtgcacataataatatctgctttatcttgcccatagagttatagaaaaatgcagatagtatatataagggcgtttgtagactgtaatgtgctgtacatgtacaaaaaaagttgttttttaggttcatgacatatgagctgcttcgggtacaggttttgttaaaagtatgggtcagagctgctgttttgtcttaatcgcttgagatcttaggagctacctagaaccaccatggatcttgtaaacacttcttagaactagaaccagtg

SEQ ID NO: 64513 - DNA, 1029 bp, Homo sapiens
tgggaataggcatttccatgttttcaggcatttggtcatcagatgccctgcagagccagcacagataggctgtgagcctatatggtgctcagaacagccctgaagtttcttacaaaggctattgatgatgagtctcatagtcctttagcacttcacagtttaccaagtactttcgtgcctattcacctttggcttttcttctttaatccaatagatgcttgagtatgcctatctgtctgaacacagcattagggtaggggaagcagagaagagtggaacagtttctgccttaggagcttgtgagttagtagcagggctaagttccctgtaggacaaacagaatgtgacaaaggctttaagagagtctggcaatgaaaatatgttgatcctgtcccttcccgtgtcttggtgaccctttctttctggcattttcaatccctgtggttttgctgggttctgctgggtgggggtgggggctagggtgggaggttgtgactggaaagccttcctgaattggaaggcttgatgtcaaattagtgctcaagggagcaaaagtaaagtaacaggggaatcttggcaagaacttgaggaggaaagcagaggaagagcagccagatagagactgagtattgacaggagagggagaagggaagccaggtactgctgagtcacagaagccaaggaaacgctaacagggaggtcacggaggttggagatggagtaaagactactggatttggtgactgggaggctgtggcacttgagagagcagcttcagtgggaaggtagaagctaaagcaggagcacagcaaatgagtgagcgggtgatgagaaatagaggctgtgggtgtgagtagcccttccaggagattctggtcaaagagcatgaaaacaagcccagtaccttgaatagagagattggttactgtttgttttgtaagcatggagaaaccagagcacgtcagaaggctgaaagagagatttagagagaggaagaaaactgagtgagtaaagttgcaagaggaaagg

SEQ ID NO: 64514 - DNA, 1053 bp, Homo sapiens
ggacttcgaagatcatccagtaaaaccctagtatgctgcagatgtgcgatgatagaggcctggaaaagcaagcgacctagttaaagtcacacaatgtgctttttcagggtctacactgtaaaggaaggctgcagacagagccaagggtatgatcagttgagtccacaaagaatagacaggtcccatgttgtgcagaaacctaaaggatctacttgtatacttgcattcactgagcgcctctggccaggtgttaagaggcctggagatagagaagaaaagatataaccctgcccggaggagctgctgtctggcagggggaagctcacacaaacacacaatgctaccccaggtgtcttccccactatttggtggtctgcctagtctaggatccaggctgtggtggtggcttggagcctggtttatggaagaccctgcaggtgttcttatgaatgatcacctccaagattagggagatacattggataccccaagtttgtatttccagttaatttctgcaagcagtgctcagcctgttcacgtgccatgccttactatttcttgaggtttgcgaggaatcctggcagttttttccccaccttcaaacagctttgttccttggctctaggctgactttatttttggtttgcaggtacccaccagccctaagcattgtggcaaagtgaaaccgtgtactggcctgggaaccaggcagctctgtgatcttatgcaggttaccttctgtctttgagaagggaggtcatgttctcagctgcagctgtgtcatctctgctagagagatgaagcgttatcattatatttggattttgtgtttggctgtgaatacccattgatctgtggtctagagaagtgtagcatgtgtgcacctgaagcagaagcaggagtcaccctctgaagtgggtgtattcgacaaggggctgggcctgcagggccaccagatggcagcagtaggcagccagctagccttgggatgaggctggtagagtcatcattcggaattagtaaggtcagagctgaaagggcccctggaggtca

SEQ ID NO: 64515 - DNA, 1049 bp, Homo sapiens
ttttaaagacacattagctcccactactcttttggaaactcttgagctctctagagatcacatgctccatttcttctctttatatctctgtggggctggatgtgaatgtctctggatgggtgacaagttgattcagaactctcctgaagagtgcagaaagatcagtgcttacaaatgctggttacaagtgctggttgctgacggtgtgttagaatttcaaagggaattatttacacaagatctaaaccttaatgtggagttggtcagaatgtctagaatccagttgcttttggggtgctggaagctttccctgaatcatgcagtatcccaaagtagccttgtggtcttacaaggaatatggattgaaaaagtgagaacaaatacagggagttctttgacattctttactttcttcagtgttaccttaaagagccaaagagtcttagaagttttagagaatcaatgatggaagaagcaacttcctcactttgcaaatgaaaaaactgaaaccaagcagagagaaagtgactttatggcaactttaagctagaaatctagttctactttccagtgaaattttctcccttccatcggtgtcctcttgatttgtggttatatccttttgattgaggttttttattatttgttttcctaaagaggggaattgtatggtacatatgaaagggactggctgttagctactctttcaagtgtcacagcccaagaaatattttattgcatttgatgtctaagcattagtgaaattcaagcccagccattgattcacactaaactgagtttataaatatacctaatgctgatttttctgttttggggccaagatccttttcagaatagggtgacagtatacattactccatcttctttgggaccatatatcatgaaacttcaaccaagcctggggagattctgacctcatgggctctatttaaagcaggtgctttggaattaatgatgcttgtgctttagaattttgaaaaccccatgagtgaaagtcaaactgagcccaaaggcttgttttgaaatgg

SEQ ID NO: 64516 - DNA, 1010 bp, Homo sapiens
caagggtacctgtgtctcaggctcatggtgctgcattctagaaacctttcccaagctgcttaatgttcccgatcattgttctcaggaacttcatgggactcctgggtgactttatccaggctcagtgacctgcaggtgtctcatctgagattcatggtttcctggctggaggtgcttttaatgagagttggatggcagatctgggtgccttcctagtttgttgaccttgattaagtcactttacctgtttaggcctcagtttcctcaactctgaagtctggtattaaaacctgcctgcattctacatagggctgctatgatgttcaaatgaacgaatctgtgaaagatcccaactattgtaaaatgcatacataagtgatggctgcctggggtatgtaagtaaattaaagacttagtagttgcttttagaaagacttctgtttccacagggataatgccaccttgagactactagcctgaaagctcatgagctggccagggatgccatactcaatatcaaactctgacagcaaagttttctaaagtcttttacttgcatgcagtaggcaagtggctctttcatattatcaacaacttggaagattttcgtggcctaatttgtaatattacctattaaaattcaggatactcatcccaatttgtaattgtgtacatctctttgtattcttatttgtttaatgtctagactgtaaattacatgagagcagtgtctgttttgttcatggccatatccccagcatctggcacaggcctgatacataacagatgatcagtaactaagtgctgaatgaataagtaaatggcaaggtagagaaaaacctgggctttgaagtcagatagaccaaggcttgaatcttagctctcttaacctactgattgtgtgactgtgggcagctccacctctctctgtctccattgtcaccaccctagttcagcccactgtcacctcttaactaaatcctgcagtagcctttaactggtgttctggt

SEQ ID NO: 64517 - DNA, 1008 bp, Homo sapiens
atggaatacttgaggtcaggagttcaagaccagcctggccactggtctactaaaaaatggagtttttttgtagaaaccccatttctaccaaaaaattcaaaattagctgggtgtggtggcacgtgcctgtaatcccagctacttgggaggctgaggcaggagaattgcatgaacccgggtgacggaggttgcagtgagccgagatcacaccactgtactccagcctgggtgacagagcaagactccgtctcaaaaaaaaaaaagattaatagccctctctttcttcatctagttcaagctgttacacattggattttgttcaatgctctttagacactttctctggagtggttgtagattatataactatttggcattgcagcagaatttaattttacctgctgaggcaacagcataatgatcctcatctggaagacagtttgactttcaaaaagatggtttagagctactaagataagtgaagttgtttacacaggcttcatcgtcagtggcatctttgtagctcagcagtccacttaatggattgatactttgctgagggggcttctttgctatcttgtaagagatcttcatactttgcacaccctgatgaagtccaggaggttgacctctctctgggaatggaatacaccaaattcacttcatagaactgcagaatgtcaatgttgcagggtcaccccagtgacaaaaaggtttcactgatttatactccctcattttggagttgaggaaacagacctagaatgtgaagtgatgtgcccagtgtcaaacagtgatcgggtaacagatggaacttgaactggagacttctgaaccttagtctgaagccccttaatgatactgtttgactttctgtcagttttttggaatatactagactgccctagggcaagcaatactatcaagttttattgggaagctacaaaatgcagtgaaagcagaagacctggcttctagtccctatttgactccttattagccatgtga

SEQ ID NO: 64518 - DNA, 1064 bp, Homo sapiens
ggcttcagactaaggttcagaagtctccagttcaagttccatctgttacccgatcactgtttgacactgggcacatcacttcacattctaggtctgtttcctcaactccaaaatgagggagtataaatcagtgaaacctttttgtcactggggtgaccctgcaacattgacattctgcagttctatgaagtgaatttggtgtattccattcccagagagaggtcaacctcctggacttcatcagggtgtgcaaagtatgaagatctcttacaagatagcaaagaagccccctcagcaaagtatcaatccattaagtggactgctgagctacaaagatgccactgacgatgaagcctgtgtaaacaacttcacttatcttagtagctctaaaccatctttttgaaagtcaaactgtcttccagatgaggatcattatgctgttgcctcagcaggtaaaattaaattctgctgcaatgccaaatagttatataatctacaaccactccagagaaagtgtctaaagagcattgaacaaaatccaatgtgtaacagcttgaactagatgaagaaagagagggctattaatcttttttttttttgagacggagtcttgctctgtcacccaggctggagtacagtggtgtgatctcggctcactgcaacctccgtcacccgggttcatgcaattctcctgcctcagcctcccaagtagctgggattacaggcacgtgccaccacacccagctaattttgaattttttggtagaaatggggtttctacaaaaaaactccattttttagtagaccagtggccaggctggtcttgaactcctgacctcaagtattccatctgcctcagcctccaaagtgctgggattacaggtgtgagccacagtgtccagcagggctattaatctccataatctttagctcattttcaaaatatcaaaaaccatttcactttgtgaatatattaaaaattactaaattgtatactttaaatgaaacttaagttctttgtatactttaaaagaaatttaatttcttatatttaaaatacatct

SEQ ID NO: 64519 - DNA, 1052 bp, Homo sapiens
gttattatatatttgaataaacagtgctgtgagtatttgccgtgaaggagctaaaaatttttttttaaaaaagaatgagcctaataaatctcatctgttacagggtctgagagatacgtcagggtgagagagacagagacaggtaaatagacattgacagttgtggttcccacactttttcatccttggcttattcatccctagggtgcaaatagctatgggcaacttggcctcggccataaggaagatgtgctgttgccccagcaactgaatgacttctgtaaacccaggagtgtcaggaggatcacaggaggagggggccactctgcagttgtcacaggtaatttccttcaaaagtagatagtcactcattttcttatttagacgttttcccctggatatgatattgccatctttcagccttttgtattttgcagaggaaaataatgtatttttgtgaaacatttttgtgaaagagccaaattaccatcagaagatcctagattttcagggctagaaggacttcagagatcttctaggccacccctttcccccaccccctccattatacaaatgaaactcagaaaggaacactgattgcttaacatcacaaggcaaagtagtggcagagttacaatgtatattttacaccataggaattagaagtctttgtaattagattggatattccttgagagcaaaaactgtgtgttccccttaatcttcccttactgtatctaggatagcacttaacaagtagtacaagtgctacaatgttgtaaaggggggcatattgcatctggttgagaacatgagctctggaatcaaatctctgggttcagatcctggttctgtgacttattatctatgtggccttgggcaaatagccacagtttctgaatctgttacatgaggataataatggtgggtgaagagaaccagtgagttagcagggctccattccgactgtcatgggtcgttggtgcttttccctttatggacctcttcctttgtaaagaaaaaaattatattttacaactgtgttggtataa

SEQ ID NO: 64520 - DNA, 1056 bp, Homo sapiens
accatagatgcatgccaccacacctggctagtttttgtattttttgcacagactgggtctctccatgttgcccaggatggtcctgaactcctggactcaagtgagtctgcctcggcttgccaaagtgcggggattacaggcatgagccaccacacccagctgtttcttatactcaagattttctttttcatttctcttacacttgatcaaatgttgctttataatttttctttggtatctggagcaactatattttgtgttcccttcactatcagactgtaagcaatttggagagcttgtgttttattattttaatgtcttcaagataaatataaggctggacacacattaggtgtttcatcttctaagtagtattttcacattttgaacttaccatcttccttcaaagtaaaattatctggtagattcacagagagaacattggtatgagacttcagcagatgaaaaatatcattcaattgttctctgttgatgtcacagtcaacaaaaatctcaaattctgagtttcttctttttgattttcgggactcgatatgtaacagattcacatgcttctcctgtgtaaagcacagggaaaagatttcatgtaactgcctcaaatgttaatagtctttgagcaggctactttaattaccactaaaaatcagattcacacttctcagaacagcaaagggaaaaagactgtttttagtgctgccaacaacaaaataattccttcttaaaaattatgtattagaaaacttttcaaaattcatcccatcctccagaaaccaataaaataacacacactagaggtccttcagatgtcagaattaatcagaattcaaatcaaaatattattaagtttcctgggtaagaggaatcttttgaaaattctcataaataaaagctagttttcaaaaagtgataccaatgttagtcctggagaaagaagagtttccctttcaaaaatccatttaattaaattagatgaacagcttgagcacagagtatttaatacctcaaatctcttaagctacaatcttagtaacagct

SEQ ID NO: 64521 - DNA, 1007 bp, Homo sapiens
ctggattcaacattataaatgtgaagatggctaagtcatgatggccatattttgtcaaaatgctatttatatgtgaaaatgttggttttacttgacgcttattattgggtattataatttttatgtcaaagttcaggtaataaattgtgtcttactttgatttgcatttttaaattaatgagattgaaatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaaggtgggctgagaatacacgagtgctatgtcatgcaaattcttatgtcatatttaggggatttagacttcatcttgaaaaagctgaggaactactaaagattttttacttttaagcaccaagtgatacgatcagtttagaaagattactccaaaagcaatagagaggaaggagtagagagagttgaggctggagggcaggagatcaactaacaggctcttgtggttggtaatcttcaagaataatctgaaaaatgatggcagcctaaacaatggaagtttgaatggagaggagggatgggggtaagagagatttggtagaatagaattgagcacttgccgggaggagtcagcaggaggggagaaggaaaagtcttggctgtgttccaagtttgtagtctgtgtagcagggtggatggtggtgcccttcactaaagtaaagacgacagtggagaacatgtttgggttacataagcctccttgatgttggtgggttcaggtgggacatttgaaatgcctatgaagtcaggagggaattgaatatcctgatttgtttttattcactagttaaagcttgaaaaattttccttttttgacattaaatcttgttgttgttt

SEQ ID NO: 64522 - DNA, 1043 bp, Homo sapiens
atccagccttgggctcccaaaagtgttgggagtataggtgtaagccaccatgtccagctttttgtttgtttttttgagaaagttttttgattgaagatacaaaatttcttaaactcctgggacactgataaattcctcatttaaaaatgaggaaagataagcaaatttaaacataaaagataagtaaatcaccctttagaataagtactgctttggcaagatttggttttcttagaatagctttaggaattttgcttaaccctattgcttttagcagtttgtttttcatttcaatatctgttttattctctgcagttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacggtaggtgagctcttttgtgtaaaatgttctgggaaaatgcaattgctagaagtattctcagatataaaagtcttcttatattccttacaacagaataaagtacatagtcactccttgttacgttaattcactactactatttgtgatgcaacctgtatagtggttacaaagttcctgttatattatcatttagctataggctgttactcaacattaactgtggtttctgtcttaccatattttatgtaatttaaatcaaagagaaaacattttcttgtgctttattttacattgaacatttaacaacttcattaacgttgcacatcatttgcttttttttgctccttgtgtttatatgccagtcttcaataagtgaccgatgttgggactctgatgtcttgccaagagtgattactaagccttacaggtcattaaaactgtttattgctaatcactagaaaattaatttttaaattgatctgcttagtgtttttcttagtgcattcttagtgctgagtaagccacatcaaaacctattaattttgtg

SEQ ID NO: 64523 - DNA, 1655 bp, Homo sapiens
atgattcacatcctgggtgagacggtgcaagatttcatcgtgctgctcagaaaggcatgcaatttaaaacatgaattgtttatttctagaattttctatttagtacttttataccaaggttgaccatgggtaactgaaaccatggataaagagggactacactaatacattatgcatttcgccaccagagtaatcttcctaagatactgtttcagtatgttgtctcccctccttgagcatcttcatgattccaaataacttcccagattaagtctaattcttcagcacggcattcagagcccttaatctcagtcctttatacctgcagtatttacctcatgctgttcacccactttgtgccacaaccagagtactttattgtctacagtattcgccatgtacatgattcccttcctgcctttgctgatactttccccttatttgaatgtctgtctttttgtttgcatatctcattcctatcaatcatttaaaactcattttatcgatagaagttcttctcgcatagctcctgcctttgccctttcttgttcttacgtttttcatcccttctcaaatactgtaagcttgtcaaggttagggtacaggcagtatatgtatttctttatcctgcctcccctccgccttgccccaaaacttggctcagcgaaagtttttgttcaagttgatatttttgtttacgtctttcgtctcagagccattgtgacttgtaaaatttgatttggcaggaaatctgtgtgggaattttaggtaatatggcctgtttccaggagatatgtgtgtccatcagcagtgataaaaatcttgggtaagtcttactatataattatgttttttaatatattcatttatatccttaaggaaattctaatacataggaaaagtagcaaatctgaaagacagtcctttctttgtcttgatgaacactctgtgggaacttcattgtgtgttgatgatagctaggggcttcttcaggagatactgaaatgattcaggatttaagcctgttttcttcagtagcaaaggaacctgaattgtcagctggtggcaataagccagataggggaagaaccagtgggccaaaacttggagatggggcagccaactggaatccaaaacagtttaggggcagggaatccaatgactcagctggagtctacagaaactagatttgttgaataatgtcatcctgagagctctgacttagagtgtaagacttgccaacaactggaagataaagggttgcctctctgatgaaaagactttcagatatctgcttcgaggctcgttctcttctccatgtgtaaagttctgggcagaaggtgttttaatggaggaaaccccagtggttactgtgttcggagaacaccccgaaattatatgctgaattttgtgagtgtattagttttctaggcaaagggttcatggcttttaatcagaatctcaaagaaatttgtacccaaaataggttaagaaaactgttctaggcagtttttgtcagagctggggccatgagggttttatcacaggattcaagtacctgggtttctcagaaagagagaactcctagttgtggagggactttaagatcctagttcagagtatttattcctcagtaatttaccatcatccatgga

SEQ ID NO: 64524 - DNA, 1061 bp, Homo sapiens
aggcaggcttactgagcactttcctaccacataattattgtcacgcatctctatggttattgtcttctttacagatttttgttttataataatttgtattcatccatttcccaacccacttgctctggttcagggttgagggtggctggagcctgtaccagcagttcaaggtgcaaggcagaaaccagccctggacaggatgccatcccatcacaggtacacacacacccacactcactcagattgggaccatttagatacccgttgtgctaatgtgcaaatttgggggatgtaggaggaaactaaagtacctggaacagactcatgcactcttggggagaacatgcaaactccacacagacagtggccctggccaggaatcaaatttttttctcatcagcgttacgaggaaatgttatttgatcacctgctgtatttgggtacctggttagtattgtagacaacttttattcatgttttctttctttgtgtttctgaagattgttagccctgaaaacaccaaatctagctcagatgatgaggagcagctgacggagcttgatgaagaaatggagaatgaaatttgcagagtatgggatatgtcaatggatgaggtatgaggctggaaacaaaactctgaagactgttgggtgaggagatggtgaatgaatgttttaaaaacggttcagtccttcactctggggaaaggctttatctcctgtctgtaatcacacccatatatgatatagggaatgagatcccaggggctataaatgctaaacttctgtctttgaggctggaggatttgagctctcaacagattcggactaaatacgtagctcttatgaatgtattcctatacacatgtaggccgggaaagttctgatacttacctacctaaagagagctctggccatatatttgacagcaggttaggagttagaagaccactgatataccatgataatattagaaggaaaggacaataaataattatatgtctgtaattgcagtattaatcatagtgttttaatatctgtattttattctatagctcaaaa

SEQ ID NO: 64525 - DNA, 1027 bp, Homo sapiens
gcttgagccagaagttcgagaccagcctgggcaacatagatcagaaggcgaatagaataagtccgctagctttgagattcacatctgttcctgaggcttcctcactgctccccacccttccttcttcaatcagtctaagagctcctggagaaatggaacacctgattcagtgagggtgacaaataattatgagtatgttcgtgccagggtcctcgataggatggggtgggggaggtcaagccgccttggcagctggccaggctccgaacagcagatggcgctgtagggggagtcccaccgggtacgccgggcgctctggcactagggcgccggtcgtctcctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccaggtgtggaaactcgcgccacgcgtggggtgtccctacatcccccaggcaccggggctccgcctctggcgaatcctcctgccccgggagccgccatccccacaaagacccctccccaggcgtgcgctgcgggaccttgctccttgcgtttcgccggccgctgcggaccccaaaactatctgggccccctcggggtctctcgacacaaagggaagtataatggtagggatgctgaaatacttgccgttctattttgctttcccaagttctccaaaaatacatgatcgtgtaactgcattcctcgggttttgctccccatccccactgtcatttctgaagcccaggtccttaatttatgtatttcatggactatcgttgtaatagaataaatggtgactttagggttatacaacttttatattaaaaacgtggcttctgaccaggcgcggtggctcacctctgtaatcccaacactttgggaggccgaggcggaaggatcgcttgagcc

SEQ ID NO: 64526 - DNA, 1049 bp, Homo sapiens
cctgccaagtttcattaatacctcaatggagttcttatatgtcagttttggcttgaaggacccagtaaactatttgccatccaatgtcagtcttgtgaggggcccaatctcaaatttataccttctcatattctgtactcttagaagttaatgctgctctcagttaataattctttatattaaaatttcccttttcaaattactgcctggtttctgtctcccaaagggaccctgactgataaaacagttcttctctatctggctctctctccactgccaccacttccacaactttgatctagttaagctccagaaactcagaaaacattcataaaaggagtcgcattacatatttagacttgaaagaaggcaatgaaaatagagtggaagagaactgcattggaggtattttttagatggagtgggtagaaattcattaatgcctggatttgtaggtgttgctgagaaatgaaaggaagactcgggtggcagtcgctgaggcaggacttcacaattcaattgtctgtagcccctgcctccagaaacagagatcactgaggaatgaagaactgagggacagagaaggtaacaggaaataattcacaggagatgagaagcctgggcaaggaagggactggaaatagcaacaatgtaaccacaaaggtctggaaaaaaggaggtctaatttgtggaagggttgatgcaggtgtctgcactgtgactactaagaatgtctcctcacatccaaacacataggcctacctaggctcacccttcatgtgggtgtgcattgatttcccttttgtaccaaacaggcagtcagcaccaaaagaagaacacactgtttcaacaaattccacctcttaagcatttattagatgcctattatatgccatatctcagcttctctggacatagacctcactaactttgtatccctgccccgagggcctcatagccaggtctcctgagagcagagtgaagaggaagctcagtatttctcaggcaggccagcaggtcggaagtgattggggtctctgccactcctg

SEQ ID NO: 64527 - DNA, 1034 bp, Homo sapiens
cagaatggggctgatgatcacatggctttgcctaagttgacagaaatattacagatacagctggagttaaagaccttttctttagcgctgaaacactgatttcttagggcagtttagtaaataatgtgaatcattatattgtaagtttatatacgtgaaatactattatttgaacagagaagttgctataaacagtctttactaagtccaagttgcctccctaggacttattagggagaaaactgaagaatgaaaacctgagttttctcagtaataagtttttattcatgttagttttttgttatttgacttctagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgagtaagcccttacacataaatctctatacattctagggaatccagctgtcagttttaagaaagccatagaccaaccttgtgcagcctgtggcccgtgggcctcatgtgttccaggacggctttgaacgtggcccaacacaaatttgtaaagtttctgaaaacatgagtttttttgtgatttttttttttaatagctcatcagctattgttaatgttagtgtattttatgtgtggcccaagacaattcttcccatgtggcccggggaagccaaaaattggacacctgtgccatagactatgtccttttcaagaaggcacatgtatgtctgcattcattgaagattgtttgtgtagcttataaaaattgtgaaattccacaaagtgttgaaaaattacatcaccccgaagcagatctattgagcagagttttaatttagtacttcttccatctttcccctgcataactcccctccttcccccataatctcttcaaacttctgggatctcacaggagtattatattaagagtaggatgaccaaggatctagacctcatcctggctctgcgta

SEQ ID NO: 64528 - DNA, 1940 bp, Homo sapiens
attcctaagaaaattctcattaaatctttctccagcttgctaagcctttttaaagcaccattgaagttttatgttctatattagacttatttcttttttcttttttttttttttgagatgaagtctcactcttgtcccccaggctggagtggagtgcaatggcgtgatctcagctcactgcaacctctgcctcccaggttcaaatgattctcctgcctcagcctcccgagtagctgggattacagatgcctgcccccatgcccagctaatttttgtatttttagtagagacggggtttcaccatgttggccaggcttgtcttgaactcctgacctcgggggatctgcccgcctcggcctcccagagtgctgggattacaggcgtgagccaccgtgcccggcctagacctctttcaatatattggccatttgaatatagatttacctacaaatagctattccattgcgctgttgttttattaggcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgtaagtattctcacctttaaaggattttgtagggtaagatttttccatcttcggttgttcttatttacctctaggatccccaaatttgttgtcctttccatttatgttttttggtgggaaggggtgaacttttgttcagctagtggctcagctctgtgaagcctccatttaggtgtgtcttggagccacattttgttttgtcattgtttattattttttgttccctgatatactcatatagctcccagcataagttacgttgctctaatatgtgattttaggtgcttcatgctaatttgagcctgaatgcaggtctggattatctcatttaatccccattctcactaccaagctttatgaagacaagctagagaaatatggcagctgatgccactagcacacggagtgacccagctgccaggcacctaagccttgctcatcagtttgttctaataagccataatggttgttattaactttctatttgagtgttggtatttctctgcagaagttatattaacgttataaaggaaatttttacctttttttttttttgaattcttttaatttttaggaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaaggtgatgaatgtgtctgttgttggttcctgatgtgaagccattattttccacgagctcctgttaccaggattatcttgtgcacggaatttctctgaagtgttaataatttttaacatgttgatagaactttccatccagatctacagatctgccccctactagaagagttggtttatgtttagtattttttcccctcacgtttggactaacattagggcctgtttttgatcatgcatcaaaatgctggaaaggttatgaaagaaaggtcattaaccaaaagagtgggaagattttattctgactaaccaaattatttttcatcaggattgaaaaattactgcagtttttgggggtcattgccttcctttttcgatgtgcgagtattcctgtggctgaactagtgagaagagaataatagagatcctaaactccctttttgacttatggggactcagggttagtaggcaaatgaaggtacctgcctcggtgttttatgtggaccatcccatgcattttgtaaacctgtgttccactcatt

SEQ ID NO: 64529 - DNA, 1048 bp, Homo sapiens
gacagatattttcttgaaggcagatattttctcatgaactgtatattgatttacatactatgttaaaatccattcattgaggaccaggttgtaacactcgaaccttatagtctggcctctaatgtagattatcctcttttaatgtcccaattccttttcacagaaaacagcatttttaaacataagactttaggtcagagagatatagttctttcttcacatcttttattcttgatctttttagaatagtttctaaaatatgatttcttcattgaactgcaagtagaaaaatagagatgaaattcagtcaagccaaaccctacgtaagaaatgaatttattagaataattgcatcccttttaaaattgtaaggggtatttggttaacattttgtatgttcacacctgtggttttcgtagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagtgagtcagagcttacctagacatctttaccatggattggtgaaactctcctaccttgcaagattgtgttacaaagttgcttgattttattaaccctgtctgtgtgacctacagatacagcaatacatgcccagagaaagcatgatagatatatctaggggtggatagagggtaagaaagagggtacaattttcatttaaaacatcaaatttacatacaaatttgtttcagaacttgtttttaagggggataattgcgtatatggtaaattttaattaaattattattattattattttgagacagtctcgctctgtcacccaggctggagtgcagtggcgcaatctcggcccactgcaacctctgcctcctgggttcaagcaattcgcgtgtctcagcctcctgagtagctgcgactacaggcgctcgccaccacacctagctgatttt

SEQ ID NO: 64530 - DNA, 1026 bp, Homo sapiens
cagtggcacaatcttggctcactgcaacctccgcctccctgtaagtgattctcctgcctcagcctcccgagtagctgggattacaagcgcatgtcaccatgcccggctaatttttctatttttaatagagacagggtttcaccatgttggtctggctagtctcaaactcctgacctcaagtgatccacccaccttggcctcccaaagtgctgggactacaggcgtgagccactgcacccagctgacccttttctttttctggaaaatatctagtatatgtgtctgaattttcccaatttggcatcattttatgctatttattagtgggctgttgttacagacagaaaggagttgttaggactcgattagctggatcactcttgtgttttctttgtacagtttgattttactttaatagctaatgcaaggatctgaattcggggaattataaacttttgtatcctagcacacttgaattctcttcacttcttctcttgcagtgagcattgtgtgctgacttggacagaaagaggaatttatattttcattcctcagaatgttcaagttcttctttggagtgaagtcaaaggtaattatatttttctttgtaatttttaatctcatgcttatgaaaatttgattattgtaggagcattctcttgtaatttaagaagttgaaaaataggatgggatgacttttttttttttttttttttttttgagactaagtcttgctctgtcacccaggctggagtgcactggtgcgatcttggctcacggaaacctccacctcctgggttcaagtgattctcctgcctcagcctcctgagtagctgggattacaggcacgcaccaccacacctggctaatttttgtatttttagtagagatggagtttcgccatgttggccaggctggtctcgaattcctgacctcaggtgatctgccggcctcagcctcccaaagttctgggattacaaacatgtatgattacaggtgtgagccaccgtgcccagttacgtttct

SEQ ID NO: 64531 - DNA, 1024 bp, Homo sapiens
ctgactaacgcggtgaaaccccgtctctaccaaaaatacaaacaaaatttagctgggtgtggtggcgcatgcctgtagtcccagctactcgggaggctgaggcaggagaatggtgtgaagggaggcggagcttgcagtgagccaagattgtgccactgcactccagcgtgggtgacagagcgagactccgtctcaaaaaaaaaaaaaaaaaagattttattctatcttttcagagtgaagttggatttttatttttattaaaagattcagaaaaaccaaagaagtctttgataattacctctcctatgattagtgtcaggcgaataagggcagatgcagttaggctcttgaatttgttttggaggcaaaaatttccctatattgggaaaagtgtaattttatgttatacttttaacagataaactcattaacagatgtgtttactttctagatcagaacctcagtatgatcatacagctggatcctcccagtctttgtctttccccaaactcttacatcttaggtaagtttctactttccttagttctgggggggaaaaagaatacttagatttttatctctgtttcttgttcagaagtagttttttaaggttatttttgcactaaattacttatagaaagttaggaaataattatgttacatgaagtgttctgtatctaaaaggaatggaaagatcctagaaatacacttctctttccaagccaattggagagtttataattgccaagaaacttctaacaattggagctaagatagctctactaaccgcctcataacctctcctacctaatgggatgctataatgaaagcaagtcccagatcaaaatctgccacacagatgtatgtgtttttagcaagcaggcacaaaaatagttgtagaacttgttcttgtaagcttggtgaaatttcagctctctatcctataggtactctgacaaatgcttgcatgaaagatctgctggaggcagtttcagccatattctaatgtcagagttcagccagc

SEQ ID NO: 64532 - DNA, 1128 bp, Homo sapiens
ttgctggtgagacatattctaagtgccatgagagaaggctaaaggcctgtttttagatgggaaagcaggaagtcttctttgagttttgttgttttcaagatttgttttattttaatagaattttactaaagggtaaaattggatgaaaaataattaagagctttatgaagataagtatttcatcaaaatctcaagggtagatagagccagaggtacaatgaatggcaaaggagtgcattagaggtagctgtgaaataccagagcagaatagcagacagctggaaatgaatattatgcatcactatgccaaagttctcagccattctcactgcaaggaaattttcactggccatttctttttttcactgggcctggcagctatcatatttctcaggaccatctccttttaaaaatttatcatggagagttttgagcctacacaaaagaagggagaattgtgtaatcaacacctgtgtacctatttcataactaaagttggatgacagtatcatagaacctcctgtaaaaataacatgtttagacgtgctttctgttagctagaattcagcttttggggacatgtgtaatataataaaatatatacttatgttaaaaaatctttttgtttcaacctgttttccctcccaacaaacagttttttggttttttttgtttctttgtttttttttttaaagctgagactcctagtgactagccaaagtgatagatatgactttgcttcatgtaaatttagtgttaaggattaactaaggtagcatatgtgaaaatactcaactttgtgcctgtgacgtattgtttgaaaaataatagaaagtaagattaatgagtatacaaatgataatgaattgattacatttttcactcagcaaacatttattatgttcctccagctccttagcactgtattaggtaccatagaaaatataaaatgaagaaatatattttatttcccaaataaggagtataagtaataaaaccactacttcctgtacagctctgtatacatttcaaagcactcttacacctatgttcttaaagtaaagcaaatgttatattttattcataaagcaattaagtacagaagtagttattgaattatctgaggtt

SEQ ID NO: 64533 - DNA, 1028 bp, Homo sapiens
tctgttccaaaactatctgtcctttttcaaatgcattttaaattgacacatgtgtttgttagggtgaccaaccatcctggtttgcctaggattgtcccggttttaacagtgaaactcctgtgtctcaggaaatctctcagtacccagcaaaccagaatggacagctggtcatcctagtatttgtagaaaatgctaatttaaggttacaacatttcaaaggccttaaaagataaagggaacagagataatttagatcatttaacttctcctattaaactggtttggtgactaaaacaaggaaattaataccttgactttttataatacttcctcttttctgaagaacaagagttgcatatgtatttgatatagttgatactgtgatgcaacaaaattgtaccttgttcactgttgccacgtttgcctctgtgactcaattcttgcagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggtgagaagcagtcccattctttgtgtatgtagtgagatacaaggtgttgtcttataaaacttccaattaaaggatgtgattttatctactgtatttcttgggagactaatccggagtccaaacctggagattttgaggagacctgtttttatatagtacacacggtggcctgttagctcaataccgttacagaatggcttttgtgaactaacttcagtactttgcacattatctattgcagtccttcctgattcacctgcatggctcatttaaagcattctttagtataaggctattaagaaagaaaagatatctatttattattggtgtgaataaagtgacaaacatagaaatgacaccaattgcccaggcttctggtcttctctgct

SEQ ID NO: 64534 - DNA, 1030 bp, Homo sapiens
gagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaaggtagtagttccactaggcaaggagctttttgtgggtagggattgtgttttgttcatccctgtgtctctagcggtgtgttcaggtcctggaacatagtaggcactcagaatgttgaatgaatgaatgtataaatgagtcagtcgccatttgtctgaggcagagagttgttttctgatcatttcttcttggatagaaagatcccattgtgaaaatgaggcagtctgcaacttccccttctcatttcttcaatttttgctatctttcttacttctttctcctcttcctccacgcacctactggggcaaaagagaaacatgtttgcatttgatgtgtgagcaacaaacactgaactattttacgataatggaaagatgagatttggattcaggagacgcgtattctaatctcagctctaccatttatgaactctgtgatccttgggcaagccagtctcccaaaagttgtttcatttactttggttaagcatttgtcgccaacttctatgttcttagtttttggtagagtgccttcacagaagtaacatttaaactcagctttgcagaaaggtagggttttggtaaatgggggaagattccataaacatcatatattaaaccatggaggcacagcaagtttatggaatgaaaaagaaaaaaagagtcgagtccaatgtagttggagaatagagaggttaagatgggaaataaggctggaaaaagaagcagggaggagataacagattttcaagaaatagagctgttgaaggcttgtacaatattatgtatatattttttaaattttattgtgga

SEQ ID NO: 64535 - DNA, 1017 bp, Homo sapiens
tcctctcctccatttatctcttgcacattggaaaaggggatgtaggtaatggaaatgcagaggtgcagtaatgtaaagatttgtattcaaccagttcatattcttccttatcactgttgccttttaagagcaagatccagttattagaatctgtatgagaaatggtacattgatctgtgaattgaaaactatagtggttcccggagtttaggcaaagatgtatatgcaaagattccttattatgtcttagcaagagattgtattcttttaacagcaagatcttaaatgatgtcattgatacttcttggactcttcttataggccaaacactatattactgggtgctatattacagagaacccgacatatatggcctctgccctcccttatgaagcttgcaatctgtcaggagacgtgtacattaaaagaatcacattaaaaattatgttgttgtaagtgccatgaagaaaataataggagactttagctggtaactttgaagcttaacatagactgaaaaaaaaaatgagtgaaagttagccagttgatgggaaaggaagagaatgtacaaaggctcagagcaaggtatatgaatttagattcggacaaatacatttttaactgcaaataaattaatgcctttaatatagatcttgctatttaaggaagtcttagaccatttcataagtaaatagtcttttagtaaagcgagatcttcattgacctgatctgtttaaatgtagcctacaccaataactttcataaatttctatggctcttatagagttctcctgggaagaagtgtttgccactcaaggaatacactcaagaaaaacctggaaatcacagaaggcattgtaagatagctacagtgattctgttaaacctcctgaaattggtccttgaacaattaagaggtgctacagatgaccaggaaaatttaccaggcaaattagctgtgagacaattgaccatttgtgcccaatgttcggtaatttatctcagatttatttttta

SEQ ID NO: 64536 - DNA, 1022 bp, Homo sapiens
ctcagttttatttatacagaagaaacagaccagaaatcaggaaactttggtgtggtttcagctctgggagtggttctgggaagtccccacatatcttgcagactttagtttcaattgaaacaaatttgaactaaataataaatatgactgtaattctacagttttacaattgtaaatatagactatatgaaagactacacattttcaaattgtgtgtgtataagaatataactgaggaaaataaattaataatactcattagcatataagtattgtataaatttacacctgtggtatgagcaaaatgaaatttaattgtagaggaatgatgccgtgcaactttatcttcaactttgaatgagaaaagagactttcttcttccccgttaatttcctacagtttagattttatatttgaaagggactctagaagtcaacaaattcaaccctaattgatgtgtggaatagtttttttcttcatcttttttttctctcttagcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgtaagtcagctatactaagttctgatgtatttgtatgtcatagttgctagtaattttgtaaagagattatataaatctttattttatatcaaaaaatcaactatgtagaaataattacaaaatggggtcactgaatatatactgttttataacctgaccttttcacttaataacagaacaggtacaggtttacatataatatgtaaatctacctgacatatagatctccacacactttaagagttgcataatactccactaaatgaatatacaatcatgtatttaaccagccctctgtggttggacacttaggaagtttccagaatttttttattgcagtgtttgcactaatatc

SEQ ID NO: 64537 - DNA, 1028 bp, Homo sapiens
gtatttgatattacaaatagttattattataagatttataatataagatttaagtatatgggaggatatgtataggttgtatgtaaatacaccattttatctaacggacttgagcattttcagataccaacagacagtacactgcagacatggtgatctttgaatcactgggatacggagatgaataagatcaaacccatgtcctcaaagggtttaatctttcctttacacctacctccatttatcaccacttcatttgttcctccaaaaatgtggggtattttgctcttaattactgaaaagtgaactgaaggacctctgctgctcaaacatcacaaaataaaagttgtgtgtttcaatgttttgtgttgccaaaatctttttaaaatgtacctacatggtgttttattctagaagttcagttatattcagtatattctgctttacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggtatgtgagccttctagatttctgaagaaaataaaaattcaaaccccaatatgtgtcttaagaccattattccttttgtaaaacttagcatttccttaaaggaaagtaatggaaaattgagtatccatggtattcttcactattattgaactattattattatgtttgtttgtttgtttgtttttaaaagacagggtctcactctgtcacccagactggagtgcagtggcacagtgatagctccctgcagcctcaaactcctgggcttaagcgatcctcctgcttcagcctctcaagtagctgggactagaggtgtgcaccaccttgcctggctaaattttcttatttttatagggcggggggcagctctttttgtatttcccaggctggtctcaaatccctggcctcaagag

SEQ ID NO: 64538 - DNA, 1171 bp, Homo sapiens
atttgaaaatgactctttcagagtttggactaatacttactttttcaaatattttcaaatgtagggctttctgctgcctttttaaacctttgccatattttacttacaatacaaggttaaatgtatcatgaccatattatagaaaatgtaagatttgtaaactatattagaacaattgggaataccttatctgtggaattatggaatggaattcagtcagttggtattctagtggaaccagaatagtattaacacattcaacaaaattttgaatactatttgtatgtttggtatcttttttggatgtttattagtgaagtgaattaataaggcctttcccaaagaagtcagtcagttaatgttaatttaattatttactaaccaaggtttgtagtgatttttatgactatacaagttttatcttaaagctccactgcctctctgccttcatacttaaacatgcctatttgaccatattagacttccaaaggagcagattttataggtcacttaagaccgtgagaaaccagtcaggcttttttgagtcctgcctctgtgcaaaaagtgaaggtgagggactttctctgtctatgcagttagttcagaaatttttttttccacctttgtccagtgtccactgggacctgagccatctttccctgatgctctaacgtgtatgtgtgtatgggctttgttttaggctgatgtccggccccaaactgatggctgtaacggtctaagatataatttaacttctgatatcattgagtccatatttaggacctatccagcaggtaagaagaatcagttctttcagatggttaaaatatatggatatattctatagtatatcagtgaaaaacaaaaagcttcagattcctgatcaagtgcaataaattatgtaaagtactttttacccagtgcctgacatatggtagatactaggggctcagtaaataatgtgttgtcatcagttcactaatatgactgccattcgagtctgtctgtactactaactcagatcattcttcattctgcatccagagtgaccttcctaacccacaaattacttcccgtgcagatgccatcctaaaagtatagattccttgaccccagcctcagtgatttattatgtgtagacaaggatgagagccagtgtgtcagtcattct

SEQ ID NO: 64539 - DNA, 1562 bp, Homo sapiens
ccgctggagtgctgagctgacagtccagtggatattgagatcattattaccccacaagctaacacagtgccttggattgagagtgcacatatataaatgagcaaacaagcagactcagctctgactcctgagattcttggtatttctactaaaacttcaaaaccttattcttttggtgcaaataaggttttgtttgtaatttgtaagatttatagaggtcatacctcacctaatctctcaagttacccttcatatttataattagattataacttatagtatgtagagttgagagctttatggtctagattttgctatttgtatttcagttacctaatttgagaggttttaaaaatggaaattcagtatataatatttgtgggtttttttccacagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggtaactgtttatctctgatagacactggtatttaacttgccaccctctagacattataagtgttaatttctgagacagataagacatgctgaactttttattttgttgattttctaggcctaaaaacaatggtttcattaggagtgaaaaacccactactagatttaacagctttggaagataaaccattagatgaggtaagaagcaataaaagaagttttgagagaaaagagtcttttcctagtcttcaacattgtcttaagcgtagtagacctattccacttgtgagaatgtcaaataagcaaaatactgttacttgaagtgatttatcggaagtgctttgaaatagcgttgtttgccattaaaattgcctagaagaaatgaaattcctgtgtgagttgctaaaaccttttaaaaataaatttctagctccctcatccgcagttctctagtaataataaaggcttaatgtgatgagttcagctttatgctctagctaacatttaatctaaagaaatatggataaattaataaataaggaagataacaaacatttgttgattgcttactatctgccaaaccttaagcactctcatgacccttataccatgccaaccccaatgtttcagcaagtaggccatcatgtatgacctacctacctcagcatcatgaccccagacctacagatttatctacttgcagagaaagagatggttcctgttgtgatcaaggataattttatcactgcctctgtcttctaggccagaacttgtcttcctcagttattccctttactctgagttttcattttcttgctcttatttttcttctttttctgtctctttttttttttttttttttttttttttgagaaagagtttcactctgttgcccaggctggagtgcagtggcgcaatcttggctcactgcaacctctgcctcccaagttaaagccattctcctgcctcagcctcccaagtagctggaattacaggcacgtgccaccacacccagtt

SEQ ID NO: 64540 - DNA, 1376 bp, Homo sapiens
ttagccgggcgtggtggcaggcgcctgtaatcccagcttctcaggaggctgaggcaagagaatcacttgaatgcaggaggcgaaggttgcactccagcctgagcaacagagcgggactccatctcaaaaacagagagaaattcagtttaagatgtattttgtaatgctaaaacgagttagtgctatttgttaatcttttatgtgcataatgtcacttgtttttaaatgtttgttcataaatatttaatgttcgtgagaagtaataaaagtcccatcatccagcaaattttttcagctaagcgtgtcttataataagaaaagcagaacctttttaaaaaatttttaatctattatttctcacagggctatggcatttcctctgtgccatctgcttccaattctaaatccataaaagagaatagtaatgctgccatcatcaagagatttaaccatcacagtgccatggtcctggcagctggactcagaaaacagttaagtataaatgcagaggtgcagtaactgggcttttcaggatatccagatggagttgtggtgttgttttgcttgtggtttttaacgttaacttttttttcccctttattttaagagaagcacaaaatgaacaaactagtgagcccagcaacatggatggaaattccggagatgcagactgctttcagccagcagtcaaaagggtatgggcaaaaaaatatgaaccatttggggctcaagtttctccaaatactttatgtgactgcaagtactgtatacgcttatttcctgtgactcagttcttctaactaagatgttaagcatttggcttaaagtgtatagcattacaaagagtatttccccagctttggcttgccagccaactttccattgactctagcctgttagccatttttattgttttttgtttgtttgtttgtttgttttcctcacatgtacacatacatacagattgttcttatatgtgattttgttctctgggaataaaatcttcattcaacagaggcaatatgacagaaaaaccgaagtttcatgtatatgatttttcaaagaaagtgaattggccctcatgttaaacctagcatttcagagctgaaagtgtcttctcattaaatattgaagaaatcatttgagggtgtggagaaggatggacagaattagctgcttgtgtatttattcttctcctgcaactttgccacgctattttgtacctcccttcctaattatgataaagctttcttagagagcagtcaggcaatgtgtattaaatgtttaaagctttacacccttagttctacttgtggacatttatttcttaagaaagatgtatactaagatttagatagaaatattcattacagtat

SEQ ID NO: 64541 - DNA, 1481 bp, Homo sapiens
caagtagctgggattacaggcacctgccgaggagaggatttttttataattaaaacaaaacaaaacaaaaaaacaccaaactggaagataaagtatttacaacatgtaaaagactgtttccttaatatttaaaagtcttattttttaaaaagtacccaatataaaaatagtggagagcataacagatcattcatttggggaaaaaataataaaatgtaaactttcacctaccagattggcaaaagtaaaaagttcaataatacttcatgtggtcagagtgtaagaaaactagtattcttaagtagttgttgagaaaattggttcagccatttgtaggacagtcatctctaggaagagaagctcatggtgggaagacttcattttttaccctctgtacagttttgttttttcagtcatgtttattgtgtaagagaaagttgtgacaaaataaaaagtactgtgttaataattataggcgaaattacaagagtccattgaatatgaagacttggggaaaaataattctgtaaaaacgattgcactaaacctcaagaagtcagataggtaagtttggtcaatattaagcagaatagctatgtaacaattcagtccaaaatatatcctacaagtatagcactcatgttttaatcagttcgtcaccatcaaagtacaatatccttttctgtttaaaatttaggcttctcaggaagcaaaaatgatcaaacccatgacaataaatgtggatctttctgctgttgctttcttattgcccttatgggaattaaattattttattgaaatctctttacttatcgtttcttgccttgaggggaacttagtactgactgctaaaatgttgcaaagacaaatgttgagcatctttactgtgtgtgattagtaatttcttctgtgctaacctgcaggtattatcatggtccaactccaatccagtcactacagtatgcaacaagtcaggacattattaattcttttcaaagtattagacaagaaatggaagcttatacacccaagttaactcaggtaggtgacttctactgtttgaaggccagaattcccatagttccttcctcagtttatgagcacaagcagattgaaccatacaactaatattttaattgggcttaaagacatagttctgctaaataaattgaaaaaatcaagaggtagcaagaaaaggtgtttggcatattcaagaggcatctgaagataagatgataatgaaaaaaaataagttgatgaattttgtgatttttacttccatatacttttattgggaaaatctcccaggtttccaaattctgtctggacattattctctgaatattctgcatgactcaggcttaaaatatgtaaaacagctcatcattgttctttgtttctcttcgtacttcagttgatcagcaatttgtcagttctgccttcaataatacttcttgattctatcacccttatttaggcaa

SEQ ID NO: 64542 - DNA, 1007 bp, Homo sapiens
agcaagctgggaggagtgctgaacttttattggtttttccttggaataatcctgggatttctattttgtagatttgtttttatacattcagattctgaaacacatctagacaagatcttaggtttcagaaccgtcttactattacaaatagtggtacattgctagtttctctaatatcatagtaaaagctcctttcttctcccctacctcttagaataaaggggaaacctgaaagtttctttgaaatcccaagagcttttaaattttatgatctctcagccacaaaattactaacttatctgaaaatagcacatcctggtttggcattgacaaagagtacacattcaaatttattctctgagtggtcatttttttcgagactgtatatgttaaaatagctcttaacctatgggccttgttcttcttttgcagagatggtgccaaatgatattcaatctgaattgaaacacttatatgtagctgttggagaacttctacgacatttctggtcctgctttcctgttaatacgccattcctagaagaaaaggttagaaccagttctgaagacagccagataattgtggtagtgacttacaagaagttttgaaattggaaagttttattgagtcttaccatgtgacagacactgggataactcttttgcatacatcgtttcatgtaaacctcacagcatctttatggagtagctattggtacccattttatagatttggaaactgagatccagacgagttccataactaataatcatacaacttaaaacttgtatctacctccaagccactgtgaatagagacccaaaacaaattacatcaataaagttatttatatttgatacgtttttcagggataacaaaatccaaaataagaactgacaacaaatatagcactagctttttaacactaaaaccgctttaaccaattaaaggacagttgacaaatgaaaaatgtaacattaatagtaatactataaattgctttcata

SEQ ID NO: 64543 - DNA, 1318 bp, Homo sapiens
ggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaa

SEQ ID NO: 64544 - DNA, 1108 bp, Homo sapiens
tttaactctcttgtgccatagggtatctagaagcaaaatatgtttgttaagtgtaaagctgtctctgcttaaaaacaagtccccctaccaccaccaccacacacacacacacacacacacacacacacacacacacacacacacacacacgaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgactgcataaaaattgacaagctatagtaaaactgatagtatatgatatatatattatatatattttaaatattttgaaatattttaaaaaatacatttttaaaaatattttcgaatattattttaaaatatatatatatattttgaggcggagttttgctcttgtcgcccaggttggagtgcagtggcgcaatctgggctcactgcaacctctgcctcatgggttcaagcgattcttttgcctcagcctctcaagtagctgggattataagcgcctgccaccacacatggctaattttttatatttttagtagagacagggtttcaccatgttggccaggctggttttgaactcctggcctcaagcagtccatctgcctcccaaagtgctaggattacaggcgtgagccaccgtgccc

SEQ ID NO: 64545 - DNA, 1901 bp, Homo sapiens
ctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaaaaaaagaatgtgcctcaccttgcaaggcccaggccctaggatcacttgagctcaggagttcaaggccagcctgggcaacagggcaaaaccctgtctctacaataaatacacaaattagccaggcatggtggtgagcacctgtggt

SEQ ID NO: 64546 - DNA, 1284 bp, Homo sapiens
tgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcgattcttctgcctcagcctcctaagtagctgggactacaggtgcgtgccaccacgcccggctactttttgtatttttagtagagatggagtttcaccatattggctaggctggtctcgaactcctgaccttgtgatccacccgcctcggcctccccgaatgctgggattgcaggtgtgagccaccgcacctggcctcaagttgtattttaaaatcttcataat

SEQ ID NO: 64547 - DNA, 1241 bp, Homo sapiens
cgacagagcgagactctgcctcaaaaaaaaattaaaaaaaaaaagctttataattatagagactgtaagtcttgggaaacctgggaatgcatagacaaaatgtgagattttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagt

SEQ ID NO: 64548 - DNA, 1089 bp, Homo sapiens
tttttggaaacggagtctcgctctgtcacccaggttggagtgtcgtggtgtgatcttggctcactgcctccatgttcaagtgattctcctgcctcagtctcccttgtagctgggactacaggcatccgccactgtgcctggctaatttttgtatttttagtagagatggggttttgccatgttggccagtctggtcctgaactcctaacctcatttgatggacccacctcgacctcccaaagtgctgggattacaggggtgagccactgcacatgacttacgtttttttttttttttttattattaaaaaaaatgtacaagggaaacttagtgctaatttcctgaaattaaaaagtagtctaggcatactagaagatttaagggaacccactctttggtaaacatagtgtggtgattgaagtgaacaggaagtatacttaaatgccagatgttttctttcataatcgattgtttattctaatctttcctcagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccaggtcagctttgttgttttaaattttcaacttttagattcgggggtacactgtgtaggttcattacatgagtatactgtgtgatgctgaggtttggggtaggattgatcctgccacccaggtactgagcaaagtacctaatagtttttcagcccttgctgctctcactccctccctctctagtagtctccagtgtcatttgttcccatctttatgtccatgtgcacccacatgtttagctcccacttatagtgagaacatgtatttggttttctgttcctgcattaattagcttggaataatgatctccagctgcatccatgttgctgcaaaggacatgattttgttttttatggctgcataggacagctttattttcactgttcagtgaaggagtttttgggggtgggtttagtaactttgagg

SEQ ID NO: 64549 - DNA, 3624 bp, Homo sapiens
ttggtagggacatagcctctgtctcattgagaaaataactaattgtagctaattgtttgggctatgaatagggaaactgggtttaacatggattaatagtaatctcttgtagggcaagtatttctgaatcaactcagatttttacattatttctcatgaaactggtaacataatttttttctttcctcacattttgaaagtgtcggttcatattgcccccttttctgaaggttcctgtgagacaaatagaaggaacttgggaagtaagcaagtgttttttgcctctgtttcctgcaggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagtaagtgactcattaaagacttaaaatttttggattgaattgtagccatggcagagtgttctatatgttccctggatgttgtgggcatagtaggagttcagaaaattataggcatctttaaacatttgaatgtaattttttatacctttgtttacagtggagcctatgtttggcatttggtcttagattgggaggggtataatatttagaccattttgtttgcaccttgtattagttcgttttcacactgctgataaagacatatccgagacttgagagaaaaagaggtttaattggacttacagttccacatggctggggagacctcagaatcatggtgggaggcaaaaggcactccttttttttttttttttttttgagagtttcactcttgcgctcaggctggagtgaagtggtgcaatcttggctcactgcaacctccaccctccaggttcaagcgattctcctgactcagcctcctgagtagctgggattacaggtgcctgccaccatgcttggctaatttttgtattttttagtagagacggggtatcaccatgttggccaggctcgtcccgaactcctgatctcaggtgatccacccaccttggcctcccaaagtgttgggattacaggagtgagccactgtgcccagccaaaaggcacttcttacatggtggtggcaagaggaaatgaggaggaagcaaaagctggaacccctgataaacccatcagatcttgtgagacttactatcacgagaatagaaagaccggctcccatgattcaattaccacccctgcgtgccatccctccccaccccctgctacacacacacacacacgcacacaggtccctttctgtgagatacaattcaagttgagatttgggtggggacacagccaaaccttatcacacctttgccctaggaaatgttttaggcaaaggatgttttaacccaaaggaggactgtttgagtgcttgatgttgccagttactaggaaataagtttagagagttctaagccatgataaagatctgcacatcttaggagcagacttaaaaggacagtactattttattgtttccaaaggttgtgtgagccattttttaaaagtatgttcagggaactttctcaataatccagagatacttggttggctaaagagctacatataaacatagcatatgcaaccttcagctctttaagctttctcataacagacagctatgccttggacagtccgtgtgtaagtcagccctatggctttgcttaatgatgataaagtggaagcatcagcataattgaagtgccaatttcacgctccattttcatccccatgagggagaatttattccagtaaatgtgtgtttttgatggaatagtaaagaattcttagaaggttgagggctttgtggaaagtgatttgtatgtacccattagccttacaaagtggttctagattgtaaaatgagcctcgaagtagccaatttttagaattcaggaaagtgacaccaatacaactcagagcctacaaccagcacctgcgtgtgatactttgtgattagaatgcagacatttgggcctctatgcattgaatcctcttcatagactgaggaaagttactctcctatggcaggtgcccatttgttgggaagaaaaacctcttatgattttctatgtaaaggaaccttctgctggaaagtatcttgtctgatggcttagtttgcagtatcatttgtcgctgacaggtgacaagcttgttactgtcactgaaagtgctgtcacctcaggatatctccatcattactctatttcactcagcatagtagatcacatcttttcctctacctttgaccagggtgttatttgaaacattattctcatccatgagttgtttaaacatggttgttagcctgtcttttcctgtgaagtgttgtaggtgtctgacaagtggataattatgtacagttattaatgcttggactgttctgttttcaggccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaaggtatttcttcattttacgttccaagattttttaacttgggttgtagaggcactgaccttgcaaaccacaaaccaagagagtttctttgtagtatggattaagattctttatcttcccaaaaaacactaaatgagatgtagggttttgcaccatctttttacctacagagtactgaggattggtctgagcaggggaagagaagtgggctggtggctgcagttctctgcccacaggcagcattaagatgagtgtaactcttctgtgcctgggtggatcaggaggtacgatcagatttccattggttctttgaggtcataccacctaaattgagatcactgattgtgccacctccattttttatctgttaattttcttagagttatataactttagaccagttttcccacatcaaagtatcaggctgccctttcaagccctcttgtatgaaagttgtctcaagcttaatgctgttgtacagaggaaaatctagtaagcgaagtttggctactgctgtctcttgggtcatggagaacatggttttagggataatagcagccacccttgggatatctgatccagctgtagctggagcctggtcaggtcatgtgctgatcttgcctatctcctctcactgtgggggaatggccaaaccatgtgcctcagaagtggtacaaccacatgaatggctggatataaaccagagacccaagagaggactctttttctgtacaatctcttgcttgagtggcatggcttaggaaaagaaagtgtaggtcaaactcctgagccagatcctgcaatgtaatgctttccctgttgagtaagcctttataatatgcagcttaaaagccacatataatgaggtattcattccaaaggttggc

SEQ ID NO: 64550 - DNA, 1033 bp, Homo sapiens
gcaaagtctaactccctgttgtgaaaagcacatttcacttgtgaattttggactactctttcttcttagaggaaaacctataataatgtactataatcttaaacttgaagtaaatgacttaacatataaatgaaccttctaccagggcatgaaaataaatctgattaactcatcaatctttcttttgatcacatagttttatttgtgagccaaacatgtgttgaactattagcagatacatagattttcctagcttggttatatgtgaaaacagatcaccatcattaagagaagaaagtaaaatgggttaatatgagcaggtcaaatcagacaaatgattgaagaccagtagtttttgctttttgtgtttgcttattagcgttacctgaaatataattttcttcaactaaaaaaactaaggcagtgagagaatttctttagactccagccttcacctatgcctatctcccactacctgcaccaccatatctgccttctccctgttaccataagttggttatctttgcttctatctaaagctgatttctccactagaccttatcccctctaatgtactcaggggcatcacttcagcagttccttcctctcaagttttgttctctactggatgactcatcagcacagagaaccatgccctaaaaaagccttaaagagtccaattgagacaaacaaatggaaagacatttcatgcccatgaagaattaatattgtaaaaatgactatattacccaaagcagtctgtagattcagtgcagtctgtgtcgaaataccaatgtcagtttccatagaaatagaaaaagctatcataaaatgtatatggaaccaaaaaagaagccaaatagccaaagtgatcttgaactaaaagaacaaagctggaagcatcatactacctgacttcaaaatatattacaaggttatagtaaccgaaacagcatggtattggtataaaaacagaaacagaccaatggaacagaataaagaacctagaaataaatctacatatttacagcca

SEQ ID NO: 64551 - DNA, 1002 bp, Homo sapiens
ctagtttttaacagtctggataatgtaagttttgtataggacttctcatagtagtttgaagtctcttgaagtctttaaaccaacaaaatcagctgtgctaattggccaacatagttataaaagaaatatcaaaagatttattagatataataaagaagttactttctaagaagttaaccttggaccgaagaaggccagaattaccttcctctaaatttgaaattgaacttgctcttaggtaatagacttcttgagaactttaaaagctgaccaggttgacctgtttgccagttcttttggtagggattgtcataagtattgtaattcatgtttaatgatttcaggattatgaaagggagaggtatttgttttgttttggtgctgagatttggattttttaactgtgaaattttgctgtgtattgacagtgtgatgtatatcttattcagtagcctacatattcaggccttgtatattatttttacaatgtgaaaaaaattgtttttagcttcctacatgccaggcatgccaggtggaatctctccatacccatccggataccctcccaatcccaggtaatgaaaaacgttcttttgaataattgtattacaaattcttctattagatctagaatcaaaataatttgctaattagggcattaaaataaatttaattgcaatttagtggaagataaaacttggtttattcctggaatttatttatttatttatttattttttttgagatggagtcttgctctgtcacccaggctggagtacagtggcgcaatctcggctcactgcaacctctacttccccagttcaagtgattctcctgcctcagcctccctagcagttgggactacaggctgtgccaccattcccggctaatttttgtatttttagtagagacaggatttcaccatgttggccaggctggtctcaaactcctgaccttgtgatctgcctgcctcagactcccaaagcgctgggattacaggtg

SEQ ID NO: 64552 - DNA, 1047 bp, Homo sapiens
aaaaccacttaactctattaaaataaattaattaaatgaaattttcatgattggggtcctacaaagaaaattatcaagctgagttgaaaaccgatgagaaatggctaacctttttctttttactgaaaagcaactctgtagctgacttgaattttttttcattttgtagccacagtcagacttgttggggcttattcaggtcatgattgtggtatttggagatgaacctccagtcttctctcgtcctatttcggcatcctatccgccataccaggcaacggggccaccaaatagtaagtagaattgagattttactttaaaactcatataaacaaaagagaacagaaacctttgtaaaaaaataaagaaaaataatgacttctttgctttttagtttatcaagctagtggattttttggaagtattctgaggccccacatctgcatgtacagattcccaccaaagactggcatttgggcttccatttgtaggtagaaatctaagaatggttgtgctggattccaaaatggaggagaaagtgtagaatagagctagaatttttaaaattatgcatgctgcagaatagccttatttgatcagcttggaagcacatataacttgaaaggtagtctgacctctcctttctctttgcaactacaaaatcagtgttgtagataaggattaaggtcaactgaagcgttcacattcagctattctgggtatacacaattggacatctagctcttagctttcttctctttcgtacagccaattcatgattttaccttgtgtggagtggtgggagcatggagagagtgttgcttctcccctaattggaatatattatctctgttatctctattttcttgaataattcttactgatacttaaaaatcactctgaataattgtgagttggttgtacttattttgaatttactaaatctgcattgatttcactgtgttttgagctgtgacttttttttttttggtaaattttctttaagattataattaaccaaacttgtttatcttacaagacaaatta

SEQ ID NO: 64553 - DNA, 1109 bp, Homo sapiens
gctggggacaagtagaatggggggtgattgctaaagggtatggatttctttttagggatggtgaaaatgttctgaagttgattatggtggtggttacacaactccaaatgtactaaaaaccattgaactatactctttaaatgtgtgaattatatggtatgtgaattatatctttaaaaagctattaatggtgagttaaataatataaattattgagacgttttaaccaatgcaatgtgtggactttatttggatcctgattcaaactgagaacataaaaaacatgacttgagactatagatatttactgatgttaagaaaatagtgattattttagtgtgataatagtattatgggttttttaggttctttcaggctttcattaatgttaacaattagtggaagagattttaagaaaattcatccagctgtaaaatatatgcattggttttaaactaaattcttatgcgattttgcttttcagtacaaatacagagacctaactgtacgtgaaactgtcaatgttattactctatacaaagatctcaaacctgttttggattcatatggtgagtttatgcagtaaaaatagcaatttctatactttgagtttactctctttgttaatgattgtaattttttccatttgaggtttgtggatttttcaattgtgggattgcaccaccgcctaataaaactgttggagggtagcaaattagaagatctaataaaaacatttcatatttctttagttttagttttttatgttaaaaaaaaatactgtacctggatgtggtggctcatttctgtaatcccagcactttgggaggctgaggtgggtggaccactgagcccaggaggttgagaccagcctgggcaatatggtgaaacctcgtctcaacaaaaaaatacttaaagttggcctggtgctcctgtagtcccagctacccaggaggctgaggtggaaggattgcttgagtccaggaggcagtccaggaggcagaggttgcagtgagccgagatcgggccactgcactccagcctgggcaacagagcaagaacctgtctcaaaaaaataaaaaacaaaacctctaacatagaactatgca

SEQ ID NO: 64554 - DNA, 1029 bp, Homo sapiens
gtagatctgaggcaatcctctactcctgtcccaatctagggatcctccagtcttagcctttcttttgccgacccgcagagagtgtggccttttcagttttgtattctccagaaaagaagcgaaaataccagtcccttactgccccaggtgaaatacataccattaccatttcagggattttctaagagtaactacttttaagtgtatgcttcttataacgcgtatttatttgctttgagcttaatttatgatcttcacggctcaagactagtgttttttttttcaatttttaaaaaagcagttaagcattttgtattttaaagccatgatttatttatataattacttcaaacgtggcacctcacaccagagtggaatggcttttgttatgttttgttgtaattttccaaaactatgtaaaatgattgagagttgagtcttgaccagttcaacgtgttagcttgggatagttttgtcaaagcaagaatggtagcaatcagcggtttaagcggtttcaatttttaataaaacacactattatgtgtaaaacttttttaaaaacagactttttccagttaaatcgcccccatagttcttgattgaagaccaaataatctctaaggagaaaatgacagctttcaaaataaagcatatattggttgtgtaatcgtatattttaggcttcttggttttgttttgataaacttgttatccttagttatagaagacatatgggaagccatagaagattgtgacccaggtaaagatccatgttgtaacttttatatatcactttttgaaaaaaacggtatattgttttacatagtatgtaactgaagagtatctgttccatgactcttttttttttttttttttttttagagtcttgctctgtcacccaggctggagtgcagtggcacgatcttggctcactgcaatctccgcctcccaggttcaagcgattctcctgccttagcctcccaagtagctggggattacaggtgcccaccacttcacacagctgattgt

SEQ ID NO: 64555 - DNA, 1048 bp, Homo sapiens
tgaggaatagttgatatacaataaatattgaatgagtaagaatgtttgaaatatggttgtattaatttcttaagtctcataaagagaaaatacaggctgatgtgatgtgataaatataccacttaccctaacctagtatatctgggtgaaggaaaaaaacaatctaatagaagttaattgtgagctcttcagaggaacaatttaaaacctaccaaaaagcagtttgtatttgattaaatgaccttttatcccaaatgtaggaatttattttcagaaacatttattggccacctgctttgctcaataaacactgtgttgattgctgttagaactatatagatgtgtaagaacctgaccctgtctttaggaaactttgagtctaatactggaaatgactggaaggctgtactctgagagaggtccaagggaagtaggataaaaccacagggaagagatgtggtaattctgtcttgaggtctcaaattggaactagaaatagagagatgtaggtgcatgcaaattgagatcacataaatgtagtattatgtaatatttgacacacataatgccagtgttaaaacataactgagcacgtatgaatccatactcaatcaagaacattactgatactgaagttaactatgtagttctccccagtctatctccctgtctgccttctagaagtaccatctgatcactttttattctgtcttctactcttcttgaagagctagttatatccatggataggtatatttaccttggtcctggtatcagaaatggattagaagctccctctgctggtttcatgtatagataccaactgtttagacttttgcataagtgataccatcacagtaactgcaattataattattttttattgtacctactatgtgtattaaatattttgcatatctcatttaaattttataaacactctgtgaaggaggtagtggttttccagatttatgtatgaggaaacttaaggctcaatgagataagtaatttgcccaaggttacatatctgtgaagggcagaactgaga

SEQ ID NO: 64556 - DNA, 1078 bp, Homo sapiens
tctctacaaaaagataaaaaattagccaggcacggtagtgcatgcctgtagtcccagttactcaggagactgagtgggaggatcacttgagcccgggaggtcaaggctgcagtgagccatgatcgcagcactgcattcaagcctgggtgacagggtgaaaccccatcgctaaaaaaagaagtacattattattagttacaaccaaaattgccagtggtcatggcattcacatatatctgaggactccagaattgtgggcttaattggctttgttccacatttgagtgtgccttctgtataacaggccctatattgtgaataaattcctcatatgtgtcattctcgttgtaattacttttctgtaagtttaaggttagacaagaccgcttagtaggattttatatttttaaattgaatttcagagttcaggatcaatttaaaaatttaattttccagaaagaaacatttaaataaaccttaaagcatatatagaactctttcctttactcttcccacccttcaaccttgcttacctttcccaagttcagaccttctccctagatacatgccttctgtctgcttctttttaaacagagttttcactcattgtttatccctatggcctttttctccagccacttgctctttcccacagaaggcattcagtttcctgtattggaaagctccttttcctatttcaaaagaatgctttccctatttaacttgagaatctcttcccttactcttttattgtttctctcttgctataaagccaggttggtcagtgatttaagtgctgttcaccctgattttgttcatttaagtatatgagtaaaataaagataatagtatactattagagtaagtgccaaagtgagtactatacacttacagtgcttagatacttatgagtgagcatttaacatgggctgaaatgactagagaaaattctataaaggccatctggagtttgaactggagtttggacgaatgaataggattttaatagatagtgaacaataggaaaaacactccaggaatgggaaatcagaattaggcaaaagcacgaagttaagta

SEQ ID NO: 64557 - DNA, 2883 bp, Homo sapiens
gtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgttttggctatcttaagccattgtatgggggggattaggaagtaggagggattgtcctacaacaggcccttatacttcaacagcccaaatattttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattgatatttttgctggtttgcatttattgattaaaactttgagatattctttatctcatcaccctgaacatttttccagctagaaacctcggtatactcatcacacttcagagatatggtttgcctattgcacacactcctctgcttattctcccttacacattcatgtctgctctaacatgatagagcttctctccccctaccagcttagagaactgttctgctctctgacccatgttgggagaactgtt

SEQ ID NO: 64558 - DNA, 1104 bp, Homo sapiens
gacctcaggtgatccgcctggctcggcttcctaaagtgctgggattacaggtgtgagccactgtgcccggccataatgttattataggtaaataattcacttcagtctcaagccagaatactatatctttttctccctcttgcccataaaatttcaaactaaagtgttggaagagaacaagaatagaatgttagttaatgaataaatgcttcttgctgtttatttttaaaagctattgagataaacctatattttattattttaatggaaatagtaaggtttttgtggtgtgtgagttctttttcccacgacaatttgagtctgtggcccctggtaaaaaaatatccctgctagtttgttttcagtggtaaagccttgaggcattttgagagcatcagcacaatccatgtgagctcccagttggaattttcattctttttaaggaaagtggtcatctcatgtatattgacaaataccctttaaaaattctttggcagcttaagactgggtatgcaagaggacttagaggaaatgagacgtgaagaagaagaaatgcaacgtcgaagggccaagaagctgaagaggcgttagctgctgcttttatttttgtgaaattctagagctgctctgctgcaaggatttcctgccttcagactgaagaagcccccttatcattttagatttatacttgggtactcaaggagaaggaatgcatactgtcatttgcaggctgtcatttgagcataaaatattttcagatattttccagggtgaaatctgtaatgcagatgatataatgcccacttgtgctcttatgaagttaactgttcacagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagtctttttatgagaaacctggaccttccatgaatgttgccagcaataaagtgacttgtcctaatctatggattgagaacttgaaaatgtagagtag

SEQ ID NO: 64559 - DNA, 1094 bp, Homo sapiens
cattctttctttaatcttggttctgaaagtgtttctacccattttgtattttaatttttattaacagaatgctatctaaaaggctaaaatagagataagttttaaagtctttatttcgaatagttctacttcatgcaaatacaaagaaactgattcaatatgtttaagtattcattgaatcataattaataacaactactaagtggatactaatgttctcttaacttggtaatgtatttggtttgaagtattttgtatatttaaagctgaaaaccaagtctcccacttgcttagtcatatagaaaaacccatatgtctcccactcattatgtaaagatgactcaattgatacttgttcacatgacttcctcatttgattcctagatgtcttcaaactgtaacctgaacgttgtgttttcacttgagcatactgcaatcttgagatctcgaagtaataacatattcttgttttgtcccttttagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgag

SEQ ID NO: 64560 - DNA, 1150 bp, Homo sapiens
cacataaaaacttgtacacaaatgttcacagcagcattattcataatagccaaaaagtagagacaatccgaatattcagttgatgaatataaaaataatgcatggtatatctatacaatggaatattattcagccacaaaaaggaaggaaatattgatacatgctacaacatgaactttgaaaacatgctaagtgaaagaagccagatacaaaaggccactgtatctgtcagtgttctccatggaaccagtaggatttattttagggaattgattatggaggcctgacaagtctgaaatttctcgggcaggccagcaggctggaaaatcaggcaggagttcatgctgtagtcttgagatagaactccttttcttagaagcctcgggttttgctcttatgccttcattggcatgattggatgagacccatccacattatggagggtagtattctttacctaaagtcaactgattgtagatattatatctacaaaataccttcacagtaatgcttaatgtttgattaaataactgggtattatagcctagtccaattgacatataaaattaaccatcatagctacatattatacgatttcatttgtatgaaatgtccagaattggtaaatgcatagagacagaatgtagattagcgtttgccaggggctgaggggagacaagaacatggagtcattgctaaagctaagagattttttgggagaatgattaaaattttctggaatcagatggtggtgttggttatactctgtggatgcagttgacccttcaacaacataggtttgaactgtgtggacccacttatacatggatttttttccaataagtttttttttaaatttgtgataacttaaaaaacctgcagatgaacatagcctagaaatattgaaaagaattaagaaaaaagtatatcaggattcataaaatgtatgttaattgactatgttatcagtaaggcttctggtcaactttgagttgttagtaaagtttttaggcagtcaaaagttatacatggaatgttgttgttgttgttgttgttgttgttgttgttgttgttttgagacagagttttgctcttgttgcccaggctggagtacagtggcgcgatctcagctcactgcaacctccacctc

SEQ ID NO: 64561 - DNA, 1220 bp, Homo sapiens
tataaagacacgtgcacacgtatgtttattgcagcacaattcacaatagcacagacttggaaccaacccaaatgtccatcaatgatagactggattaagaaaatgtggcacatatacaccatggaatactatgcagccataaaaaatgatgagttcatgtcctttgtagggatgtggatgaagctggaaaccatcattctgagcaaactatcgcaaggacagaaaaccaaacaccgcgtgttctcactcataggtgggaattgaacaataagaacacttggacacagggtggggaacatcacacaccagggcctgtcatggggtgggaggaggggagagggatagcagtaggagatatacctatgtaaatgatgagttaatgagtgcagcacaccaacatggcacatgtatacatatgtaacaaacctgcacattgtgcacatgtaccctagacttaaagtataataaaataaaatcaaataaaattcaggagccatttcatggaagccgggtgagtgagagcattggtgggtgttgggccggaggaaagcaggaaggcccatcggagcatgtggatttgagccaccacattttttaaccctagatctcgaaatgcatcgtgattcctgtccgttggactgaaaggtttatgtaggcaatcttggaaacaatggcaacaagaccgaattggaacgggcttttggctactatggaccactccaaagtgtgtgggttgctagaaacccatctggctttgcttttgttgaatttgaagatccccgagatgcggctgatgcagttccatccccgagagctaaatggaagaacactatgtggctgctgtgtaagagtggaactgtccaatggtgaaaaaagaagtagaaatcatggcccacctccctcctggggtcgtcgccctcaagatgattatcgtaggagtagtcctccacctcgtcgcagatctccaagaaggagaagcttctctcacagctggagcaggtccctttctagagatgggagaagagagaggtcgctgtctcgggagagaaatcacaagccgtcccgatccttctctaggtctcgtagccgatctaggtcaaatgaaaggaaatagaagacagtttgcaagagaagtggtgtacaggaaattacttcatctgacaggagtatgtacagaaaattcaagttttgtttgagacttcataagcttggtgcatttt

SEQ ID NO: 64562 - DNA, 1061 bp, Homo sapiens
cccgcctctctccctccctcctctagtagtccccagtttctattgttgccatctttatgtacctgggtacccaattagaacctgtttttatagggtagctcatagtgttccacagagcacactttgagaagtgtagacaccctcgtttcagagtctaggtgggtgagccagatcacaccaaatttgagttacccatgtgatgtcacagaaagaacactgggtgtggagtcaggaaacctagctttttatttcagctctgccacccccttactgggagagcctggacaactcttggcccttcatggggactcagtttctctttctatgtaatgaagccccatcctgtcctgtgtctgagactctgagtatagtagagtttgcccattgtagacatccttgcggccaccgtgctgctcctgggactccctccttcctgacagcgggggtcctggcctctcctggacaatatgtccttgactcaccagcagcctcatcccagggctgttgggcccgggactgcagtggggagggtctggagccatcctctcgggcccaagccccgcttctgtgcttcaggcaggtgtcccctctctgagcttcctggggaccacagggtagaacttcctccaacggtgatggaggagagtccagggtaaggccatgttggggtagctttggatggaacttttagaactggagccccaaatccccactaagttaacatctccactgcaggaggcaggagatagggagtcaggccaatgcctcagggctgagattcacgcttctttgtcagggggtcttgtcacactcccactcctcttcctcaaccccaccctgttcccagctgatctctccctccctcattttcccagccctggagaccccagctcatgcccgtccctctgcccctgaggctcacactccctttcctggtccttccaggaggggttccaatgtctccctgaccctggacatgtgcactccgggctgcaacgaggagggctttggctatctcatgtccccacgtgaggagtccgcccgcgagtacctgctcagcg

SEQ ID NO: 64563 - DNA, 5324 bp, Homo sapiens
agtcattctttttaccctcccaaattatgcagtcacttctgtattagttacccattactgtataacaaattaccacgcatttagtgggttaaaacaacacctacttattagcactatgctttaaccaactgagctagcacgccacccgtaacacctatttattatgtcatagtttctgtttgtcaggagtctaggcatggcttagctggatcctctgctaagggtctctcacagttgacatcaaggctgagcttggggtcctctttctagttcatttggttattagcagaattcagtttcttgctgttgtatgatcaaagtctcattttcttactggttgtcagcaaggactgttttcactcctgaagactgcccacagttccttgttatgtggctctctcacaggccctcgcatatcatggcagcttactttttcaaggccagcagaagaatctcttgcttcagttggctaagacagagtctgatataacatgaccatgggagtaattgtctcatcacctttgccatattccattgcctagaaacaagtcacaagttctgcctgtgctcaagaggaaggaattatatgagaacttgattaattggggggttcgaggatattcttagggtatgtccaccacaactccaaaaagtagaggcctggcaaacttcttaccaagtcagtagcaatggtcctctgcccactacaagtaacaaggtccatttgtgccttttcagatgacctttgttttatgaacaaaatatgtaatttggattttttgtaatagtaagcatcttttctactgaacagaattaagataaagaaaatcttccttaggatacactttttttttcttttttttttgagacagagtctcactctgtcacccaggctggaatgcaatggtgtgatctcagcttactacaacctccgcctcctgggttcaagtcattctcaggatacacttctaaaactccaaaaaatgtaatttattaatatagatattgttgatagtagcaaatgcttcattatgtaattgagtgtgacattaattctctcatgctttgtcaaatgactcttactcttcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcagtaagtcttccaaatgctttggtttatccttatgttctctagaattaatagtaatatatgtgtagttcatggagcttcatatgtttacctctcttaacttcataatagtagttaacaccagcaccagtatatttgtcataccaacaccacagtacttagtacagtgtacctgagctgtttatgtaccaggacgtcccattagattgtaggcaggttcttagcaaaagcatgtcttcatctttgtagctccagtgcttttgcacagttccttcttgtgtaaggtacccaataaatgttccttgaatgaatggatgattttaaatgacactaagccaaactctttatttgaaacacaaatctaagtcttttaaaatatactacaacctgaataggtagatggaatgaaaaatactgacttacacatttatagatatttttaaaaatcatttatttcttgagtactttccatgtgcttgttgtgctggactaactagaagaaatacggtaaggtaaggtggaaatatgttctctgaccacttgaaacacatagtgtgttgttttgcttgcactggatatggaagtacattttgaaagtttccccttaagatctccatatgtgggtatttgcattaagtcaattatttccaacattttcaccttcatggatcttgttgattattaacatctatcacacctcttgacattgagcaaattttgaagtattttgtacatcagactacatcaagtattaatccatttttgtagtaatcaaacataaatctgcccagcagattgcccatcaaataaaaatcatgccaatctaatcagcctgaggggaactaatgttaccatactaacttgatataatttctatcagaagcaaagatgtttggagattaattagcctgtttggccttgatatggactaatgtattgtctatgttaattaaaaaatatattgacaattatttgagtattctaattaccaatttatattaactctagaggccttgggaaccactcttttagttgaatattatttgatattgtttatattttatttgtacaaagatgagcatattcttaaggtaaatatttgctttaattaggatgcaaacatttaaatctttccctgttgcccataaaactcttaagataaatgtcagaaattaggctctttttagagggaatctcagtaaaaactcgcattttatgtctttcctaaaattttcttcaggtcctggaccttctcaagtggttgtcgggggacctgtaggtagtatctgggaagggcatagagagctatggagtgtgtgtgtgtgtgtgtgtgtgtgtgtgtgtgttttctaaaccagcaaaacctgaatgtatattcttattatgtttctaaaataaagggagtatttattttccagtaaaatgttaaagttgacatttaaaagatggagagtgtaaatgtatgtgtgtcattttcaaaaatttactcttttaaaaatgccaaaaagacacacacacgcacacacacacgcgtgtattttggtaaggcagaaattattctaatttacagtgtgagaaacagacaattctgccatttggtttgatttttgatccttgcgggcttattggaactttcaggtagttttaagtagaaataagttttaaagaaagtgctaaagggtcagttgggacttcatagaaatattgctaataggccgggtgtggtggctcacgcctgtaagcccagcactttggcaggccgaggtgggcagattacctgaggtcaggacttcgagaccagcctggctaacgtggtgaaacctattaaaaatacaaaaattagcctggtgtcgtggcacacgcctgtaatcccagctacctgggaggctgaggcaggagaatcgcttcaacctgggagacagaggttgaagtgagctgagattgcgccactgcactccagcctgggcgacaaagcaagactccatctcaaaaaaaaaaaaatattgctaataaatgatttgcctctttattctctatgaaatatgtctttttaatgctataatttctctatgaaatacctctttttaatgctatactatttaactgattaactagtagttaaatctctctcaagcccatcattccttttctgttcctattgcttcactcttactttaggctctcattgtctctcacctgtatttattgcaataatctctaaattcgtatttcactctctgtcctcaccctgctctaagcagcttccatactgcctccaatgcgatctttcttaaaactcaaagtctgagtgctttcctctttaaaaccctttattggtttcccattgaactgtacataaagctaaacttcatagcatagcacagaaggcccatgtgatctttgcctattgcgtctgacctcatgtctcaccattccctctcatgctttatgctttagcaatgttaaattgcttttatttctctgaacatccatgtagtttcacattgctgatttttgtacatgctgcttcctctgcctgaaatgccttttgtcaacctataaaatatagcttagtttcatctccttcaggaagggctaatcatttgttcctctgctatacctatattctttccatatttcgttgtggaatttatcccattctaagtttgcttttagtctttatcccttattgtgagattattgcatgggcttggtttgattcaggggtaagattattgtcaggaattggcaccaggtgtttctggcacatagtggagatcagatgaaacttattgaaggaaggcaatgtaagtttaaagtttacttaagaaagtcaagttcaactccaaagagattaatctgatcagtacataaaccaggtttccttttgctgtttggctttatactgtgtcctctctatgcatgtctttgttaattattatatttctgtattgactgaaaggcagtttggatagtgaaaagatatagtaaagtgaagaaattttgatatttgaaatgattttaattgtatcaattatgcttttttttttcttctttgagatacggaatttttgaacgatgtaaagagttggtagaagcaggatatgatgtcaggcaaccagataaagaaaatgtgtcgcttcttcattgggctgctattaacaacagactggatcttgtaaagtaagatgggatatgtgtgttaattgtgtatttataattttagacctctccttcatttatctttttctttaagtatgggtattgaaccatgtgtaatcctcgtgtaaaagaacacccgaaactttttctgccacacacgttggttattataaagttgaaagggaccttagagaccatgcctggttgatccaaaagggaaaattagagataaagccaagggggccaatcataaagtttagaaagtaaaagtgaacattttttaaaaaaggaaaagtataataaactttttcagaagagaatgggaagtctcatctagtttagaagaagcattgaaatattttacattttaataccacgaagaatagataggtaggagatttaaccttttaaaaaaactaaatatggaatatacttttaagtgggcatgtattggattgtataaaatatttccccttcataaagcactactgcctacccattgtttcttttaaacagcttaacatgtaaaatgtacatgtgtatgtgaatgtgtatatattttgtgttataggattagatatttaaaatcctcaaagtttaagaaatttattaaggtttaaaatgttctaacacacatgaatactcacaggcaaactcctcttctgtggaaataaactggcatggtatttagataatatgatgtatgaagctcaactttgaagtaatgagactaattcctataaaccatagaagaaaatcagtcttattaccttatatgtccaccttatacagtgcctctcatctccgtaccctaaatacagggcaaaacactcaaaatgtctaacttttccaaaaggattttaaattaattctttactacttacttttaaaattcattcccacatagtaattctacttttaaactgttg

SEQ ID NO: 64564 - DNA, 1037 bp, Homo sapiens
tactccttaagtcatcatctctgttaatgcctcttggtattttattattttgagacaggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaaggtatggccagatatttatctcccttagtttattatatcttgagttagaagattgataaattaacgtaaagataagctatataattgttttcagttaccccaagatagatataaatgataatagctggctatccttggaataatgtgttgagtctatgattctggtgtttttaaaaaaagtttagcactcataatatattaaaaatacttttaaactttttaccctactcttttttaagggagaaacacctcttgatatggctctacaaaacaaaaatcagctcattattcatatgctaaaaacagaagccaaaatgagagccaaccaaaagttcagactttggaggtggctgcagaaatgcgaggtattttcatatggggtcttttctatgggatagatgactttttttgttcatttggttttgtttattaaggcatcagaggaaaccagagagttggctttttgctgcattatatctgctgactatatctttcccccgcatcctattacccaaagttggaaatttggcactttcattggctatttattgttggtcctcaactagatgctctaaaagtgcttgttaccttatgaatatcattgtgtacttccacatttatttaatgaatgtattgaaatgcaaaaggttttgatttttagagacacaatgggaaaaacaccttgttgcaaggagttttatagaagcttgtaggaatagtttattccttactaaaattttatttcttgaaaagaaaataataacatttacaatgtttccttagaatcataaggactttaaaaatgatagtgttgaaa

SEQ ID NO: 64565 - DNA, 1070 bp, Homo sapiens
aatgtagggtttttaaaaggttgtttcccactttgggaggccgaggcaggtggatcgcctgaggtcagaagttcaagaccagcctcgtcaacacagtgaaaccccgtctctactaaatatacaaaaattagccaggcatggtggtgggtgcctgtaatcccagctacttgggaggctgagccaagagaatcgcttgaacccaggagacagaggttgcagtgagccgagatcgcaccattgtgctccagcctgggcaacaagaatgaaacttcatctcaaaaaaaaaaaaaaaaaaaaagattgtttccaagatgtacaatctctcaaacctcaaatttatcaatcagcaattttagaggaaaactttgtgttagctttgttgttgtattaattgttattatatactttggaagtagttcttatattgcactattattagatacttaagaggtaaaatccataaagttctaaaattctgaatctcttaatagctcttcctgctgctgatgctttctgtgattaccatgtgggctattggatacatattggacttcaattcagattcttggcttttaaaaggatgtcttctagtaacactgttttttctgacatctttgtttccaaggtgtgtatgttaatttttgcaaggctggttattgtgtttctgattttatttcttatttctgttgttggttagctggagtcacagatttttatcatgctgtaaatattacttaccatataacagcatcctgcgggtggatgggaggaaagggctctggtagcatattatttggctgaaagcaagttgctcaacccagtaacttggttgacttgacaactggtggaaaataaatatcctgggtcacgttttaattgttatttttggtgaatgatggggagatttttgtaatcatttcataattattcaagattttgtaatcatcttgaagcatttttgctcatttttcagaaattttttcctttttctaaatttattttaagctagttatttttgctgtcagtcatttttagttgagttaaattgtgagagattataaaatagtaaa

SEQ ID NO: 64566 - DNA, 1018 bp, Homo sapiens
tcaagctgattataggatgaatgtgcttaaggttgtgtgcatcagtatgcttaacaaatatcattttagtctctggaagaaagcttgctaaatgtaaaggtgaatctcaagtatataaatttttgcattatagtgtatttaaaaatatatgccaaaaaagaaataaaaatatatatctcattagaaatacaaaagatccattgaaaacatatattaaatcgttgtgaattaaatattgtatgagttggttagaagaactagaacatacacttcttgagagtcgttgtgctttagttttctcctgtgtaaaatggggggatgatgttgcataactctattaccacatggaaagtgacacatagtaagcactcagtatgtgaaagctattactgttgctgctggtattattattactaccattattatttagggaaatttagaactaaaattaatacaagtcatactaataacttatatttatcttttttcttttaggttcttggttgggtataagaaccttgtatacttaccaacagcctttctgctaagttctgttttttggatatttatgacttggttcatcttattttttcctgatatcctttaagcatcaattttgatgtgtatctcattttgcctttaaaagagtaatgttattgttaggaatttaggtattggaaaaggcccagggaatgcaacttatatttgcattcatttaatggttctggatgaagacgtttaatgttgaaaatctacttgattctaaaagtagtctcagagtacattatggaaacagtaagtatctagtatttattactcataggaggggaacagtagaatgtattattgttttacttgtaccataatttgttggattgtcttgagattccttcaaggtcagatggttctcataatttggtcagcagttacagttaattaatacattttctgagtactaagacggactgcatgaaagggatattggggaaaatatggcttcctcagtaacggtaagtgt

SEQ ID NO: 64567 - DNA, 1051 bp, Homo sapiens
tgttttaatctcagactgctattcgttagtgggtcgtggaagaattaaatgggccgtgattaaaattaacaaaagagaactgatttccatagctagacagaatcttaagatgttggaatcaacaagatggatgattttatttgcttgtacaacctaaagccctttgttctaggcaaccatatgaacctgctacttgtgagggcatataagtcagtaggtggcatacttcaccatcagaataatgttcttcaaactaaattttaaatcttggaactgccttgtggatgaactgagatgccgccctgggttttaggctagctttgtctcaggctgccgtctggattgaataagggcatctgcttccgcagatactggcctattaggggaagacattctggggcactatggaagaagacaaaacgattttgagttttagctcttttcagactagttatgcaccattggggcaaggtacataatttcaccaagccttagtttttctgtaaattggagataacagaaacaagctcatggtgtggctgcaaggattactataaagtgctcaccacagtccccatggcaaaattggcattctataaatatacctaatattttattattaattattcttatgaataaaattgatgtggaaggctgcatgtttaaactaatttcaagggcaattctaggttggcttctcagatgatcagtttcttttggtaccttttataagttcagcaagtaatgtctggcttgtgcgaggggggattgaatacaataaaatggaaccttattgatgagtttgaaggtaaaattcaaactcaggagagaaatggtgaatcactgaatattacatttgtgatattggctgtaactaactgagttaagtttaagagggataaatacatgtaaagtcccatactgagtttcagaaaatcagttatacaagtgcatgttatggtgagctatgacatagcttctggtcaagtgcaaaggaacgaggcgctgtgactaaatgctcagtgtggctagtgatgcagctgtcaagaaa

SEQ ID NO: 64568 - DNA, 1111 bp, Homo sapiens
taggtcagtgaaccacacaggcaagagcaccaaagcaaggagtgtcttcagcttctatgtgaggtgatagggtgtaattcactttacttggagagtggtgatccaatgattcccctgccatttgttttgtaagttaatcaaaataggagccgaaaattcagtcagctcagcgtgcaggatcattgcattatgaaactgaacgtatttttgagaactgaacgtatatattttgagtcgtgtgtcgatcaggatttcataaagaaattatgatgtgattctttcacaaaggatcttgccctatgtacctttaatagtgtctttctgcaaacatgtatctaatatatagggaaatacttttatttggaatctctgaatcaagagggttgtttctttgaatgattttgttaaaatgatcaaagaatatttttctagatgctcacaggagagccacaattacaccattagagataaatttatttggtcttgagtgtcacttttcaggatgttcctcataagttgcaactattcctatcaagtatttaatatgagcttcaactaataaggaaacattaattattagccaagtgggaacaaattccagtaggattagaacataggatgggaagagatttaggggcagggacatgtgtgcataaggaaggtgagattcttaggtgccaatgatgaaatttgcttacatcataattacattatttttaaaggaagtttggtgtattccttaacttggctttaacatttagcaggagcccctttctatttcagtttcattttcagcatagtagcctttctatactttttctataagacttgggcaactgatccaggcttcactaaggcttctgaagaagaaaagaaagtggtgagatttcttcgttactgatatttttaataggagggtttgtaaactttagaaagtttatatgcacatatgcagatgtgttgctttttgttacggctgcatgacatgtggggtgatatagcaaaaattagatttccactcttacagttttttcatttatgtatatgaaagttttaacacatatttttattttctgttgaaataataccccaccaagactttttcagatgt

SEQ ID NO: 64569 - DNA, 1862 bp, Homo sapiens
ttgtaataacattttcataatggtcatttagcttacatttccccactaaataaatggagagtaactagtcagtgaccagggagagtccttctgcttattggctgaggagatgcccctcctcctcctcaaatgtgaagttgtcagatgacatggcatgttttccgttgctcatgaatgtttagaagttggagaatgttgtctttgttacctaaagccagtgttcctgaaagacccagcccttggtgcttgtaactttcagttttgatgtatactggtgggtttttcttttttaatgtgtgtgtatatttgcatatttatttttctctagcagatcataactgggagatgattgccattcacagagatgaggtgataggtgggagtggtggggtggtataatttttatgcatcctaatttattagctgttggttgaaaatgcaaccttgaagagtcacatcatttcaagcacagaatgatttggtggcaagtattccaaattgcttttctaactacttcagtttggagcgagaactgtgagaatggtgtataaccatgcataatacattttccaataaaatgtggtaataggtcaaacttcatgtctttcagaatatcatcacccttgcagaaactggctctctggacttcagaacattttgtacatcatgtcttgtgagttttttcatataatttttttccgtagtgaaagcaaagtcttggtaacgttgctgatgtaagcatttgtcagatcttcatggtatatttatacacctttgtttttacccatttctaattttacattcctgtctgaacagctttctgtcttgaacatatggcagaatgatgtttataatctcttgaagttgtctctggttacatctctccgtgaattatccattgtgtgttttatttgcttttctctgtcatgaagcatatattagaactaacgtcaaatcagaggctcataatgaccttagaaaccacttagtgaaacctctcattttgcaattgaggaatcaagggaggaagtaaattctcccaaattattggtggtgctaaaaatggaacttgggtttccttcccttggttgagtgcttattttgctctgtggtactgcctcatttctgcttagccagtgtgaacaggctctggaattcagatcccacttagtgatgtcctaatcaaagtagacatatggaagtaaatactaataaggcattccacagcctctgtgtgaattgatggtctgtttaggatttgtgccaatgcctctgtgacctaaagttaaaattttgcttgtgatttgttaccactttgagacactggtttttgcttaggcctctcttaattgcccacttagataaggaagccattaaggtcactccactgccatgtatgcaactgctgtgtggctcgatatgatcaacactgcctgtggactggacggtgcataggtgagagatttaatttttcaattactactgtgaagttaagcatatgtttagttatgactcacagaaaaagtggaagggcatcctagggctccattttcaatattctagtattccaatagcaatgggcccatgcatcgttattatgctacaggtaacataatatttgcacatgcatcattctgtttggtagccacaggcctgtgaagtagacagaaaaaatattatctccatattacttgtaaaaacgctagatcagagaagttaaaacacttaacttacagtgacacaactagtaatacataagcctaggtctcctgattccaatgggtgttgttccttctgccgggttttgctgctccaggagaaggtcggaccatgatgtagtagctgaggagtatttgtgtcat

SEQ ID NO: 64570 - DNA, 1009 bp, Homo sapiens
ggataggacagcctagctagaaaagtgtttgcttagttaactttattctattccagaagttgcacttttacaaacatgttgcatggaaggaagaaagagacagggtatgatttgtccaaattcctgcctgcttctcttccttccatcacagaataggccagcctagagcagtgtttgcttagttaactttattctagtccaaaaaagtatcttcttttaagtaagcaatgaataaatattagttcagttaacatggacaattgactgtgacatatcagaaatgtgtggtttgatttaatggtacttaaaagcaaagcaacagctttatttctgttttactttggtgaagacttttgacaggaaagtggttaaggaggtcttatgttgaaaatcagaagaaacgaaaatattaagtatgttttttttcttttttcttgaggttttggcaaccatcactattacatattcttcttgtttttcctttccatggtatgtggctggattatatatggatctttcatctgtaagtgtaaatttttcttacaacaagcacatacatctacacccatttctacttttccttgtaaacccttgtatatcacattctggctgggtgactataaaccatactcctaataaaaacaaagcaaatgcctctaagactccctcagcattgggaagctgcaagaaatacaagatgaggttagttctcagtactttaggaaaaaaatgtgataaatttgaaaagtagtcaaaaatagaaattcatttaaggcaagtgcagatttgctccccagtgaagaaggaaagtcagctgctgaagtacaaagctggaggtggtaactgaataaaacaggaaaaaaaaaaaaaaaaggtcagtggtagagaggttgggggatagttgtccagtcattaaggaacaaacctctgaaagcccatgccatttggtaagtatcaagttgaaactgagaactgatgggaatactaacagttaaaaggttggaaatag

SEQ ID NO: 64571 - DNA, 1455 bp, Homo sapiens
tcacattcagtctttccaagttagtttttttattacacatgttgattcttcccttctctttgtcttttttctctggctctgaaccaattttcatattacattttgtttcataagaacagtcccaccttatattcacttacaactgtataaactagctgagtgtattttgttacctttattccatttatattccagcaatatttctttacactgaatgagggccttgtgtcatttattattatttcacagacaaaacatgaacttgtgctccatttctctaatgaggcctcactgtcatcccacctcccttgtttaccattaatgctgtattactagagccctgctctatactctccttctcatgtgatccaatagctgctacttctgtacagcctccatccatttcatcttttgtaaggtctgtttacaaggtggatagtaagtgactccaaaagtgtcagcatcctacaagttacagaaagaaagattgtagattaccatcaggaagaactctgtaactgtcagagccatctaaagatgaaaacgtttgacctggaatgatgtgagttccctaccattagccactggccagctgataagaatgtattagcacaaattaaagtgttacattgcataagataatgtacgtgacaacttgctgttgtatctttgatattaaatctgaaaaccagtattctgaaaacttcagtgtgagatcatgctgtattatcaaaagaattcccagaagggagcagtagaaatccataaactgaaagaaaatagatattctttcccaatcaacagctgttttctccacctactgttggaaattatattcttttttgtgatatcaggtgcatgggatgcatctttctttgccatcctaatgagatgctctagagagagtgtaatttgccttaacttgaaccttgattgctactctgtgatgattgctcttagaatgcttctggcatatattcatgaaagatggttgggaatcagagacttaaagagaaaagaaaagtagatttttaggatttaaatggacagttgacaggaaagtcatagactcattttcttcctgtccctggagttcttcagagcagcattgggaaaatgtccaaaactgtttatcaaattgtcagaggcatttatgaaacctcaaggtgcaaatcgacagaattatcttttaaaaataattcaccctttatgcatgggcagggtgcctgtaaaagtcattggatttacataaccttgaagatccgttcccttgtttctgctgcttcctgtgtgtatttctccttactgctgctcctagctacatgggttaggaggttgatatgaaaggccatagtaaagttctttaattggcacacctggggagaaactgagctgtgaccatctgaatcttgctctatattcttttcccaggtgtatctgtcttgtgagtccctt

SEQ ID NO: 64572 - DNA, 1142 bp, Homo sapiens
acccatgcccagctccctgcatgctattagattgtattctgatgatatctaggtgcttgtgggatatcttgtgcccacagcaatggcctgttcatctgaatgcttaataagagtttatattcagtcctgtaatagacccatagttgctataaacatgaataaggtagggagtgttctaaacaaataattaacttcaggctagtatatcttatgctgaatgctgattttagtaaagattttacggaccctttttctttattccttcactgttaactacttatacagtgttatcatagcctcaattaacattgagccaccattttgtcatctttagtttttgaactgtcatgtggaaaatgaaatcctaaaattgaatcatgatctgtgccatactttctcttctccctatatagaactgcagtgattttatcttcttggagactgataagtagtttattgccttttttttttttttttttttttggtgaattcacagatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcaggtatttatttctcttcttataatggctttgagtaaaatttctaaaacttgtagtgagacagccttgaatttaaaatcagaagatgcacattctgtttttacctctgtcactgactctgtgggtctagccatgtcatttaaccacacttgaatttcaggtattttgtctgtaaaatgaggataataacgcctgtctactacattaaaccacaagatggtttaaaggttagcataataaattattagagtatgacctaggagttacctaatctgacctctttattttacagatagaagtacagaaaggtaaattgaattgctcaaggtcacccagtgtgtggcaaaatcagaactggaaacttaggtcttctgccagtcccattcaagggctttttccattgtacagttaaattatatgttgtgtgtaagcatagtataaactgtaaaccatcatgcaaatgtcagatgattgttttccctcagtttttc

SEQ ID NO: 64573 - DNA, 1300 bp, Homo sapiens
ggctgagcgagcagaagccaggaaatctccaaatatagattcaggtccagaaataggcttcagttttaaggtaccagaagcccaggaactatctgatctaccccatctacccctggatttctgcaagatgttcaaaggacattgcatattatagattctccataaatgtttgtcaagctacacaggaaatatagtaagacatgttctctttttttttttcttggcagtcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtagttgagacttggtttctgacacttaacacttctagagtcttaaattaagatgtacataggacacaaattagttcacaattccaggaatgagttgagattatgattaataccagtaagcaagatttaatttggtttttcatcttacttagaaaatagaacatagaaagtcttaaatattaattacaactttacttagtaccctcaaaatattagactgatatgactgtaattactaatttcccttgttctacaggaaatgctaattcaactttagtatagtatttatacacccctgggcatggcaccttcctgctgaataacctcccttgggttcctgttgctcttggggtaaaagcaaaaattctcattgtgacctacaaagccttgaagcatataatcctgttttgtttagcagtgtcagtggagcatgttgtactctaatcatgtggcctttcattgcaaggatccgttctctcttc

SEQ ID NO: 64574 - DNA, 1509 bp, Homo sapiens
tcctgttgcttacatagttattcaggattaggattttcagtggatagattttccatatactcctgcttcttttttatatctctgcaactctaaccatttcttttttcttttgagacagggtcttactctgtcacccagaatggagtgcagtggcatgattttagctcactgcagcctcgacctccaaggcttaagtgatcctcccacctcagtctcccaagtaacttagactacaggtgtgctgccatgcccggctaattttttattttttgtggagacggggtttcaccatgttgctcagcctggtctcgaactcctgagctcaagcagtctgcctgccttggcttcccaaagtgctgagatcacaggcatttgccgtcatgcccagcccactttaaccatttcgttttagtatggcctgagcaaaacaaagacaatgagagagtcatgtgttaattcattcaacaaatttttactgagaatttatacttctaggggtggaaagaagataagtatgcaagtaaacacaaacatatcaggtagtgaatgataggaatgaagatgacatgataggaggaaggggtggaagggctactgtaggctagaagagttcaagttcaaatatgtcagattcattcggcaatttaatagttctaattattttataaaaaagggaattggcataggttaaaagattctataatgaatatagtttgttggaaatttaaaaattattattctattattgtgggttttactgaagacttgaaagagttaaaccagcagtcagaataatttgtaccatgagagaatataactaaagctaatagagcgcaggtcttcataaagcacctaaatttgccccttaaaaattctctcttcctgcagttttcaaggcacctactagtagagattttgagtgggaccaagtacttaagaaacaaaattaaaagcttgtagtatacttttagctttgtggattctgaatttcctggttcccaaggaaaagacctattaacaactagattaaacttgttttgacaatggagagaagaaaggtctgaaggaagaaaaaaggaggtccctagtttataagagcggtttttagcttttgccagtcccgctcatggtaaggctaaagcagacttttcatgcagttcaggcacccgtgtaaactttttctgtttgggaaagtacagtgatctaataggcatgttgggaggtacatgcaaccctacccttgggccttttctagttgcaatataactttattgcctaaagcttttgctcaatggcatgtgcgtctctaatatgaattaatcagttctcttatttgtaatttttttaactctggtgtactttgcgtattttaagactgcttgttatcattagagcaagcagtactagaaagaaatctttacttatataatttctgttttaaatcaggggccagcaaacgttctttaaagggccagatagtagacattttttgggttttaaggccatatg

SEQ ID NO: 64575 - DNA, 1038 bp, Homo sapiens
cagaagacaaggaactgttccttagcatcccataatccaagtgaggccctcaacagctaatcccctggctgggatgaaggcagggacatttttaacctttggaggaagggattatttgctgtctttttaaagtaccatgggtggttgtccttaagtccatttctccatcacacactggaatgcaaacagctgtcatgaaagtcttaaataatttacaagcagacgtaaccccaaatgaacgtgtggatgcatagggttcctgtaactcctgctttctgagtcattacctaatgtttgtttgttgtcatgtaactggcatctgttgcctagaagataaattgctccccgtttttactttctacctaaaatttaaatcaaaatttctatttcatgtaaatagaaaaatcaaactgatcttggcaaattgtagatatagttcatgtattggtttctagagattttgacatgctagacaaatttttttcctaagtggagattagttccggagggaattaatatttattggatgcctacccacatatagcagacataatagatattagtcacttttacatacagtatctcattttcctcccttaggacaattatatatgagagacattactgtatcatccgataaataccactaaatgtgcaagtaaaagttaatctctcattttgcccctgctcttaatacaagctattttacttctctctgtcttatttttccgcatcggtaaagaatttattccaccagtttttcctcatcacctactggatataaagcactgtgctctggatcaaatctaacccagcacctgcctttggtggcaattgcttttgggtacttgcctgtgggcatatgatagtttttgtggggttaagtgaatttattccatgatgatacacataaaagggtttgatccttttaagacgtgttataagctgaaaggtattatctgttacgttgttattaaagaggaagcttagagtttgtcaaatcttccctgaggatggcctcatggtaaccattcaaaa

SEQ ID NO: 64576 - DNA, 1489 bp, Homo sapiens
ttcctaaagctgtgtagcacaacttaggccctcattaaatgttgcctttctaattcatatgatttgtgcccttggaaagcaagcacatgtctttctcaccttcacagtatttgttgagtatgttcacttacagttaggaaagtgatattatccaagacctactgactaataaaccaatggaagaaaaagctattcaattctaaacacgttacaaaaatctgtaacacacaattgcacattctttgtagatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcaggtgagagatggtagtgaaaactccaggcggcatggcatttgtcctctgtctaaggaaaaggttctgtggagaacacagctctaaagctactgctgcctttaatgttcagatgccacagttgtcagctgtatgatcaggtggtagtatttttagccttgttactttagaagtcacttgtccctttatgaattttaattctctaatcctcatccttctctaaagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaagtaagtgtcatgactgccatggatttttgaacctattcttaaacaataaaatctcagtcgtaaactcatttccaaattaggaaacataggtgcataaacagatcttctctaattatgtttttatatcttctccccagaagccatgataatattgatttagctaacttgttatgatacataagtatcactactctttttttttttttttttttttagacggagtctagctcttttgctaggctggagtgcagtggcgagatctaggctcactgcaacatctgcctcccgggttccagcaattctcctgcctcagtctccggagtagctgggattacagttgcgcgccaccacacccggctaatttttatatttttagtggagacggggtttcaccatgttggccaggaggatctcgatctcttgacctcgtgatccacccacctcggcctcccaaattttgggaggcctcccaaaattacaggcctgagccactgcgcctggccaagtatcactactcttatttgacacattgcttcatttga

SEQ ID NO: 64577 - DNA, 2312 bp, Homo sapiens
tctcattagacattttttccttggcatgattctattcgttatgcaatttctagaatccaagctgtctgataaatcctgttttaccatggatttaattatttacattttttaaaccaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgtaggttttcagaggactggttggaggctggggaatttgttggggggaggggggaggttgtagctattagagaagtgccagcaatttaaagcatcaccacccgaaggctgttattaacttccttcggagcaccagaaaggtttggaccccaagaaatatagctctgggaattctgaacctttgcgttattttcgtttcaggctttcctttcaggtttgccaagcattttgtactggcccccctaaccttttctcccatccagactttgcagctgttgaagctaagcgtgtgtaagttggtgtcagtcatcgagcacagatgcccctaataaatctgtcagactttattttagaataagacattgtttaccttttcctttgtaggaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttagtaagtatgcaaagaactcactgaaagaattaataattaaagtggctttatggacttaactccttcagacccccgctcatctagccagtgtttgtaaatgacacaaataagccggcatggaaattttctatctctaaagccctcttctaatataagaatgaaggtaagtagttgcaaatttcagcaaatcttggaggcagaaaagtcacaatggaggttgcttctgactacagttgtctctgaagctttaaagaaaggcaatattgtctcatgacttgtttcacaaagttacaactgtgaacttttgcttcattgctctcccttgctgttcttgaagaatcaggctgataaatggttatcttcctagttgacgctgaggatcagcttctgtgagtgggaacaggacctgtgcactcctggaccttcagcactattctgaggactagttttctgaatgttttgtgttgggcacaagttattcctcctgcccctttttactctgttcaaagacctgaatctatttggagctaaaaaggggcccgtggtgaatttggggtacctttggagtcatgtgggtatcttaatttaaacctgtgaagtgatgtgctgtgcaagataatacattttaatacaaagcaatcaccccgtgaagaaaagttgcccttctaatacatgtttgtaaatatcaactttatttcacattttaagaatataccgtttagattcatctacttttcatatatgcttaatggtagctgggtaggatattcagcaaatatctattaatcttctactactatgtgtcaggcaatgttgtaggagcctgggatacatccgtaaacaaaaagggcaaaatctcttctctcttagaacctatattctagtggggcaatagatactgagtaaaggatataggaagtaagtaaggataatacatgctagaaggtaacatgcatagtggaaaaaataaattgtagatcaggatcaagggatcaggagtgctggggaggtgctttgccataagtggtcagatcaggcttcgttgagaaggtgacatctgggcaaggacttgaaagaagcaaggtagggagctgtaaggacatcagggagaagggttccaggcagaaggaacagccggtacaaagcaagtgcatatctggcaggttccagggacagcaagaggtcggtaggatgcacccttattaaaatagtgttttattgatcacttttccagaaaggctgatctcatcaaatatttaaattgaaattaagtttcttgaacgaagagaattctaacattacagaatattgaaaacccaatttaaatagatagagtcacagaattactaatatcatattgttaatgatagctagaa

SEQ ID NO: 64578 - DNA, 1019 bp, Homo sapiens
aagtgaacttacatgcatatttcctaatagttttagatgttagtcaaataagagaattactattgcttctgataatctgaggcaaagaaaaagcctattgtcagatcagtacatctcagatgcacacactggcaaggagctcctgttgggtccaccatactgacttccatgtaagaagagcaccatacttggagtgaaaatatctgtgttccactcctacgtgacctctctcagcctgcatcttctcttctgcgagctaagaatgcaggattccatgaacatacaaacggaaatgcacttgataaacccaagatgtcacaacatgtcccatttgtccatgttcttaaagttatttggtctgcctattattttacttattgctgttccaagcattttctttaaaatagataaagatgggagtagtgtgtgaagtccctggtgtccaaaactggaaggaacatagtctccattagccttatttatgaactgctgttaatttacccttttgtctcagtggctatcctgcttctgccaggatctagctttgtggtcttaggtagctgttaggttgatgcaaacataattgctgtttttgccattactttcagtagcaaaagccacaattacttttgcaccaacctaatcattttacttctctgggccccattttctctatctgtaaaatgagggagtggatgttcaaagagcagacttttctggtcagaaatcctgctgttggacactctagatttccctgataaatctgaccatatgctatccctcactcttgtctccttgtctctctgactcttcagtggtattttatttagcacccactgcatgcagccattatgctaggtggataagaatttctgccctgtaggcctttacttattacagtgccatgagtaaacaaaagtcatttctagaagtttgatcatttaacattgtcagtccaattaggggaagctgagtgaagggcatttgggaactctatactgtctttgcttctcttctct

SEQ ID NO: 64579 - DNA, 1011 bp, Homo sapiens
actgctgagcctgtgcacgtgtgtgtaaggggagaaatccaggcatctagatgcagacttgtacccagttacttggggtcgcgtgcgctcagctgggacctgggctcgtgcgcttagtccggagccctgatctgcgaacaggtgggtgcttcctaaagtattcgctggggtccggagaatggctcgccttttctacagatgggagagggctgtcactagaaattccgtgggttgcttgaagtcttaggaccgccgatccgtttgctgaaggaatttactggcatttgttggcgttctccgctcagtggggcgatctctggtcgagaataaaatgtaaatctagtttgtcatttttcgttaggctttgtttccgtagcctcttgtccgtgaaggaattttcaacagatcttttggttcttgtttttctctaactttttctatttccttttttctttaaggatattaaaacttttagtacaattgattggactacttgaaccatcgggatttggggaggaactccagatttttcatttttaaactctaaatgtatgaggaatttacagaatggagaacgaaaaggtactttataacttcagtattcatcattgcaattttaaattcagtatcatcctgatttaactccataatttttccctatccaatgtgttttcttaatgccacaaccttggttagcctctgtaaagacctggaaaaaatgaaccttatcttatagtttcaaaaatatatagtttaaaatatatactaatttaattaatatagtttaaaaaatgaaaattatcttaaaaagaaattcagtctccaatcatgtcaaatgccctttctgaattccagttgttcaagaatcctcagaaatgttgtaatgaaactaacaaattttattattcttaaaaataccttttctctctttatgtctgagacagctaccaaatcattaaaaactagaaagagtgtaaaggggcaaacctacccctcttcaaaaattcgtta

SEQ ID NO: 64580 - DNA, 1049 bp, Homo sapiens
ttatacaaaaatacaggttacatttcttgcaaccatttctacttaactttcctttctctgctgggttctgggagggaaacttcagtcagacttgtcacatgcccaggctttacccaggaagtgagcctcagtctcatctgctctcaaatgcctaacttatcctgccccggggcctggctggaccaggggttgggggagtgaacagtgtgcaggcctcctcctcaggggcctccctgcattggagatcattgatttgcttgttcctcctcctctcgcaacagcacctgcagttcttatttcgtggggagtggtaaggagtggttcagactggtcacggtttcttccaggtctgttgtttacagcatcaacttcatccccaggctgcttgcaggactcaggcaactgaagctcaaaagcccaggtcttgtagctcaagagtctggaaaggtttgcaaccttaaattccaagggtttggctgtacagctctcctctgttctgctgtaatcacccaatcaggaggcaacaggtgcttcatggtccagtttagcagctttaagagatactggaggaaaatacatcacttaatatcatccaagtacgcacctatttgccattcctaggtgactcagcctgggcaatattcccgcctaccagcaatcttttcagctccctcagtaaaataccaacacaccctgtggctcagtgatgcattgaagtcccaatttagtgataccttatttacagattttctaaataaaattgctaatacagtcaacccttcatattcacaggttctgcaccctcggattcaaccaaccaaggattgaaactatttgaaggaaaagaacaataataatacaaataaaagccaataacaatataacaactatttatgtagcatttacattgtattagatattataaataatctagagatgatttaacgcacatgagagcatatgcataggttatatgcaaatagtatgtcattttatataagggagttgagcatccacagatttgggtttctgcagggagccctggaatc

SEQ ID NO: 64581 - DNA, 1011 bp, Homo sapiens
gcctgacagttgtaaagcaggcctgcggggaaggtgaaggtgaatttgaggctaaacctctctgtcatgatcatggattttggtgtcagacacacttgggatcaaaatccagttctgccactcactgctgagagacctggggcaggaacttcatcttctgtagactcagtttaatctgtaaaatggtggtaatagctgtcccatggtattgtggagagaattaagagatgctgaatataaataatatctcaggcccatagccagtccctagtaaatggaagccattctaacgccaagccttcagatcataggtgcttctcaaatgtccacatggccgggcccccaatctgctcaggacacccaagggtgaagcatgttattggcttcccagggtttcctagtactatatcatggaggcatctggggattgtggtgtgatgcttagccaagaggctgccctctgcacccccacttcagggaggcgaggaaggggagcagtgtgtgtgtgtggcagagatggcattgattgagaactggcagacctggcttccctgccagcgctgccatgttccagtgtctaacctatagatgttggctgaatgagaggaaattacatactctgtgagcctcagttctctgatctacacgatgggggaatagtaccttttggggttggtgtggacactatatgaaggagctggaatactgcagctatttggagccatattctagaaccaaactgcctgggttcacatcctagctctgccacttactggctctgcagttttgaacaattacatcaccttttagtttgacttactcttataaaaagtaaggacaatgttaacgtctatctgacagtgctgtcaaatatgttttcatatatgaaatacttaaaacattgtttggcagtaggtaagtacttgataaatattatcttctcttttatgatgatgagagtgcctgttacagtgcctggcatgtcttagggtgcccagtaatgaatttcct

SEQ ID NO: 64582 - DNA, 1046 bp, Homo sapiens
ggacacataatcacaaactgactgtctacaactttatcactcacatggctcccgtgtcattcagaataggcaattagattttcccaaaggccagatttggggatcagaagggcaggctgatggagcatcaacaagtactctgatgttagctttaaaatatgcagtagaatcctgaaataatctgaaataatttgaaataatatgtctctcccactctttctgcttcatattcatgcaccctcaatgtccagtagcaggttcagagccacaactgctattttttcctctcccgaggcaaggaacagccagccagccagaccaagaggtcctacaggatttgaagtccttagaatagtggctacattaagtttgcttttgggtagaaacaaacaagcaagtttcctgctggcctccctgttcatctctaggtgaagtgaggaaaactgatggaatgttaaaggggccaagcttcttcccatctactgcagcaggactgtataagaagaaactggacctgaggtgtgtgtggccttggaagagccatttcactactgtgagcctcagttttctcatctgtatgatgaggctagtaatcccagccctttatcccttataatgttgttatgaggattagatgaggtcatatttgtgaaaataaaaagaacactaacagctaatgttcactgggtacttattatatatcaggaactgttacggtttatattttataactaaaggacctgaagctaagggaagttaaaagtcaaagtcacacagcaaataagtgatagagcatgtatttgttgtctgacttcaaagcctaagtaagcttttaatcatatttttcagataaatttttcagattttagctgtgcaactttggacaagctacctctttctcaggtcttcagtggtgccatctgaaaaggagacatggctcagattaacgttcaagtccatttagctccaaattcctggttatattttaacaaagtatacagacacacaccataactctttctttctccaagtttggtcttctttga

SEQ ID NO: 64583 - DNA, 1016 bp, Homo sapiens
ttaaaattatataaatttgggagtatccaaaacaatctggtgtatggatattttacccaaggatctctgattagagtttcccttagagggcatctaggcccatagctgcaaaaatgacccagcttgtgagccaacccacttgacagtggcttcctgaagatgaattctgacggcaagcatgctgtgattgattagtaatgtctgccataggcagagaaaaggaagatgataaacaaagtcctgtgtaacctgctagaccctatcaagtctaagatcctcatatttatagggctgaggttcaaacagaagaagtggtacacaactaccattggagacataggttggagggcctagaagatcactggaggcagaatgaaaaaggatagaaaatggtggaagacctgctggaaaattctcttagaaataaagaatttaagagagctaactgctaggaacaagccaacaatggtagctatctctaagaaaaaagaaaggagtcagagcatggggtgtgatgtggtttggaatcttgctgggcttggtcagcctcatttgtgccaggttagagggggaaaaagaagcctgctgtccttgcccatgtttctttctgcatatcataaggtagtttcatgaactcaatgggcaattggtagatggctggggttctcctaggcctctgggatgcctcccatggagatctgggcacagagggcaccgtccagcccctgagcaccatgactcaccatacctggtccttcctctgtgcctcctctgtgctggttcctgggtgtccagagacattgaatcacggccctcaacccaggtgagctcacagtctagagggagacagagaagtcctgtatttcttggatcctaagatgatatggttacaaaacagtttatcaatttaatgacagaatttcaggaagacaaaaaaacaaacaaaaaaccaaccaaccaatcaaacgaacaaacaaaaaaaacctcccagcttaaccagaggcagattgtaggag

SEQ ID NO: 64584 - DNA, 1051 bp, Homo sapiens
ggccaaatcagctggccacgtttttgtaaatacggttttattggaacacagtcatgaccattcgtttctgtattgtccatgactgccttcatgctacaagggcaagattgagtggttgcaacaaagaccatatggcctgcaaagcctaaaatatttactatctggccttttatagaaaaagtttgccaacccctggtctaacccactgaggtttttccaaacgcctggaaactgctggccacaatcccagtatccttctcctttgaggagaagagaatccatccctattgtcaggttggggactggccagagacccctctccagagggagaggctgcgccgcaggaataggagcgaggggatgctgaccaagaagaaagcctccttcagaggggagttgagtcccaacttgcacttggagagcgcccaagataataaggatgataagaagaaaaccaattgctaacttttgtgattgtgtgccaggttctgttctaagctccttttttgtaggattgaaccttcacaacagcctagcacaatgggtacaattagtattctcgttttgtacatgagaaatgaaacgtagaaagattaaataacttgcctagcctagtcagtggtgggaccagaataggagtccaggcatgcttactccggagcccatgcctgtcatctcgctgcaggatctggatgaaatgggtgtctcacctgcactgggaggggtcaagagcttaaccctgtaactttcctcctttctcttttcatcaactgtttagtgactgcctgttgtgcgcaagtcacagtagagctgtgctaggctctgtgatgggagagcaagaaacatcacatatagaacccgcgtctgaggagcccgcagatgggaaggcagcagctgtgtgatcaattgctatctagggtagaaattggcagtgtcgaaagagaagcatggggaaaatgccaggtgaatcaaggggcatcatcttccgagataccacatagccattcaaatgttgagcatcaggggctcaaaatgctaatgcccggattgg

SEQ ID NO: 64585 - DNA, 1057 bp, Homo sapiens
tgagtatgtctgtgtgtgttttctgctgtactgttatatatggatagaatcctctcaagaaaagtccaaggcagaactcaatcaagaaatgagatggcagtgctctattatattagtgtaatttggtaataaggaaaccaattaattcattctttgttattaatagcaaggaacgtatgcagagaaaggtcctatggggcaagagagagatgccaagagtgcaccccttccttcatgacagtagttcttaaacttcaatgtactcaggattacccagggagcttgttaagtgtgcagaatcatgggccagagcatcagagagtctgattttgcagatctggggtgaggtccaagaattcatatctttgaaaaatatgaccaagtgagtgtgcataagatggtctgtagccttcactctgacaaagactggtctagattagaagatgaaattggaagactgagggaaggagggaactgggtgacttggagcaagcaggaatgggatcctagaagatgggagaggagctgaggtttgaatgcatgcaagatcccgagaaaacagggaagcatactttggatttggtctgatgaacagacggtggagagctctggtggacaggaagctctggctcttctccctgctgccattggcaggagatgccaggttgggtaggcatcacactgggaatgtcagccactaggaagggtttactgagaatcctggtgaaatataatgaacccaaggcatgtgtctctttgtcctctctttaaggcccaagatggctggctttaagttgcctaactgtgcccatagagttgagcttctttttatctatttccttattcagaaatgagggcttgaagcagcctgcagtggtagacctggaagtataaagtagatttgtgatgctcagggcaccagagtgggctagcagaaagggcaccagagatgataggagatgttgagtgccatttctccttattaggggctgtgttggctgagaggggccacagctgaatctcaggtctgcaggggacccatgttccatgataaagt

SEQ ID NO: 64586 - DNA, 1140 bp, Homo sapiens
aatgcagagaaatagcatcactttttttttccccgtggtaaaaataacatgcaaggatgggaagaacaaatggaggttgggaggctgacattgcggggaggaaggagctagaatgctgggggctgtctacctggtgccatgtgctgccatctgcccagtatgggggcaacatcagcctgacctgccagcacctgcctggctaccagtatcagctttcaggaataaaaagatctttttcaaaaagcctttgttccccagggaagctcaaggggcagagtgaggtccgtggagggttgtgacagttcaaaacatgctgtccatttatagtatgcagcagtgaccctatatctcaccctctctatagcaactagctccagacacaaactgggcatggcttttgatcatgaagcatgtttttacaaacaaaaaaatactgaaagtagtatgtgaggctgagattatgttaatttatgcagtttccactgctgctaggattaaaaatagctttctttcaagaaaactagaactacgcactgtcagtatgccttctaggccctcttgttgggctccaggactggtgggccagacacaggacatggattatgagatcctccttggcagtcccaggttctggagctttgctgaagtggaagataaagacactttatcttccagtggtaaggactcttacaaagtctttactgcatgtttcataaaactggatatgctgagctctaatgaaagctgttgtcagcattaaatacccagggaaaggcatggaggcctttaaaaaactgccacaatgctcctgcactgaagtgctcacattttgctccatatgtgagagggaggggaatttggccagtgtcatccacctcataaaaggcaaacccaggatttaaactcaggtctggtgcctccaaagcccaggaactcatgacatctcttcccccaactctgctgttctacatgttgattatggctacctgtggtgctcattttaatcagatttcatcaatataaacattagtggtggggtcttcctttagagttagtatagccacaaccacctcccctaggttatgcaggacacctggcaaaccttttctgaggggcccctaccaggggaaaaaaaaactt

SEQ ID NO: 64587 - DNA, 1002 bp, Homo sapiens
cctagaattggctgctagccgtagagcccaaggcaacaccactggggtaattcctgaagatccttgggacatctggttgacaccataagtggacagaagtttagagactgctctgaagggacagctgaggacagggactcctgtggttctgggtcagagcaaggaacagcctggtcaatcccagccactggaaagagacttagagaatttcaaagagagcatggaaaccagaaaatatgagtgaaagggaagggagtgaatctacatattatacaccgtctatataccagttacagtgctatgcatcgtggggagttacagggtgcacaagaaggacagaacccatactttcacggatcttacagcctggttgggagaataggcattataattacatcatggcagggagaagggatggggaagaggagatggggaaagggcccagctgtcaaatagataattccaaggcagagtaatatggtagaaggtggtataacctggcaattgcaatcacagacttgggatcaaagagactggatccaagaaccatccttgctcctttccagttccatgtccctatgcaaggcatttatttatactctgagctcagtttcctcatctgaaaaatggagataagagttcttacccgacagggtgcttgagagggttaagtgaaatagtgcatggaaggcacttagcaggaggtctgacatgcatatcgtgcccagtgaatggtggctattactagttattatctgatttctgagacctgagcagatccaacgcagctgatccgagtaggggagctgagataagtaggtgctctgacagcccaagccatggctgatggtgaaaccactgacaatctgacagcaaaggaagaggggaccaaaaaatctactgtctcagcagctcttagagcaattagtggtggttatgatgtgaatttctgtttgatgtcctcgtctttttgagaagatgtgagtgtataatgtacaactt

SEQ ID NO: 64588 - DNA, 1048 bp, Homo sapiens
aggaagaacagtggggtttaggagaaagagcactgtgagagttgtgtagccttggttcaaattctactccccctatttgggattttggacaaatgacaacctatgtgaacttgtttcttatctaaaatgtggtggagatcctcaacatttactcataaggccactgtgaggctcctatgaagggctttataaactgcaaaggaccctacaggtggagaggtggtggttatagctgttgcagctccaaagtgaggccagtacttctgaacttgggagtcaggggtctggcctagcataaccaaccactacccaagcctagcaacaagacagatggcagaaggaatggatatgagctactccctctttgctggcccaggatatctccagggtgggtgaagcactggggtcttccacccgtgctgtgagttcctggtgctttctccctcctgggtcttgcctgcagtctgctcacacaagtgtagcttcaggtgggaatgcctagtgcctgcagttgtcagttctaggcatgaggagcttgtgtctgggtttccccaaaggacaacattctgggtctcaatgaaggacaagatgcagaattccaaggcgaggccacaaaaaagtgctgggcttagcctagagctacctctccagccccaggaatgtgacggtatctggacctggacacaaagcattagctcatcccttctgatgatagacaaagagcctagtgctcagagttgggcagtcatcccggcagcttctcactgtcctgcccaggcagctgtctggactggtccagcccaaagagcctggagtgtctacttaccccactggcatggaaggtttgggtcaggccagggtcatcccaatcctcaggccctaatgctaagcccatctcacaggtactcggaggaggagtcctatttgggttgtagtatgcttcccctccactggcctcagatacagttggtttactgagcacctaatatgtgttagataaggtacaagatgttttcacagagattatctcatctcttcctcaaagaag

SEQ ID NO: 64589 - DNA, 1372 bp, Homo sapiens
atgggcagttgagcatggcattagtgggatatgctgggcatgtagtgagaccttgtccaggctttgtggggaaggctctgatgtcaaacgaggcagctctgaggctgtgggcagtgctgaccagtggactggtggaggcagagagattggatttccttcaaagcaagtcacagtcaattctcccagcttgttcagaggcccttatagatgcctgcatgtgccctgggattttcacatcccaggagacagtgaggcagacctgtttacccacattttacaaattaggtaaccaaggattgcagagttcaattaagccactcttatttatcaagcatcttactgtgatgtgaaggcacaagagacctggaccccacctccaaggagtatgagagagggaaaaagaaatgtagccaggccactggaagtgtcacaatctaggctggatttgaatcctccctctgctacttctcactatttaatcttttttgaatctcattttccttacctgtaaactagttataatacatacaccacaaactcctcagggacaagggccaggcttgtcttgttctccacctaatccctggcgcctagcatggtgcctggcacagagtaaggaatgcatatctgttaaatgaatgagtagacattgtcatgagtattaaatgtaatgatgtgggtaaaatgcttacttaaaggttcatgggaagcactcaatgaatggtagtgttaatactctgttaggaacggggcagggaaggtgcaggcacctcacttcacagagaggtgcagaccaaagagaaacaggcttgcaagacaatgagcatatccctcagccaggtttccaaaacagatgatgctgctgaaaggtaaagatgtgagtgaccatgattaaagatattgacaggcagagatagggaagaacttgcccaaaccacaaggctggtgactggcaaaagccagggttaaaacttggagcttctaactctcagtttgtgttgtttctgggccattcagaggtcttcttgtaccctttaaagttttaccagcagattgtttaagcatcctctgtatgaagctcttagaatttcaaatggactcttatttttagaagcagcatcccactgagcatttgacagtgatcgattcatttcccagtttgttttttaataagcttaaaggttactgttgataactgtttatagacagttaatgtggtacttgcagttcctgatttcttaggcctgggactcactgcgccttcaagatgctgaaaccaagcaaggtgtgaggagtaggtgggggcatctccctcccagattttcctcacctcttcaaggctgtcattcacaactccagtcactggctgctg

SEQ ID NO: 64590 - DNA, 1061 bp, Homo sapiens
tgggctgatccacggggaagaccctgatgcccagagaacacactgtgccagctggaaactgttgataaagcctgtggtgaccacttcagcgccctgctctgaccttttcccatctaatgtggggctattttaatgttgttttgaagctgagagagcaccagaaccttgggcctgctctcctggtggaaaccacaggcttcatctgcctttgtggtgttgccaaacccttgactgtcctataagggagcgggcttgagagtaacacagttggcctcaacgcgtgtgtggaggcctagggctcctgtttatttttagcaggagtactcaagcagcatggcagagtttctccatactgcctcataaggtgtcctcagattctggggctgcaggttgcacaagagagcaaccctggggtggtgacaagaagagagtttgaatttctgaattaaaggcttttgctcctctgcctcgggttaactgtgtgaccttaggcaagttgcttgacctctctgaacaccagttttatcagctataaagtagagtgggtaattcctctttatcgtaagattcagcagcatgaactaagaggatttctgggaaagtgcttcataggctgcatggtgtgtgatgggaaggtataagggacatgaatagccctgtatctggtgcacagtaacagcttacacttattgagggtatggtatgtgctatacattgttctgggtacttttcatggattgtcctatttaatctgcacaaaagccctaagagatactgttataatctctattttacagatgaggaaactgtggcttagagaatttatttgctgaagatcaaacagctaattaattgccaaagccaaattcagactctgcagcctgcagtcttacccccagtctcttggtgctgcctctctcagtgtcatcattatcattaccatcatcattgcccagttattggaacctggtcttcgacaaaccccaaaaatattatacattgtctctaatcctcacagcagcatcataatattaactcattgtaatatttacattgtggtg

SEQ ID NO: 64591 - DNA, 1051 bp, Homo sapiens
gatggtctcaatttcttgaccttgtgatccgcccgcctcagcctcccaaagtactaggattacaggcatgagccactacgcccagccagggaagtcttttttattccttaacatcaatctactccatagggtcttttggttacctgtcctcaatagcacttcatattttccttcatacttcttagcacacttgtatttacctgcaatcttcctgcacttgtccataagctccaggagggcaggaaccttgtctgtctggttcactactttgtcctcagcacttaaaaagtatctggaccgcagtagatatgtgatatgtatttgttggagaaatgaaggaatgaatgctcacaaagatcttggatcttaaatgttccacttgaatatgctacttgcttttgacaaaatgaaataacaggagactgtctgtattttctgttccatttctctaccctatagagatggtgattgatatctggagtttaagaataaggcatagcatgcaagaattctggcagatgaacaacctgcttagaaagtctgttcttgccttcgactatcagaacagcattattttctttggctcaaaggaatctaagactgtgtgtactcagggaaatggtgtagacccacggtgtggagtcagggccaagggtgagacttaaataataattaagtgaaagagggttgtgtgaagcctgggggcgacactgcctttctcagtggctgcggaattagaacattctcccttgtgtcaatgtggaagtgaatgaattaggctccgttttatgctgtgcctggaaaaataccaatccgtactcgcatagtttctgaaagcaaaccccaaatgccactgtctcagctccatgggagactgttaaggaaaaaaaagaggtaacattcacagactatgggaaatatcactgaagtggaaaaagattagcgttgttgtttttttgtttttttgttttttttgttttttttttaccttttttgaagttacatacccctttggtaatgtaacaaaacctatggaccctccttccccttc

SEQ ID NO: 64592 - DNA, 1064 bp, Homo sapiens
aatgggagtctatcacatcatcatcttcttctcctcctccttcctcatccttcctcctcttcctcctcatcctgtcctcctcatcttcccttctttccttccttccttccctccctccctctctccctctctccctctctcctcctcctccttcttcttccccttccccttccccttcccctccctctgtctccttctccttctccttccaaccctttaaaactggagaagctgaaagctgtccttaactgacgggcttacaaaaacaggttgaggactggatctggcccctgggtggcagtttgctgactcttgctctatacaagctggcctgacccttctctcctgctcacatcttcttgcccactgccttgctcactgtgctctagcctcagtagcttgctggctgtttgggggcacactggtcacattctgctcagggcttgcacactcctgttccctctccccgcaacattgccccttcaggtcttccatgtggcttgcttcctgcctttgtttaagcctctgcttgcagaagctctccttggagaagcctctctgagcagcccctccaaaatgctctccccactccaccccaaggacatgctatccctcagtggcttctctctctaggacttactatatcttcacttgcttgtttgtcactaatgccagcctagcatcagctcttccagggcaggtgccagctttgtctgtctcattcctcactctccctccctatcacccagaatagaacctggcacttagtggtcaatcagaaaaaatatttgctggatacattaataaatatatccatataaggacaattttttaattatataatatataattaatacatataaggacaattctgccatgtggccagctggttttcaacccctgtagtactactcatttgcaacaaggccctctttttaaatcctcagcccggttggctctgtgtaatgcaaagaggaatcggatgaaggtgccaagcagtgcttggggtggctgtggactgtgagaggccagttccatgtgctgtcatggtctgaagggtgaat

SEQ ID NO: 64593 - DNA, 1030 bp, Homo sapiens
ggttccaggctatgcagtctgacaggcctgcgttgcaattccagccacactatttataagctgtgtgacaattagcaatttgcttaacacttgtgtacctccattgtactgtaaaatgccagtggtaccatattcaaaggtttattgtgaggactgaagatggtgatttatataaagcacttagatagtgcctaggacttttgctaataataacattattgtgtaaagtccacttgtcttgagaacctatgaggagggtatttggataggagctaataggtctaaggcctagtgtgaacctctcattaggcagctgtgcagctttggacagctcattcaacctctttgtgcttcagtgtccttctcaggaaaatgggaccatgccagccattcagcttagttcacagagcagttctaagaataactgccaggataactgatgtgagagtgtttttgaaaaatataaaaccaggttatcatgagttcttgatgttggcatttcactggaatatgaccaggaaggaagctgtggaaaggaattgagtttgctctggaggacctccgtactggttctgctctacaatctgagaaatgcccagaacagctgaggccaatcaacagcagcagtaattatgaccaatgcaatgtcatggacctgcgcagaagccaaaagcaagtcattagcagcacttgaagttttcctttgctaaacaatggcaccttcattttgggagttcccaggttgtcctctctggacttttggatagagggtgattgcagatacactctgtttctgctggtgcacctgtttcctccctcaactcatgtttgtggaccagacccagagtgccagcatccaccccgaccccagtggtgctcactggaggcaccctctcctgggctgggtgaaggaggaagccctggagtagattgtgtccaccgttgtgtatgtgtgcttgcaaacaaccatgtcctgggaggattaagatccctaacaaaaatggagttagtttacctactgtttttgttc

SEQ ID NO: 64594 - DNA, 1043 bp, Homo sapiens
aagctactattttacaacttcatttaatgtgctgtaacattagcagacgttatgcacctttgctatactatgtcatgattccagctccctaatcctttcctggaatctttctccaaccagactggtgtggaagaggccagagtttcacataatttctctccaagctgtacctgagatgccactctaacaggcagcataggaaagctgggtcccgatctgaactgcatagggtcaggttgccaaacctaaatgcttttttaaaaagaagaaaaagaatgatttgccaggcagggaaaacgtggagcctcccaggggatggcttctggagcttggtggcaggtggccatggtaagggctgggatgtcttctccactccgatattgctgcccgtttagtctatggagggagctttcctcaacaagggtcaggggtcagcctttattgggtctgcctgaatctttagagctgtctcacttttcaaattaactgtgaggaccacccaaggtagttatggtccaccaaaataccctttccccatgaggtggaggaagggctaggggagctcaagcaactgggaagccctgagggagtagcagtttctgtcccgtgtatcccactgccccagagcccaggcaggaagaggcatgactgggtcttggcgtccagatagcctcagatatcctcagtgatgagcctcagcttttctgtgaatgctagaaaccactgatacatcattagctgaagtatcattagtttgcattttgttcattcacttattgattgatcaatttaccctttatttgttgtgtgttttgtgcagagcacagccttggtgcctgtgttcgttgtgaaagattttgcttgcagatgattcttggtttgaattccagccttgccacttactaatccctgaatcagttttcctcttttgtaaaaggctgttttacaactctctttccccaggttgtgaaaagatgaaatggcataatacaggaacatgatccagcatagagttggaagcatgtttgtctgttaaatgggaa

SEQ ID NO: 64595 - DNA, 1093 bp, Homo sapiens
aggctctgagtaaatggtcacatcttttactgccccccaaggtgtgaggcaaccagcacatcatgcaacaccaagtcgctaacagttgttcctttctgtttgcaaaaggggggaatattagggctggatctgctgccacttccagggaagaactgcagcttcaattacttttcacttaaaaggaatattgcttgttttttttttttttatttgttagcatttattgggcacttactaggtggcaatcactgttctgtgcctttacacacattatgtaatttgtctgcacaacagtccctgtgatgtaagtactattattatcctaatatgatagataaggaaactaagtctcagaaggtgataatttacccagagttagttagtaagagggaaagccacaatttcaaacccagaacaatctggcttgaaaactatacccttaaccattctcggccaggaactgtgccaggccctggttgcagacaagtcctgcccacgtggacatcactcacatcaaggacagcagaggaggatggagcaccttcccaggttaaccattaccacctcaccagctgccaaatggcaagagggcaaggcgttggaaccgcatctttgagctcctccccttccctatccagcccgccccttgtactgcacccaccaatctgctggggcctctgaacacgtcaagcccgccaagttcctttcctttcctggcccaggtgtggagcccctggggagcacacgctggcatgacaggaagaagctgtgcctgagagctgttcaaaggagcatcttaatctgcacatgagagagacctcatcccattgctgttggtaaatacacttggtagcagagttggggtgctgcagagttcttccctccctaaaaagagttagttccatgtgagaacatctgtgactggttgcctttctcaagcttggtaagcacttggggcaagccgagtgtttgggttggaatctcaggccataaccatccagagagcgggcactcagtctccccagaagaaagcctggcaggagaggaaggcagcaaggtgtggggaaagcataggacttattcaaatttcagc

SEQ ID NO: 64596 - DNA, 1076 bp, Homo sapiens
ctcctctgctgtgggaaaatggctttaaaaagatgtggggaggggatggtttgtgcatgaatgaagatgacgagaaatgacacttgttgttggaagggaggctggccacggggagccctcatgcttgtttctgactgtggataaagtactgctttagtttaactcgactttggaagcctgagttggggttttggggatctgcaactgataccgtgtcaaatactgtgtcagatgctttacatgggttatctcatagctgccttcatgtgttcccattttacagatagagaaaaaccgaggttctgatatattatgtaacttgcctggtgttaccaagtggatggtggagattttaaaatctaggtttagctgacttcaaagcttgtagttttcctggcaatgcctgacttcgacctatgaatctatggactcttggaaacaaaatccctaaatttacatatctgaaatatcagcactaccccagtcagtattcttgtaacccctttagcacacatcccctccactccgctcagaggaaatgcatgaggtggttaaggagaagaggtgagcagaggctgggtcctgcaagaccatgccaaggtctcaggggctgggactttatcttgaggataataggatgatattgaaagtcctaacagaagagtggcatgaagcaacttcagcaactattgagggccgacactagcagacgtgccttttcccgctgattgattgaaagcgttcttatgcccacatgaattccaagagaccctgctgcttcatcttcaagaactccagggattctgggccacaggtggggaactgccagcatagaacattttcacaggacttagaaaggtaaggaagagtgaggagagcgttccagattacagatcttcactgagttagttctacaattgctgagtgttgtgtccctgtcaccaaaacctgctaagaatcaacaaccctaagtgagtagacagaactacccagtggatcttagtgtgggcagatagcatgagatttggaatcagttgccctgtacaatgaacccggtatctcccaaattaggtgct

SEQ ID NO: 64597 - DNA, 1061 bp, Homo sapiens
ttccatgaaaccatgcgtgtctgatttctgaacctggaatttcactacagaggtttttatttatttattttgtcccctgatagctcagtcacttggagttaagtagttgattgaacatgcaatttttaaagctcattcatgctgaatttgctttagtgtggtagccagtgttccatctttatagagtttctttcccacactcttatatgaaaataaacaaggccctaaaatgtcaggcaagattccttctggctttgtaacctaatgtattttatagatggttgaattctccagtgaacatttcattggaaaatattcctttcctgacttctgtttctccatcaaagggatattacattgtaagtgataactatttcttagtggccttgacattgcagttctgtgtaggaaattatcctgcatcagtcacttctgttgtcatcagattcctttcatctcaagtacctgcatttcttcaacttaaaatttggaacatgatcaggcctggggccagggagatggaacctcttgatctctcatatcagtgttgattcttagaaagaagaaggtatgatgattgataacctggtctttgaaagcagaaaaccttggtcgaatgtcagctttgcttcttgttaactactagaccttggccagatcgtgtctctgaatttcagttgttttattttaaagtggagattcatttctaaagaggggatggagaatttcttttggtattctcatagaggctttgtatgctgatgctttggtgaattagaaaaagcaatgctagagaccctcctttttggggaacacttaagcctcgctgtcccactcaccatataatagattttctaaatatcaagaagtaacttgggtgtcagtgaaatgcccctctttcctctttcggagataattatctatatatctctatgtagagtgtgatatgatagctaaccctgcctgggcatcagaatcctcttgagacccttgaagggaaaagaaaaatgggcatccaaacctactgactcgcacacttcaaatatgaggcccaggcatct

SEQ ID NO: 64598 - DNA, 1027 bp, Homo sapiens
cttctcacctctgaaagcactttgcatctgcctttatcctggctgttgtaactactcacatctctctcaatcaggagcttctatagagtagagaacaagttttatacatatttaaaacacaagcacaacacctgactcactacaggagcgtgataaacaagcactcattgatttactggtgggtgggtagatggatgaagggaagaaagtaaaaatggatggaggaagggagggaggaagatctgggtaaacagactggtgaatgttcagatggatggaagcgtggatgagtgggtggaaaaaaagagatgaatgattaaatggtgggggatgcacaaatagacagatggactaatgggtgggacagatgaataagtatgttccccttcactgcctagattataaagtccataaaaccaacatatttcatgtagctgttagaccagtcatagcaaaaggcccacagcaggcactggtaagtaacactgccatgagacaatttcagtagcttggtagtaggacccacccgacggtggatgctaaagtgctattttcaaagatacaaacacacatacagtggtatgccagggcaggcatggactggctcaagagagttggttgtaacattttcagtaaattttggagctgattgttaactacagccactattttaataattaaattatataaacttaaaattatatttttaaagtgatagtaaatatttaaaactcatcactttctaattattttactgtattttactattgtttatggtcatgagattatttacacctattatatctgtatgagggaaatactatataataatgcactactgtacatctcttcccagctcagagtgggtaaattaaaatcagtcttggtagaaggatttacaccatggtaattggcaagtactacctatcaggcttttctccttggagagccaactgttaaacgtcactgagtatagacaggtgagatggagtaaaaaaaaaaaaaaaaaaaaaaaaaaaaaaatcac

SEQ ID NO: 64599 - DNA, 1051 bp, Homo sapiens
taacgtggggctggtttaatcctgccaactctacttgggtctgacaaatcaaaggctaagactccagagaggattagatggtccgggttaatactaggggaagggaacttgagcagtggaatttgtcatgccttgaccatgtgctgggaggagagagttcctccagtgaaggcacgtgggtggatactggccacagctttgccttgggccttaaggtaaccaccccatgggcctgactgagagcccagagcagacagaggaggcttacaggtcaattggacagcattagcctgattattgttactggtagccttggccaagggagaaggtgcaaggagaggacagggcccagcctctctggcatgttgttgtggaaaagttgcttacccttcaagtgtgagaagtagtctttcatagttggagctctgctcaaatccgtggagtacgtacctgaaaacacagaaggttggccttagctgaaactgttggactactgctgccattcaaagagaaaggagtttgttttccctgttgtcttgtgattgatttcttagactacctgccattgattctcctcttctcctttttcctcctctccctgtattagttttctgttgctgtataacaaattatcacaaacttagccacttaaaacaacatgtctttattatctcacagcttttgtgcatcagaagtctaggcatagcttagctgggtgcctctgcaaggcttcagtcaagctgttgcccagggttgcattctcatctggaggcttaactggggaagggtttgcttctatgttcactcagtttgttggctgaactaattttcttgctgttataagactgtgggccctggcttcttggtggctgtcagctggaggccaccatcacctcctagaagctgctctcagctccttgccacatgggcctcccaatatctgcctgcttcctcaatgccagcatgggagaaagcttctggaacaagtctgctaacaaggtagaatcttacctaacttaacataatcatgggaatggcatcttaccagctt

SEQ ID NO: 64600 - DNA, 1035 bp, Homo sapiens
ttgccactgctttgggaatagttattaggacaaacaaaagcaatattaatctggccaaagatggagtgagatgctttcatttgtggcttttttctctgggagctgagttgtagctggactgatccactctgaactattccgtcttttgtgacggttgtatttgcctttccaagagcctaaagcacaatcacagctagctcactctctttcccagtctccaagcatttccacgatgccccttcactccaagactgtcatcgatgcagttgtctctgttttagatgacgaccttgccccagctgtccctggaggacggcagctcgatgagtaagtcctgaagcttgctagatgtgtctcagtatttcacatgcctgcactgattggacaaaccctggtatgggccttaggacttggttgcctcaagtgtcctgaacatcactactgaaagtgtctctctggtgatttatttttctgacttgtgtttcctttttcagcaaatgaaaagattgaagacatcaatggctgtccgaagaacagatcccaaatggtaagtggtgcataggtagtaaatgtttgagttctgtcagcaagccctgcctctaagtgatattgaccatcttgaaaacattcataccagatgctttactccaggggattatattaataaactcacagctatttccaagtagctgtgttctgcttttctgacatttgttggcatttattgaaaaatggctatgatttttatgtagattgtgagacagttaaagtgaaatattgtccttgttcttagacacaaattatgcagaactggtacaaacatatacatgtttagtacttgaactgctgtggctcgttctgcttcctcaaagacccacatcaatatgtgtttgtgtatggagctgaggcacggatgaagtgatggtatcttactaatcagaaactggagcatgtggtcagattgcctttaaaggttggaatgatgtgaaatcagaactgtgacaggaaatgtgaaatgtgcagtcacatctgaag

SEQ ID NO: 64601 - DNA, 1078 bp, Homo sapiens
tggaagctaccttctagggttgttgtgatgggggtataaaaggcacctggtctcatcctggctcacagttaatgcaagtgagaaggtcattccctgccctgtttacaagtcacatatttcctaactatggtacatcaaaagattttttcctattcaaaaagtacgccctcagtggggtagctgaacagtgtcaacccatccccaacaatgttcacatcctaatccccagaacctgtgaatatgttatcttacctgatgagagactttccaaatgcgattaaggattttgagatgggataatgatcctggattatctgggcaggcccaatgtgattacaagcattcttataagacagaggcaggaaggtgagagagatgtgacaatggaagtaaagttggagagagagattggaagatgctaagttgcaggctttgaaggtggaagaaggggccatgagccaaggaatgcaggtggcctccacaagctggaaaaggtaaaggaaacagattctcctctagagcttccagaatggatgcagccctgccaaatcctaggttttagcccactgagactgattttggacttctgacctccagaactgtagataatacatctgtattgttttaagccactaagtttgtggttaatttgttgcagcagcaataggaaactaatacactctgggattcatgcaaaataactcttgctgtatcagagagtaagctatttgggttttatagcacaggctcattttgctgtaaatgtgggttccttggatttctgagtttactggaaggtgcctctattgttagaacccttcagaatggagcttgctgcatcagtacattcagagcacgtcactgtagggaagcatgtggaggacagagacccacagttttttatttctagtactgtgtccacattgtgggccgatatacatactaagctgtcatgggagaggcaagtgcatttcatctcagtaattagaagtgaatattgcatcttctggacctctttgccaatgtaaactcacaaataggtactttgtccccacaactaacatatgtttgtcttgtt

SEQ ID NO: 64602 - DNA, 1004 bp, Homo sapiens
ctagctcttgtcactgcccagttgggtgactatagatatgtcacttcaccttgtgggcctttgttttcccataagtaaagtgagtagccagctgaattatttcatccaagcctcacactctgtgattctcatgtaccactgagaacatttggaagcagaagtggaacatgctacaggtgtgtggctctcatttggtttccttagtgtggggaaggaagcatggctgaaggattaaagctgaattaccaaaagagactgaggggctggcccaccccttggacatttctctgcttcacacatcacacagagtggtttataagcagtgactttgcatcctgacttgtccacatcagtcctggctatcaactgtggtcctggtataattaagagctccccactccctggctttcattctcagaagcgtcatagttagcacaataggttaaaaggtcaccatagtaaaaactgtcatttttaaggtatgaagctggagctgtatgagaatctcattcaggattctggggctatagtcatataataaccaagatgaatgaaggacttcactgtttaaagtgtgcttttgcctaagtgctcccattagttctgcaaaacaaccttgtgcagtggggcaaagcggtgtccgtattgcccttttactgaggcccggagagattaagtgacttgcctggggttgcacaactaagaagtggtaagaatacagattggaactcacggcttaggttttccaaatgctatgctcctgtctactttgtcctgtgatcagaatctgctagctcccaaagtagggtgtgaaggctggattctagaagttcgtattgtcagtttcttcagagcctggagaaagggatgctccaagggaaataattcagcctgacctaatcagcaaatcacactggggggaaggcactggcagggcgcacttcctcctctgcgtggaaaggagcttgcttctgaaaggactccattcatactttctgcccccc

SEQ ID NO: 64603 - DNA, 1032 bp, Homo sapiens
agagcaggtatgcattatgaatgttcagacaggtggtgacacagaaaggagcattctacaaacttggccacgtcactcttcttattttatagagcatctcactgcatagggttccaaggaacatgcattgagaaatagtggcttgtgtcactgagctttgctaacctgaggcatccatttccatggtaggcgtttgttttcttaaaataaccagatattccagtcagagcacccatctcccagtaagccaaaacatcctactactaacgagtgctttacctaaagaagagccaaacttacttgagtcaggtttttacattcatttattccagctacaaagtgtcctgccatcatggccccctgaccctacagtggtgacatagaccgggctttggagttgctgtatgtcctcatcccttcatcttgcccaggttgggttacttctgcagaagactggttttattcactatatcctgatactttctaattgtatttccaaaggataatcttgttctcaaggtctagggatatgctatcccatgctaacactctggctataaatttaagaatgataaaattacatcagtggctcggtctccaaattctatctttgataaccaaaattccaagggcagtggtttggacgcttgattattaatgtcaaatgttgatgcaaaccccccacatgccaggtttgttttgtttttctgttagaactctgcctaaaaactattttgaagctatctaggttcagcacccctggggggtagcaaatactaaagcttggacaacattccatgaagtttgctggtaaaggagctatggaagttggcaaagaaaatctgagatttttttttgctccactggcatgaaggaatcagagcaaatcttccatgacagcttcatagaggctcactttgcttcttccccttagctcatctcataactgacatggtggccaagaacttaatccacatttcaccctgtgaaattccccactggtctagagtccaggagaggagcatagtctcc

SEQ ID NO: 64604 - DNA, 1037 bp, Homo sapiens
acacacatgaatacatacacacaagcattcttagataatcttaaaagcagtttcttcacattggaaatctatcaaatcagtaaactgagacctagaaagaaagctgtgtgtcatagaaaacagtgggcagggggggaaagaaacagcaacatccccattgtcagaagactcttaggatttgtgtgtctaatgtatcttctctctcctcattcagctcttccacttttttctttcctatcatgcagtgcatcatccaaggactcatctcaaagcaaaatcatccgcttcactctgggtcagaaaaagatctctaggttagactttctctgtgtcctgcaaagcatggtttaatcccaacccactgttccattgttccctctgttctggctgagtttgcctttggtcctctcctcgtttcatgtttgcagttcgagaaaactaaatgtgctttggctaatggtcccatggtgcagagctttgaaagtggccatgggattgttgcaagtgtgtgtgggggaagtgacagagtgcaagtgagattgaggtgtacatgacgtttcgcattttcttgacttttggctttgactgctttgtcatcagactccattctgatttaggtaaaggtgagtttctacatagtttttatagtggttttatgatgagtttgcttcctgcttcgtcctggccctaatcccacctcacctgcatctcatttatgtgtcttgtgctttgtgttgttgttgttgttgttgttgttaaaattactaatgtgggtttggttttcccttgagttataaagacttgagcatgaatccatattgggcagaggagacaaaacagcaaggcagctatgtctcgtctttgtttctggatgctcttaggtgccatggagaccgcctcagttccctgaaaataaaaaacaggcttgctcacaagctagttctcttaattcagacttcaacctgtctgctgcctcctatgaggacccatcctatggtatgggaaaagccagttatatcacgttgcatcattgcttc

SEQ ID NO: 64605 - DNA, 1063 bp, Homo sapiens
atgaggtaaattaaccaaggtacaaatcctcgcagcacagtgggaagtaattctcactgcaacttgttgggggaagagctaacccccttccttctctcccagctcccagtcagggaattgggccagcttctttttaactatataatttttacagtcccctcacaccagctcatgttctctgtttactctacaaccatctttcttgcccagccaacaagaaaagtttaaagtgattgcctgcttatatctaaaatgcttccagactgtagacttctttggtgcttacagatttgcatggaaagagaaggctgaaagttttatgacttgaaaattcagacttgtcactagatctaatgctagtcagctgaggttccagtggcttttaaacacagctaagtggatttcaagctgaaagatataactaaacatttcatcatttattcatctttcaactttaattattggaaacagcctgcttagtaattccctggaccaaaatcctgatttgaggagtcttaccattaactctttggtgaatgggccataatatctttagacacattatggatggtgactttatttcccaagccacccaaaatgaggtgttttatttaaagggagagtgtgtgtttgtctttaggccaacaaattcctgccagttttacaggaagaatatatgatgttatccatctactgtgcagataagttgtacttcagcctcaaaataatgcctttggagacaggtcatcaggtgttgaagggaaatgtatgtgtgggcaagtgtttccaaccaacctgaagttttcattgcaaatatgttggattctgagtggtagtaattcaccttctcaccactataaattgtccttttcttgatacttacaaccccagattatggcaaacagtttttatacctatcagaagagatgcacacacaaggttatcagtttagaatcctctgagggctttatgttccatgcttgataaaattagaaatgactggcttgaccctattcaaaagtaaaaatacttatcccagagggaaaaaaaaaatgaactttgt

SEQ ID NO: 64606 - DNA, 1053 bp, Homo sapiens
agagctttaacaactatgataaatccaaaccagtcacctccccacccccaccgccaagcagccacgagaaaggtgagtcaccttcttgaggagcctttttggtattttccttcagagcacatctacctagttccttcgggtgaattgggttgggtcatggggaggggttgcatctgtgttgagaatgagttacaaggacatatttggtaggcaggaactttagtagccagaggtattaataaagtgggggaaaatattgttatagtcactagcaaaaataatttgctatctttgtttgggtggggccccatagacacccggctatgcatagaagcaatatagcatttggaatttgaaaataaattttcatggaatatgttccatatattaagtagtttttcagaaatgcaagcttcttggagcatgcattttgtgaactgtgataagcttttttatccgtcagaaataatgtgaggggagttaggaacaagaggtttttcaccctttgaaaaagtcaggaatgtggattggctcattgaagatcttggctacatataaggagtggacagcattgctctaggagttgtgatgatgtaacttttgccataaaaggatatggattttttttttttttttactatacacagtactgagtttttaggatggagaaaaatagtgaatagtcccatgggggtgctgcccagaatgtagtaaaacaaacctttgcttgtttcagcctctatctcttgagacattggagaaactaaggtagtttcaaagattattcaaaaagaggcagagccttccttcattccttctaggcaaagtagtctagacatctttaggaaatatgtccaggtctcctggaagcatttcctacctggtggtgtagaagattcctagggctgtctacgtggtgtttctctatttccctgacgtccaggaaagctgccccctcactccctaaagtgccccagggacatgggcagccctcctactgtgaatgagctgggaaccgccgccattttctcctctaactcagagtcacttgat

SEQ ID NO: 64607 - DNA, 1373 bp, Homo sapiens
cattgtatggatttaccacaatatcgtttaatcactttcatttatgttgtttccaattttttgatgttttaaatagtgctgaaattaatatccttgtatgttttttacatgtatataaccatttcagtgtaattgctgtatcaaagggtatgcatagtttccttaatacttccaaattttgctcccaaaagattatacctatttatatacccatcaacaagatatgagagggctactttctctacatacttgatagcacttttatcactgtcttcggcaaaaaatactttcattcttttgaaatgaggcaaattattttaagaagctgaaataacaagaccatttgataaaaactggacttgtttactgacactgctttgacaaccagttgccttaacatagtacaaaaaagcacttgagtttgaggtcaaactttctactctcaagatacttctccagactcagtttcccctctgtgagtctgaggtcctccatcactaaaccaccgtgaggtgtgaatgaattcttcagttggcgctggctattgcacctcatctgatgggagcgccatccgtgatccatgctttctggtgggtttcctcctctagtttttgttctgtgtcattcccttcctctttgttcactccttgtcatgagcagaagagaagagccagacatggctcgagacagaattttataaccttcagcactatgtcatgtctgagtaactttggggccattgatttagaatctctataaacatgtcactttatggttggcaaaccaagttatttatctgagctggtgattagatgtaaccatggaaaagttgcccacgtcctgctattaaccaggattctgacataaaattacaggttagactagatgaaattaattcagtcatccaagtcatgcagacaaaagtacagttggggtggcctgtttcaggttactttcttcatttgttcatttcatcatcatttatagagcacttactatctgtccagcactggactggttgtcgtgacaggcagaattgagacacagactctgcttcccagggactcacagtctcagagaggaatgatgctcacgtgttctataatagagagaggctcaaagttgtgaggaaaaagatgaacatagctgggaagactcagggaggacttccgagaagtgatatcatttgtattgatttccatttcaaaatttttgcttagagaaaaggaaggctgggaaagaatgacttgtcctgcccttcctgatctgggtgttaatctgacagcaaatctgctgggttcactgtgttattcaactcatattctatggagggcttgtagagtgtaaacttctgcaagatcatttctgtggtg

SEQ ID NO: 64608 - DNA, 1045 bp, Homo sapiens
tcagttgtcaaggtaatagtctctttccactgtagttgcatgaaaatgagaatgcactgagctcatttaagatgtactaagacatacttgcagtttcctataagttataggggcatgtagttctaagaactcacgggggagagcagccaaagcatccttggttaccccagtcccatagaaggtgtctctaagaagcagatgctggcaggtcggtgaaggggcacaagcaccacttgctttatgaggcccctgtggccaaggaaagaaggtaggaaccagctgttaaagtagaactccgcaaaacaggtcttactccacttgagtctgttctccagcctttgggattcttggtattcacaggcctacacttctctgctttctctttcccacaccaactggcaaaagttgttgtgtgatgaagatgatccaaatgtcagacttgggctcaggacacctggggtctggtcccagcaactctatttgatggctgtgtggctttgatgggtcatttaacacctctgaacttcacattcctcagctctaaaatggaaatgaggatagcaccaaccacataaagttattgtacggtttccgtgagatgaaaccatacagaaaaataccctaaattgtgtatataaggtttgttgaatcaatgatttcataagtgtccaaaagtcagaaatgactacaaaggggaaagtaaccacagcagctgaactgagaacctcagagagccagttctccactcctggtctgttgcttcagatcaaaagtctgaagcacccctgtagccgcctcttcttgctcatcctcctctctctctgataaaccgtgatgaaaagtgtttttgaaaaccaagggaccaagaaacactgaatgaccttcactgaaaggacgacttttagcaaatgcacacttgacatagtttggtaaatatccaccctgttatcttttgctcctggtgtcttagaaatgtcacttattgattcttgaaattcccccactgccactcatagggggagggggaatttgagacagaagtatt

SEQ ID NO: 64609 - DNA, 1052 bp, Homo sapiens
agcactttgggaggccgaggcaggctgattgcctgagctcaggagtccaagaccagcctgggctacgtggtgaaactccatgtctactaaatacaaaaaattagccaggcgtggtggtatgtgcctgtaatcccagctactcgggaggctgaggcagaagaattgcttgaacctgagaggcggaggttgcagtgagccgagatagtgccactgcactccagcctgggtgacagagcgagactctgtctccgaaacaaaataaaattaaaaaataaccaaacaccacatgtaaaaatatcatgataatttgaactcatttttatgaggacaatgatcacttctcccccaaaatgcccttaagtgtaaggtaatgcttaatccctgtctcactggcttttacagtatcatcattttgcaagcacatttttttttttttttttttggtcttgatttcatttagggcaaggacagggcttagcaaatatttgtgagctggaagtgaactgtagccaactctgttggctatatggtgcctgaaatcccagcatgtgccagatgctgtgcttggaatagggacaggacacgtagcacagaaacagacacttgtaatatcctgtgataagtgtctataggacatttatgtctggaaggagcatccaatccaatcttggaggagtcaggaagatatcctggaagaagtgaggtctaagctgaaaggtgcattagctatatacaataaggaaagcgtattctagacagaacagcgtgtccaaagtctagatggtaaaaggggacatggcatgatagagggaagttgagtgtgtatatgtgtgtaggtgtctgaatgaagtaggcaaaatgactctctcaattctacccagcaaattggtgctagactccaagttttgtgagggcagggagcatgcctgtcatgttcaataaatccttgttgaaagaattgagaggacggtggccaaaatgggatcagaacccaggctttctgaatctctttggtgttttatcctgtcacctcactctaagaattcttcatc

SEQ ID NO: 64610 - DNA, 1056 bp, Homo sapiens
ggaaacctgagagagctctgtggtgatgaagttctgggccacctaaattctagtaggtttcagcatctgttagcaaaaggcagccctcaacctttgagagcacaagtggtaacatctgcagccactctagcgattctaactggcaaaaatgatggattgcaggcatttcatcattgaatttctactaggttacatcctgacttaatcttttggtgcttacattctaatttttaagcagaatgtctgtgtttggtagtagttcttcaactttatctcattaaataaagtttagtgaactgccaaagacaagatgagctagggccaatgtttttgaaatagaaaaaatggaaatggaatttacatctggactctaggacactttgctgcttcatttgcagaataagagcaaaaaagtgattcttgtatgtttctatatctcttgcaaaagtcctctttgctttcaaacacccacagctttgagcaaatgtttacattccacttaaacacatttggactttaatgtctgtgctgctgattacgaaaatgttaaataaatgaaacagaaaataaaatttgtttcaaggtaatattttagaatgcctgacgccccttacccagccccatgagactggtcactgttgatctttgtgtccccataactggcacaaaacagagatgcattaaatgaaggaatgcattctttagagttcatgtcgaatactcattgtcatgaagaccgtcctttagtgtaactggaaacccttacccttgggaccatgtccttataggcatgtttcttcttctaaccctggtgtaaatttccaagagacccagactgtgccttatttctctttacacccagctaacccctctgaggaacattactgtatgtatacatcttgctcaaccagtgtgtttgcttacagactgacttccctaagctgtactgcagttcagagagaaactagattgaacagaaccttttagtgcattgtgttactaaaggcaggattaaggcatgtaatccgagttgtccagggaaacccatgcattcct

SEQ ID NO: 64611 - DNA, 1099 bp, Homo sapiens
gacactgtggaaatgtgtttacatctcagactaggcacttggcttctcccacatgctagacttcacctatttaaggaggcacctgaaggaagaatctccctggacttcacacttcctttgggcttccattcacacttccattcaatcattcattcattgtcaaatccttattaagcacccacagcaaggcacgtgctgagcatggaatatggttatggtcatagacatggatgctgcccttatgaagctcatggttggtcagagaattaaactagtcttaaccctcatctttctaggggaagatcctgaggctcggcggctgcggacagtgaagaacatcgctgatctgcggcagaatttggaggaaaccatgtccagtttaaggggaactcaggttacacacaggtatctgcagtgtgaattactttactgaactacctggtatcctaattttctcctgtgtttgttcatagcagtagcaaagcgatttggttataatggatcatagcctcgctttccaaatgtgccggaattcacaaagaatgccatatgacatgcagaagagagttataggaaataaaaaattagtatagacagatttttcccaaaagcagaaggttgctaaatccattcaacaaaggatactgtagaccagctctatttaaatttcactttacttgcattttctataactgtctggtgctgtggaaatgagcaggtgaactatatttgacctgtgtgataaactgaatagcttgaattcctacccaatcttctgatatgcagcactctgtaatattgttagtcatgcacgtacataaaacatgtaaggaaatatttataaaaacttatgatcatgttttaactctgatttagttggatgaaatctagtattacattggaaacatcaggtgctttcattgttgaacaagaagttgaagaggatgcaaccctgggatgtcttttgtgatttgggcaggaggaggttttatagttgtagaaatcaaggaaagttcttgttgtccccactgagctcccagggagtctcctttgcttctccaatttcagtttctttgataagtggctatggcaaggaaac

SEQ ID NO: 64612 - DNA, 1042 bp, Homo sapiens
gggagtcagatattggatcttgtgactctaccattaggtgtgaaacatccctttttccaccatcgtcactgacactgacttaatgttggcatagcagtttgacggtgggatggtaattatgacaggagggaagacttcagtggtttcttctgcagggaagaatctcattctctgctcagtgaggaaattccagttttcctgtgaaggtgcacacgatagtcttgactgggctgcaagaaactgcagcgctgtgaaaacagtggaagacagactctgccaagagattgagctcatccttgggcagattctagtccatgtaacttgattgaagagggaactcaagcccaggcatttaccaatctttccaggctttttggatgaaatatgagaaaagcaaaagtctgggggaagtgaactttagagggttagaaaattagaactgtgtccactgctcagttgggagggagctgaggatgtaaaatgtggtattaggaactcccggtgggtggagaatcccacccttaggaaaagaaggctgtgatgcaacatcctagaatgaatgggcaagcaggaaccttcatgccccatcctaatcagttcagcattttctagtattttctttcccagattggaaagaaaattcttatttttttttttgccgggggggatggagtctcactctctgtcggcaggctggagtgcagtgatgcaatctcagctcactgcaacctcagcctcctgggttcaagcgattctcctgcctcagcttcccgagtagctgggactataggcacatgccactatgcccagctaatttttgtatttttagtagagatggggtttcaccatgttggccaggatggtcttgatttcttgacttcatgatccgccctcctcagcctcccaaagtgctaggattacaggcactgcatctggcctggaaagtgagccactgcatctggcctggaaagaaaattctagtagttgaggtcatttaattaaagtaattcgtttcttgtaccatgttttagcagggaaagtc

SEQ ID NO: 64613 - DNA, 1030 bp, Homo sapiens
aaagcttttgtccagatgtttatttggcttagtagaaatgtagccttgatgtatgagtaatatatcaatctgtacagaggctctttgaggaaagttcttgtaaaagtttatagtaagtttatttagaaaatctgatatggaagtaaattctggtttctaaaaacctaagacctctgtttttaaagtgatgctgtacttcggcttggcataacagctattttttgatgcctctagttcattttctgtactggtgtgtgcatgtgcacctgtgtgtatccttcaattctccctatggtagggctgaaattactttattaccatattaccatgtagtttagctaagaattaagggcaaatgcctcttacactttgtgtgtgtgtgtgttcttatattgtgcctggtatataccaggcatgtctaagtactttacaggttgttatctgatctcactcatcccttttattggattgataaattgggcattggctgtagtggggaggaaattaaaataacagatgaaatttctcttactaggttttgatctgtgaagtcaatcttctactcatattctaaaaattcaaagtgccatatggtacagaataaaattaaaggggcagactccacgtccatatgtttgaaatgattttttttttcttttcaaaggaggcactgagttgtgtaatgttccaaagtataagtagatatccctttatggacaaaaaaatgaccctttaaatataacatcagaagtttctccctctcagaacctttgatggcttcccattgcctgtgggaacagatctgaatgccttaactgactgtggaggctcttcatggcctttgcctcatctgccttcgctgacttgcccccggccacatttcccttcacacactccagacttcccactgctctaggctacctgccaccaccaaaagctggttcctgcatttgcaaagccctgcctctggttcctgcatttgcaaagccctccctcctgggacatgctgctttcttcctggaattccttt

SEQ ID NO: 64614 - DNA, 1018 bp, Homo sapiens
agtcttggttcacacctacccttatatataagcgtttcactttgcatgggaagtgtctgaaagccactggatggtactgaggaaagagtatgttcttaaaaggcagacagacttgagatttaatcctggctctgccaagtgaactggaacaagttcttaacctttgaatattagagatagagcttgaaaagaacaggcaagaatctgagatgcacaagaaatgtgcacgcgcgcgcgtgtgtgtgtgtgtgtgtgtgtgtctttctccactaaacttggagttcctagcaggcagacagcactcattatttttctaaacccagagactgggacttagcaggtatttaatattttgagaatggtctattcttgatgcctactctggcaggaccttatgcttatataactcgctaccacacgctatgaagctcaatggttctatttacagaacacttggagaaagccagcttagcctgtggtgtccatctagtggttgatagaggctgtggtctcaattccttttcactgtgagtcattgtgttggtttaaagctcctggctggtgatatttagggctaaggatgttggcttttgagaatgaggctgatcaatagcctagtgtagagagaaaacaggatgtaagcatttggtcttccacagtggctttttaggggctgctgtcttccctccttggtggcaggaattactccatcaacaaatatgggcacagatgcctgcggggagactccgttcttcagaaattgaggaactcattcatgctgaattaattaaagtcatccctcagtatccatgagggattggtttcaggacccccagaaaataccaaaatctgtggatgctcaagtttttcatgtaaaattgcatagtatttgcatataacctatgtagatcctcctatatactttaaatcatctctagattacctataatatctaatacaatgtaaatgctatatggatagttgttatactttatttttgtttgtattatttgttcat

SEQ ID NO: 64615 - DNA, 1153 bp, Homo sapiens
ttccaaacgcctggtaacagctcccagatggcttctcttatgttctttgggctagtttgtcccccaggccagaatatccttgaacagagggattgtgtctttttactctctcacgtttccaacttcttctaccagacctgttgtgtatgcttgggtaatatgagcggaatgaaaagagagagaaagggggtgatagtaggagcagtgctgctgctgctgctgctattaataatacaggtcgtgttcattaagtacttttcatgtggcaggtgcttttcaggcattatctcattgaattctcgtagaaatcctggaaggcctataacatgtgattgtccccatcttacagatgtggaaactgaggatgacagaagtcccttgtccaaggtcatactgctactaaagggtgcggccagtttcaggaagcttgagagccaagcctattctcttggtgctgccgcctgttgcactttaggctctgtagacccaaggattttcctacctttccttagagctctacaaagcctaaccttcaactggattcatagaataagaatatgggaagcaacagagtttctgctagctagacaatatcaagctctgtcttattctcggtgctaggttttaaggggttcagaataaggcagaggtttttttttaggaacaggtaacaaggtgcaggattcaaaacccaaaacataatagaaatgtttgtagaaagtacaaatattggcttggcatggaaagtacttagaaaagcagtaggttccaggggaccaaacttgaaccataggtggaagttagacaggttttttattgcctagacaccaaggtgaccattaatcagcataaggaaaaatgtgcccaaaagtagacctgttaaaactagaggcagttttgcaaggacatgagccctgtcactccctgttcctgggaatattcactcagaatctggaaaactctgtatcccagatattacagaaggggttcctgcatgaggtgaaaaggagacaaagaggtgatctttcaaaggtctttcagttttatgattcagggtatccaggtgcccagaggaatcattacagctggattatagactgagcagactgggtattgtattctggagataaggatctccttggaaagccacgtt

SEQ ID NO: 64616 - DNA, 1038 bp, Homo sapiens
catctcctttcaccatctgtttcattctaagaaagagcttaaaggggctttgtctagagaactgtctcttgtgtgttaggatgtgtttcatctttcagaaggtggacaaaaagcttcctgctaatgctagaaatatttgctgcaattccacactgacagttgaaccacagtaaagacaattcaggcaagaccagtttcagacacaggaactgtcaattttcgaacgtgtgcagcctttcttcagaagtgtgccctgcctgcgtccatttcaaacaagcgtagccatggattataattaaaattttacatatctctattggtttaagggtgataagtacactattgttataatccttggctctttgtgcatcggagtatgtattttattagggctattataggcctttcaaattaaaatgctcctggactttatatacgtatagatctttttcaaccaaaatgctctggaaattagtattagatggaattttattaaacttgtggaaagtcacattgcattttgcaaaagacacacaaaccttggtagcctgtttcaccaccacacagaaattctccacgtgatcaatctctctgctaggagtttggtgaaagcaagacccaagcagtggtgagattgagcctgtgtgctaaaactcagggtaacgtgaattgtagcaatgccatgagccactgcggaattggtttatagcaaacagacaagtcttgcaatgtagaaatcattgtagagtgtgttgaagcatctgctcagccaggatctacttctgccctgttttagcaaagtcactgctaaggtggggcctcgaggtctgtgagccaactcatgctggatgtgaattttgcacatatgtgagatgaggtccctagctttcactcgtttctccaaagaggttaataagaaagtttaggaatttctgatttcgataatggtctgtaaactggatttggttgtagttgtttttaaaatatatatgtgccatgctattgaaatattgcatatactctatagcgtgcaaaaac

SEQ ID NO: 64617 - DNA, 1029 bp, Homo sapiens
gagttctacaaaggaaagaggaaaagtactgagtgattagacctgattagacctcagcaaacgaaagaaaggcagatcactgtgtgaataagaaaattaataaccacagccaagcagctggggagaacagctcttccaggaaaagaccttaagggacgctggcctaccaggcagaacttgcctgtttgcagcagaatgtggctggggtatcttcagggttattaaaagtaactgataagaatggatgccttcagagcctgggagatagagactgtgtcagttggtgagtctggtatgttaccagccagcttctaagaaataataaatgaagatagtaaagtgtgcccttgatctcttgtcactctttagggttgccactcctgggctccaggtttttcctgatagtgatcagtgtctacttccagcagactagagccaggtgtctgagaagagaggatcaaaagggacaaatggagtggcttattacacatcataggctccagataacagacagataaaaggagctttggcatggaggtctccaaactggcagactgggaagaagaagaaatatggcaaggagggccaagactaggctaacagacagtcaaatggctcattgaactcctgccagttcctacatgcactgctgtcctctcagaacccatcaaaagttcccgaactccagcaagttgagagctttgatagtgtaaagatcagctctgggaaagttctaaatctctttcttggtgactgcaaagccacaccatcctcctcatccttttctttaccaacctgtgttttagcacacaacgggctgagccagttagatgctcctctcgaatgtcatcccaagatcacataaacgccattgagagcacaacgaggacagaaatcaggcttggtgtgacattagatcaggaggaggactttggaactacttggtaactttcttctaagccgttagaatacttactgaacttcagtgctttttattaatttaggcgataaggccatattacttcaaac

SEQ ID NO: 64618 - DNA, 1189 bp, Homo sapiens
atcattgtgcttgcctccctctttgtttaaagagtcagttgttatccttccaaaaagcaaaccttgtttagacctatatgagtaataagtgagcatcccctagggcctagcaccaactgaggtgcttgcaaagccactgcatctggatttctgacctttaagccagtccgccttccaggtatcattttccccatctgggaggctcagcaaaaagaaagcccaagagtgtggctcaggctcaggccaagctctgctattgctgagggaattctatcctttacttaagaagatcttagggatgcttgaagctgtgagtataatatttttctctgaaggacatttaactgttttattgccagaacccccagctgaggcttcagagtttcccctgtcatgttgatcacaccagttgaccttcagggtctgtcttccattgcctcctctaggagcagcctctgctgtaaacccctgtggctgttttgcgtctcagtaatgcagaaagaagaggctagccttgtgtgtttcagctgcagtcctgttattttcgctcgtccactgtgctctttgatttatcttcctcattaatctgtggcgctcagtactgtaaaattgcctgaaacgagatctgaagagagaccctgacattttgagggatgttgcaggattgtgtggaggagattaaatggggacagagggaaatgaggtggctgcatggctcagtgggctcaaacctccaacttgaggatttctattggtacctctttctttagctgaccctgaggtttggagagagagactcacaagcctacggtttctgtactggcaaaataaggcttgaaaaaaattctccctggccgcttatttgagttgcctggacattgcttgtgggcaacctatgagtatgcagtaattgaagccctagagaagatgtgaacagaaccacaggccattgtagtctgggtaggagtctgtcatgtcacctcctatggggtgcaaagtttgacactagaaggtgagtgcagggacgactttgggtgccctacacctaaccagaagctggtggagcactatgtggggagatgttggtgggcctccagggcccctccaacttgtggaagagttttgtggagagaataggttcatttttccattgtcagtgtggtagcaactcatgagagctctgggtaca

SEQ ID NO: 64619 - DNA, 1007 bp, Homo sapiens
cacctcagcctccagagtagttgggactacaggtatgcaccaccatgcccggctaatttttgtattttttgtagagacagggtttcaccatgtcatccagtctggtcttgaacttctggactccacggctttggcccctcaaaagtgttaggattacagacttgagccactgtgcccagcccatttttagtaagggctttattggtgtagtaaggactccataggactttctgaaacagaagaattaggtgattaagtaaaatggtggcactgctctctctaacagttttgaaaatgagactctgttcatatgcccaggatgtgtgaacagaatttttcctggaggtgcagggcaagtttgagaggacctttgagtggccttgaggctttgcctcatctctccacattgattgggttggcagtattttcactgaagaaactgatctgcttttctgtggagtgaaatgacaggttagaaaggctctcaaagtctaaatttagccagcacagtgtattcatgtgctgttttgcacccgggtcaccaggagaagatagatttgacaggttggctgggggacaaaagccagcccttgaagaaatcagttctcctttgaaaggtaagtcagactaattatttttctctatcaagcctggtgtgtgagctcattgatcagcagctgcaatgggagaatggagtggtggtactaggaggcacaactgccaccactatggggcttcagctgtaatcatcttccaagatcagccagtggtacagtaactgcctgctatccccgcacacactttagatcctttgctttatgatgctgttttggatttgtaaaaacattttatgttcacaaaaacaaaaaatatttttatagaagagaacgttatcatactttaccccttgtagaaatcttgtgagactggtcattgagagagccttgttttatagagcaaagttgcagaaaccaaatattgcagaactgtcagcctgtgtattttaa

SEQ ID NO: 64620 - DNA, 2011 bp, Homo sapiens
gctaccttatgacctatagagctgcccagggaagcacatttctgtttttaagccagacaaggggagaagaaaacaatgttcatgaccacctaccacatgccaagcatctagcagacattgtgtcattcaatttcattgcaaagccagggagattacattcaattttgaaaatcaccagtgggaaccaagagaggttaaataacttgattaaggttacacagctgataagaggcaaagctgggattggaacccaggttcactctaccaccatgccttcctgggtgggcttggcatctgagctcggaatggttttacctgttaattttaaatgtgacttcagctggatgaagggcgtactttgttgtggaggactcaccgaaatacacaggatgctagcagcacagcctgcctgggcttctcggattcagcttgtttctggaaggaagagggctgtgtattaagaagcagccctgctttggcagtaggacctagctgggagttctgtgatcttgaggctccggggctgctggattgatcaggctggagctttagtttgtacctggttcaggaagacttgatcccaagtgaaggtcaaatcaggaaaggccagtgaccttggagctggccttgggctgctgaggctgtgccctggaactctgggtctgcttcttaagacgctgaatgtatggagtcttggagggagaagatctacacccagcatattaatgctgaccaaagctattggcgctagctgttcacatgtgtgctggaggtgcctaattagctaaagctgagcttctcttgggctgtagaaatcttgacctgaggtcccttcgctttcctcttaccccaagaaagagagagcttaagggcaagtccttgacaaactgcaaaatgaggccagcctgtttttgggagatagccgcctcccttggctgccctggggcaactgtggttctgttttgtgcattcaggttcccacatccctaagatatattgggagcttagtggagggttggagggagggagactatgggggtattgaactcctgtcccattctacttagttttaagacagctggccaatgccctgtctgggatttgtcccccatcccctttcctttaatttctttgagatgttttaaaagtaacttgattgcattaaagtgtcctgtgtattttgaataacagttggaagttctgagttcttatatgaccatgatctatttagatgcatctttacctctgttcttaacattgagtcaatgtgattttaaaaagcttgggtttcagaatcaggcagatctgtattcaaatccagctctgtttgttagccctggcaccttgggcaggtcacatagcctctctaagcttcagtttccacatctatccaaagggggcattagtagtttgtgcctgataagaaagtggagaggtgtttatgggatggtgcttagcatggtacctggaacctattattaaaacttttcaccttgtataaatgtttactgttattttcatttgctataatatgctgaactctgttgatgtttaggggaaatatatcttctggtaaacagaaaactaggatgagtttgttgatatccttggcaaaagccagccagcagtggcccaagggtaagcagccctctccagaggagccttgaaggagagagggctttgtgtagctgaggtcagcagacacgctggtgcctagtgtaacaatgagggtctaaggcatccggagctttggtctgggctttctaacgcgaccaagctcctgaagccaaagggaaaaatttcatgcttactcaggggaccacctacttgtcaaggaatgagttaccaaaatgggacaaaggtgcggtggggtgaaactcaagcctgatggctgctaaatccccttggagccttttttatgcggtttgtgttttcctctctccacctcaaatcactggccttgcacctggcaccgtctgtagacgttgcttctcccctaggacactatcca

SEQ ID NO: 64621 - DNA, 1086 bp, Homo sapiens
aggactctgcaggagccctgcttcattctttgaaggtggattttcttaacaggccccagcaatagttagaggagatgatgctcccgagaaaacctcctggggaggaaatagttaacatacctgtttggtgggaaatgtaggtagccaaaccctttctcttccccaggggttactactaagcctacagttaggcttgctcactcatccacaccaaaggatctcgttccgctcgggccccggggtttcacgggaacaattgccttgaacaatagccagaaaacgagttccaccagtctggacttttttgcaactgaatgcagctgtctggcggggggcatgggccagccctgtaaatgggctgtgccttgattctggagcagaactggaaaattgagcaggtaagtcctggatgcagctggtcacagctgcgcagtgtgagcttagtcacctggaaagaggcagacagaggggcgggggctggcccagactgtttccaaggacagtaagggcctcctggaagcagacccagcctttggagtttggggaggattaggatccttgctttgtgaagactgcttttcagaaccgtagttagagaacctcatctctgctcaccggctgtggttttattagtaagtagagaggaactaatatatatctacaatctgattttttttacagcatcgtttagcatgtctttcccttgaataaacaacattatctcacagggagttcatttgaaaggtgtaatgatcctccctccagatccttcaataactcctcctcccggagtcttttgctgaaagcaagggtgtgtatatcctagtggaaaaatctgtttaatcatccctggaaccttgggattctattttgcttttttgcttcatgagagatgaaattgtaaatatcatatcacattaattcaggaccattacagattcttgcttcttttagatacctctctggaagagcttgatattaaaaatttgcctatattaaatatagtttctcaggggtcccagtgaagtctggtttactttctcagttctgtggaattctcactcctcacaacagtggagcaaaata

SEQ ID NO: 64622 - DNA, 2310 bp, Homo sapiens
ccacttcaggatggaatcaagcttggctctgctccctgttatcttttcctctgtggttatttttggtgcttggagctgctcagtctctcgggggcagatttatgctaccatttgaaatggcattcagcttttgaaatccttcagttttatcctgtttgttcatcaacagcttcttttccctccccttgtaattgtgcaagcagagcaggtgactgggtgcagacatggagtgtttagtaggatgctctttagacagctgggtaggtttgttgtcattgtggcaaacaccctcctcctggactgataggaaatcaagaaattaaaagtgttctcagagccctggatttctctgcagcagggataaatgtgtccagtttctgcatatagggaagaaagcgaggatcagcatggggaatgaaaaaaatgtatataacaacacctctcctttcttccaagctaacgttccttctcttgttttctacctgcctggacttctagccctctctcttcccctgctgctagccctaagttctgcagaagtactctgcccaggaaacaggacaggtaatgacattgcaggccggggaccaaccgagcctctaggttcttctgcccattcgttgtcaagccagatgtcttgtgcgaggctgttggcctaagccacctgcttgtgtttgtggctctagtgtactctgtgacacatggacatgccagtgagagtctgttcctctgtctgctaaagcccagggagaggtggagttgggctggcctcttcattcccattttgggaaggcgaccttaaaccctgccacttgatctggggcagcggaagctctcgcttgcatctcttgtggcctcctgtggcatgttcctgcttttcagcttccttcccattccttttgccacccccaaccccaagcccagaaatgacctgccacccactgtgtagcttggccctcacctttgtctacccctccccatgcagctgcctcttctccctttcaaaatcctttgctgaagtttggctcattatgtcttgcagactgttgtgttctgtgtgcccatttcctgcgatgataatgaaaaagaatgtgtagagtattaagactttacaaatgtacacgcttgtgtttgcccccagctgtaggtgggcctcagagatggatactgtccttaattttgtgggggagtgatgacctggccaaacataacaaacagatgttgtctcctgccagaaaaaaaaaaaaaaaaaaaccttcaccccatcaacagtgaaaactttgtttttgtcagctcacaaaccaagcctttaaaccgttggtctttagaaatccaagtgctttgacttcatcagccagcaagttgtaacatgccccacccaggactcagctcctagctatgcctgggccgcagaaattgagagggacctggaattcacttcgttacagatgaattccaaatatgcagactgctggcctcttgaaacctccaacaagtctgttctcccatttgaagtcattgccagtggcatttagggggtgggccagagttaggggtgcagggaagtgggcatccctctctctgagaagccgtgttggtgcagagagtgcccctgggcagtagaaggcacaggacctctgctttgaggtggagcaacccctgaattttgctttgaatctgtggaaaacgaggaacaattggggttaagggactcaggcctcctggtgacctggggtaaagtatgcgctggtgtcagctcaggctgaggattgggtttcttttgttttccacggatgtggatgtgttgcattgcacgcctagctggataaggcacttcctggtgatgtgcacctctttctccagggcccttcagtcccctccctagctttccctctctctgccttctgtgtgctgctctgaagttcttatttttgttttaactttcctacagtgacccgcaccttgataggaacactttgcctaagaaaggactcaggtatctgtgtttcctccttgcatctgtgccatctgttgtggctttggagcttggctgtgtgactccttcatggctggtgggggtttgggctgggctggggtccccgctttgaccaccacagcaggaccttttggatgacggctccccttgcaccctctcgttctcactctccatttgtcagcttatttgcttgagcaggggctgtgctttttcaggcttaatgtggtaaaaccatctcatgaaaaacatccctgggcaagcccaaggagcagtcattactgcttctggggccaatgggtttaatttctgagcac

SEQ ID NO: 64623 - DNA, 1017 bp, Homo sapiens
aattagatagcaagcattagacacatttagaaaaaggaaagattagtgctggctgaagttataggcagaggttatgtgaaggtggcagagtaggagctgagccttgaaggactgatagagggtgagaaatcttttctaatctcatctcactctttagagaggcaggcttttctgaatatagtgaataacaaattcagagtctttaaggatagaggtggcttgtaatcaagtgaggtttaacacttcatttctgattgactaaatgagtacctctgaaaatattgcacatgactcaaatggacaggattttcataagaaagctagttttagctgagacaaatgtaccttccttgcattgaaactctttatataccattattaaatgtcccccatctgaggcaatgggatctgtgttcatactgttctttcccagccataactctttgaggcaagagattcttgtcatgcacaaatgcttcccatctgatcaaaagcctgattggactattttgggcttttggctttagagaaaatcattccagatgagcctggggagtaattagctcatgcctggaaggtgatactggcctgtctgaacgtgccaagttggaaagctgaggcccagagccttgctttggagctgacctgcctttttactcttatttttagctcccggtgtgtaactcaaatgctgatgggactaccttttagaaaacagatgggagaagagttggcagaaacacatgtggctaaaaataagcagtcttctctttgtccccaaccaggatttgaacagagacatgaatgtctaaccttttgattctattccttttattccagcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatg

SEQ ID NO: 64624 - DNA, 1012 bp, Homo sapiens
cacagccttgctgttgctatttacaaagtgagaggagttaattattgagaaaaataattacctctaccttaagcctgccagatgtgctcttctctgcctgtggccccatgcttgtaccgagttgttgctaaaactgtgtcagtaaatgtatgtatatgagatgtagaaatagaaaagaaaaaacttccattttccattagccacaggccatatagcagccctgtgctagtctctggcaggccagtcatgcaagtgtgtgtggctatgtgttacacacatctcttcacccagcttggcctccaacataattcctccactattgtctgtgtcgtaagctgaattaacttacctctgtggaacattaggccacaaagttgggacattaaaggcctctgttaatgtgtggacatattaacactgaaagccattattggccattaacaccttaacctgattttttatgggcatgagtcagattagtcatggatgaagaaagcacggaggaaaagatctagaacgcagggcattgctaaggagggtggatgtacatgctgatatagggacagcttagagcattagggagctgctaagagagaagagggctggaatagcaagccaagagttacgtgggctcagagggaggaggaagccctcccaggtggcagtctgcgaaatgaggaaaggtcccatagagaagatgtcatttgagcagatctgttttgatagacagtatttagatgcagcctaaacgaagagaactgcatgggcagagactctgaggcaggaaagtactgtctagggcaagcttgggagagcagtgcagaattcatagtgtaacaagaacatataagggaagaaggagaggtcagggaaggtttattggaaagatgacagagaggaacctgagtgttaggctgagctacttatcagctatcttgttggcatatagcttctgctgactgctaatccaaggtgagttcacttcgtgggtggtagatgaatgccatttagt

SEQ ID NO: 64625 - DNA, 1017 bp, Homo sapiens
ttgtcatctttagattcgcaagctgcggcgggaactggatgcctcccaggagaaagtttcagctttgaccacccagctgacagcaaatgtaagtacagacatagggcagtagcatcgggacaggaagcaccatccttgccttctgaacagcctcaagtcctcctgtgctgaacaaatagaagtagcacattataaagaaaaagacacaggctttggcatcatgggtgtgaatgtcagtttggacacttactggctttgtgactttgggtaagttcttgaatctcagcctgcgtgtccttatctgtgtaacgagggtgatagtatttacatctcagtattggcccacagtcaatgcttgcaatatgcgaagtgcttattaaaatcttaatttctcttcctctttctgaaaattttgattttaagggtgggaaaaagaagcaaaaaggaaagaagggggaagaaaagaaatgtagggcttttcaatatctaggtagctgctctgtcattgtgatatacacgattatgagtttaggagatgctgccaaccagcattcaattcaacaactgtttgagtgccagctatgccccgggcactgtgggttcaacagcagagcaagcacagtgactgacatcttaacattcagtctctgggacagcagagaaacaaaacaaacaattttgctataacatgataactgttaagataaagggaggaggtggcagtgggaatatctagggggagcacctagctcactcttggtgggggatgaaaaaggggacagctcatctgatattgaaaataagaaaaaaattttttaaaagggggacaggaaggacttcctggaggaggtgacatctaatggatgctaggtaggggagaatgcatagggatgacagcattctaaccaaagagaataatttgcacaaaggttaaggagaaagatcttggtgtattttgaactctcagtaggtgggtgtaattagtgtctatggcttggatgtggaggagaggtaagg

SEQ ID NO: 64626 - DNA, 1047 bp, Homo sapiens
atcctctccaacctcccccaaaatttaaagcacagagaggtgactgacaagaaaaaagaagagaatgagaagcacaggaaggtgggaggcagccatttcagccagacagggaaaagctggaagaactggaattgtagaggactccccaacctgctattcccttcctttcagaagggaggaacatgcccccagtgcttttaaagatttgtgttcctactggaaacctcccctgtgtgtggtgtttattattagccatgttgtgtctgaaagtccgaagctttccctgtcactggctttctctgttaaaaaattgtcttttttcctcccccttccccatttttgcttgcgttttctctggcaggtcaatgaggtaagcaagaccaactttaatatcagataccaagctaacccatccattgatatgactaacctcatccgcatccatcaccgtgtctgagcatcctgctttgttgctgtgtaacctcatcttcccaacatccatctgctgagccagactctgtgttgctgttggcatctagtcttgaaccaagagtaggcatggaatgttacccacagatgcagtccctcaagctggcaacaccagataactcttcctcccttaatgcactgattcaaaagagctcttgggaacctcttccattggtggggggaaaaacatgggagaattaatcgcttttttgtgtgcatgtctctgttttgccaaggcctaagcattggttgcccccgctgtgagactgacagtcttgtatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctgtaagtctgtctgtctagtcagataacatctttggcccctgagaaccttctccagtaggaatggctaggagtcctgttatgacacatctgctccttgg

SEQ ID NO: 64627 - DNA, 1031 bp, Homo sapiens
agaaagagggagttacagctgccggccagcaaggtgggaggaaacctgggagcagagaggagaaactgttgctggagggagtaggaacggggccagatgctgctgggcggccaagtaagatgagcagagagaggcggtgatgcactcagctgtgcaggaccatggcagaactatcctccaagccactttccccagaggaatcgggtggggttggctcctggctccccagcccttttcttacattccacagcatccatgcacactggagatgtttgtttttggtctcgttttccaaagggtaggctgagagcaaatgcttgtttccaacctcgaagggtttgtaagaatgtgcaaatctagatgtgagagggagttcaaagacaaaaccataggcagaggagttgggcttaggaaattccccaatccgtgggcaaaaggaatggtagttgtggtaaggcaacgttttcccacactcgaggcattttaaaattaggtatgccaccagccctgactgtggacaagacagtggaaaaaggcttgaatcacagttaagggactgagtagggaaaaacacacataaggtgtcttcagtaagcagtttatgaagtggacaagcatgtattgagcgcctagtgggtatagttcaggaacacaggctctagagctgagcagacctgccaggtttgaatctgcctctatcatttttacatggtgcagtcttgggcctgcttgtgtccatgtctctgcctccccattttaaaactggagataattacagtacctcttcatggagtgagtaatgtacaaaggaaatggaataatatacttcaaatacctagcccatttgtttaggtattccataagcatttgttaggtacccattatgtaaatgtgatcagatgccagaaatgatgcagagaataaccctggtccctgaggagccagcagccaagcagaggtaacatgttaagttgaaatgaaattatcagcgatacagcataagtctagtcagggaaggaactaggggagaa

SEQ ID NO: 64628 - DNA, 1046 bp, Homo sapiens
ctgtccccatgtgcctaaggctgttgatgttttccattcgcagacatgttgctggatgacactggtgaatgctcggctcggaaggaaggaggcaggcatgttaagatagttgtcagctttcaggaggaaatgaagtggaaggaggttagttggatccctttccctgctttgcctgtccctcccccaggtagaactacctagcttagtgatctaattgtaaaacctctatcaccttggagcctaaggtgatttggaaatactactaacccttctcttaactaaccataatcccttgcagcattctgacacaagtaaagtgtgcgaacggcatttccctttctcgtgtgcttgaaagtctaataaagaatactaaaaatggtcccacgtttcactttcatgtaattaactaaacactaacatccattggaaagggcctttctgaatgtaatatactcccaaagcacttcagaggcagctatgcacattcagcatgtaaggtacagaaataaactgaccacatgcagccgaccaagagcaccagttttatcggtcatcagtcaccaagagtacacatcttggtagacatcaagggatggagatgccaagccctgggagcatgcaggtggctgaaaatagagctagtggggcgtcctgactccccaaggctggggaatccgagttttcctagtacggtttctgttcacttccaaagtctaggaacttccagagtctataccactgccagagactattttgggatgggggctagagctgatattgaaagttgaattttagccagtgattaaaacccagtgatgctttgaatgactgtttctcgaataaatgtaaaaaggcctcatgagtcaccatttcaagttcccttgagttttttgtttgttatttcttagtatttctagccaacatgctattgtagtttcagacagctagggaacccacagaacaaagcgtctgcagccagacctttcttaggggattcagctttgcggctggcttgctagcctcactatagggggtaagctcagcat

SEQ ID NO: 64629 - DNA, 1581 bp, Homo sapiens
ccacaattgtgcctttggactaaaagtgacagaaacagactcaaaagtagctgtaacaaaaaaggaaatgtatgggctcatggccttgggcaatccaggggtacacctcaagcacagctggatccaggtggtcagacagtgaatcaggaccaggcctgcctcagctttgcccatcggctgtgcttatttattgagctctttgtacctggttgatgaaatggcccctggtagcccaattccttcttctagcttaggaacctgaaggaaagaggggtttttgggaaaatgtaacagataattcctagggatgactctggcccactataggtcaaatgcccatcactgaattggtcattatgaccagggagaggatttgtccgagcctgggcaccagcccatccatttgggttggtggaagagctggaccagtggaggagaattggtggagttgctggattggttccacttgaaccaccaggaatgagctccccatgggaaagaagagttctaccatgaggggaagcaggaaggagtatcagacccactggaacaatcatcctcgacaagaaccctttaaggagagccttttatgtcctgagttcaaattgcatttcatccctcctgccaagcatgcgttgttcacttgctggttttacctgtgagcattacaaaggactgaggagtaaaaggaatggcctattgctgagaccaggccaagcctctctagaaagtaacaagattacctgcctctagtggagcgtgccacccctctgcagaccctgatccatcgctgctgtcagcacgtcaagttttagcacctcaagggatcagctcaggtttatttttcagtgacacctgactcttctctttcctagagtacttaaaacttatgccttcaagacactaaaaaccactcaaggatttgagctgaaagagttgcctgagctgcagtgattcacttcagtggtaccaggggaagggggtttgactttgcatttcctcaagtgagctcttgtgcaaaatagtcacttcctgtggggtttatggcagaagaccgaaacagagcagtacatatatatacagagagggtgttctagtggttttttcctgtgtttattattattattaaatttagagaccctacactccatactttgcattgaggtttgagcaagtgtacactacatcaagctcagtagcaggaaaatcttaggcttgtccctagcagataagacatctgggggcctttgtcatgttcattctggaagagtcattgtacacttagatatagatgcattggggggatctgctagcagtgactgagtacgtagaaggaatatgctattataaaacagtacatactcttcagtttactttttattaattttgctggtttcttgagagtaccttttaacaatgacctgaggttctggacagctaaccttggatggatcttctcttagagacagtatccaaaagataccccttttgaagccaacaaccctgattaatgacattgtcccagataggaaaggagaaggataagtttccacttgatgttgttgaggaccaagagtccca

SEQ ID NO: 64630 - DNA, 2262 bp, Homo sapiens
gcctgctctgagaccccagacaggtctcccgtctcttggccttgggttctccatctataaattgacaagtttggactagaagagtgttttttcaggctggtttctatgaagcccaaaagttccccagtctactcagttgaggaccagagatgaagagcaaatgtttgaaaaccatggtgccagataatctctgaggacatgttcagctccaggagttctagcctctgtgattctgcagccctgagcatgtcctcatccaggctgtagagtggagacagaagcagtagctgtcacagaagcagtagctgtgagggtttggttcagcctcatgtgaggtctggcttgggaaatgcagcccagtttccacagggaaagacctcagagggagaaacttctcaaaattgcacaaatggttctaatgtggagcagccttcttctgctccaaatatcccacttttgcattctcttctgccctgagacacatgcccacatacacacaaactcatgcccctcacacgattccttcctgctcacacaataattgcttttcaaatgccagactgagctcctaggcctgagactcactcctgccccaggttaaggaagacttagcaacagactgggccagagcgcaggacgggaggagtgctggtgtctgggaaggcaatgagtcataggaggctgcatgacttaagcagagggggtgatagccacgaatacagagagatgggcccatctgagaaggggcagggtgggcagcttccctgacagaaatcatagctagaggtcccagatggcacagacagtcatgggagtatgggcactgctggcagggacaatgagcccagcaggctgtcacactgatatctggccaacagcctgctccgcgtctccctgctctgggtctggctgagtcacgtggctcacatgactcagagttgttcaaggtggtgtcagtcaggaggggtggagaggaaaaaggcctggcaaaggaagctgaggttctaggttcaaatcgggctctgcctgacagcctttctcagcgggctctgctcttcaggccttgattggcccatctggtaaatgagggggtggggctaggtggccccagctccttccccttggaaagacgtggttttgttggttcagagctcagcttcacactgttgtcagcaccttgctctctgtaccctctccacggcaggattcgcgggagggcagggagagcagacagacagacagacagccgtggccaccctagagacacactgcagccgtggtggcccacaggactctttagtctctgtgctctaaggccccctgcagagtcctctctgcagaactacaggtgacactgccctggctgtgagcatgtcctgccacatggaccaagtgggccaaactagtgggccgtggaattgaacatacttagtttccaattctggcttctctcctccctgggcctatttcctcatctgtaaatcacggatattagtacttcctcttggagttgcacggtggttaagcaaggtattcgtaaagcatttctcacggtacctggcacaaagtcagctggaagatgtggtggtgttaaaggagaaaaatataaagcctatacctagctgtgtaatatacagagcctcgtgttgggccagtctaggtttctgttcttcaaagaatgtatgtatttcttgaaattgctagtaatggtcactaaaatcattttaccattagataattgaggcttaagaaaaggagcttggaggcatggtgttgatcttaccataaaattaagtgataatatagtttactgttttaagagccaattagctattatggaattttgagaaatacatgacaagagagaagccctcataatttcactgcctatgtgcaacctctgttagcaatttgctgttttgaaaaggagtagcacttctatataggggctgtaagagtcagacccatttcaagaaacggggttttattgagccaggaccagcccagcacagtggctcacacctataatcccagacctttgggagaccaaggcacgaggattgtttgagcccagaagttcaagaccagcctgggcaatatagagagatcccatctcttaaaaaaaaatgttttaaaaattagccagacatggtggcacacaagtagtctcagctacttgggaggctgaggcaggagcatcacttgagcccgggagattgaggccacagggagcatgatcatgccactatactccagcctgag

SEQ ID NO: 64631 - DNA, 1625 bp, Homo sapiens
aaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcc

SEQ ID NO: 64632 - DNA, 1037 bp, Homo sapiens
ggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtggtgggtatttcagctgggactcaaatggacccccaggattctgcgaggtgaacatatttcatgcctaaaggctgaatactgccctgccagtggtgggggtagtgagaggccatcaaaacttggccaagattggtctgtgagagtccctcccagaagtctgactcctggattgtagcccaggtgtgcctccctcccgctcattgtgtggtcttgggcaaagcccttctctccatctgcaaccctataaagctgggtctgggttgtaatgggggtgggggctggtgagacagaagagcactgttttcagggtcatacaagctgtattctagaggcagccctggtgaccttgagaattttctcagccactttgctgattttgtcaacctgcgcacttcacactaatattgtcagggattct

SEQ ID NO: 64633 - DNA, 1020 bp, Homo sapiens
taagtaggacttttcacttaaggaaaaagactgtagtatcaataatttgctcaaggtcacaaagctgtggtgtgcttatttccaaactcacattcttgccacttaaaattctgcctgttagtcttgggaagctttggctcctgtcctaggcaagtaggcatgaaagaggcccggttggcattggccggtgttactttaatacattttccagtgttccctgtatctgggcatggtgctgagtggtggtgcgttagtgttctcatctgtagccccattgggtagatagaatgcctgtatatattctagttgtcataaaatatttattgagcaccagtggtaccgtggctgtgatagcctccataaatagtcgacataacctatctcggtaaacatttgtggaaaactaatgctccacatgtgttaggaatatagataaggtatacagcttctctgctgtgtattcctgtctttaagtagccttcagatttgcatgtcacataataaagaggattgatcctcacagtgtctgtgatgcaagtacgttgggaatactacaagatcacttttgaaataaggcacttggggagtatgccagctgtaaaattacattttatgctttatttctaaaagcagtttgagctgtgccagttcaaagcctctgaaagcagagttgacacttagaggagaaaagaatctcaagtagagaaattgtatgacttgagagaaacagactctatcaaagggaactctcttaaaagccttttgataaaatcagtgatattatttgacaaataaattcactttgacatttaaaggataattggttttaggtataaaatgggactcagaagtactaattccctttaaaagtgctggattcccttcctttcagatacaagtgtgtttgttttttcttaattggaagtaaaactagaaaccagcagagttaaaaaaaaaaaaaaagtgtatatgtaacatgaaatcagtatttagacttcttaggggactattccatgaagc

SEQ ID NO: 64634 - DNA, 1994 bp, Homo sapiens
gtgctggggttacaggcatgagccactgtgcccagccttaatgtttttaatgttgcatttctaaagtattagaatcatacttaagatagaattttgttttgttttttttttacttaccgatatagggggtttgtatactattaaagttttctcataacaagagttttatgacaaataattggttggttggatgtattactgctttcctttgttttaaatgctgcttcatttctggaaagatacgagaaccagataacaagccttattgggcttgcatcatttaacttcatgtaaaagctagtatacaccatgtcctggcaaaattataatttgatacacaccataaaaattagggatttaatactttcagctctgatatcagttgccaaatacttggtaaaatgtggatcttaattttccagatttgtattgttctgacaaaggaggagtagaattttagaaatcagttttccatctttttagaaatactagaaaagctttaatttgtcatttatggctgcttctcaagatattcagaagtatcattgtattactacttctaattcttaataaaattcaaaatataagtagtaatttagaggtcagaattattttattgtttaatcagagaaggctttatagaataggtcagttaaacaaaactcattatgttaacataggtgaattatctttttccccctttaggacttgaattttatggatacattaagctaataaattttattagacttaaggtaagttgacagcttaatttataatttcgtttagaaatcaaagaaatgctacagtgactgtcagtgtactgattatttaaaagaatatgaggaactgcattaaatttggtactcatcatattgggggaatcacggacattaggaggtagcacagcagaaagcaccatgtaaatgtctaccataactaacaaatattgttttcactgcatctaagagatgaatcggtgtatgtgaaaaagtaattcagtgtcaaataaagggaaatactgatggacaggatctgtaaaatcagaaataatttctaatgtgattttaagtattttggttgctcttttttattctgttttttttcagatactttgtttttttttttttttgtcctgtttaaatgaatgtttaatgacatgacaacgctttccccaaatccaaacagtaaaaaaaactctgcgttgaaactgctggttaagcagtcgtccagcaagttaatgaaatgacaggcacgtagactttttggagacatactgactttgtgtaatgcaaacatgatttcctttttgtttaatttctgtagtttttactaaggggattttgtgattatatgtaatgaaaaaaacatgagattaattttatatccagaatcctacagttgagtacatgaattccatatacaacccagtgccttgggagaaagaagagtatttgaagccagtattagaagatgaccttttacttcaatttggtaagatgaacataagtgtatctcctttaattaacataaggccgtttgttaacggcaaaatggaggtagagtgttttaggaaaagacatgctttttaaaattatctaaatgcttcatcaggtagttagtttcagtagaaaagttaagttgcttaaaaactaatagtcggccaggtgtggcggctcacgcctgtaatcccaacactttgggaggctaaaagggcagatcacgaggtcaggagatccagaccatcatggctaacacagtgaaaccccatctctactaaaaatacaaaaaattagccgggcatggtggcgggcttctgtagtcccatctactcgggaggttgaggcaggagaatcacttgaacctggtatacaggtgacagagcaagactctgtctaaaaaaactaaaaactctgtgatcaaaagattgtctggttttgcctttaattgcttcatgtattttggagctcttatgtgaggtttatacacattta

SEQ ID NO: 64635 - DNA, 2953 bp, Homo sapiens
tatgttcagtttagccaactaatgaaaaacttagactaacagcatgctctttgaattcaaattaaaatagtgtagatgataaatatttattattattattattacttttaagaccgagtctcactgtattgcccaggttggagtacagtggtgcgatcacagctcactgcaacctccgcttccgaggttcaagcaattcttctgcctcagcctcccaggtagctgggactaaaggctcgcatcaccagacctggctaactttttgtatttttttttttttagtagagataaggtttcaccaaattggccaggctggtcttgaactgttggcctcaagtgatctgcctgcctcggccttccaaagtgctgggattacaggcaagagccactgtgcaaagccaagatgattaatattcaattaaaagtactttcactaatctttctcaattggccacatagtagaaacttagggcgtatttattcctaacatatttatacttgttttattgttataagatggcctgataataatgtccatttatttctttagatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaagtaatttatcaatcttgcaaaattaattgttttagatctccagaataatacaacctaatggcaaagtagaatatagtagaacatttcatatactggaaagtacaatgtagatattttatcttcatactgttaaagatatgtagcatttttgtacactatggatatagttaattaatataaaatcttatagttttacctattctgatatgttctgacaaatgttgtcctcatgaatgtttttgttctttattgccttcctttcagttttcctgtttgcattgatttctccattttactttttctatcctagttttttaaagtggaaggattaatctttttgaggtttggggaaaatacagggttgaagtttttagttttaaagaatcaaaatgtaggccgggtgcggtggctcacacctgtaatctcagcactttgggaggccgaggcaggaggatcatgaggtcaggagtttgagaccagcctggccaacatggtgaaaccctgtctctactaaaaatacaaaaattagccgggttgtggtggtgcacgcctgtaatcccagctacctgggaggctgagacaggagaattgcttgaatccgggaaggggaggttgcagtgagctgagatcgcaccactgtactccagcctgggcaacagagcaagactttgtcggggtggggtcggtgggggggaatcagaatgtaattatggtgtagtatgaacccagaaaaccagatatacagtgacagttttttccagtgaataaattagcattctactggtgtagtacttttcaaagtttaatgtgcataggaatcaactgggatcgtgttaaaatataaattctgattcagaagattgagaatagggcctgagattctgcatttctgacaagtatacctcacaggccttcctgttggatttgtaagctgtttgctgttgcctgagtacccatctgatggtttgccagaatgaatgtccagcaggaaagatagtagagccaattgtagttcctcttccctgtttcagaatttttatgctaggtaaccaagtaaccaacaccagctctaccttttgcccctttgaacttctcccttttatataccttatggattcctaatatgtcatgatctgagagggatctaagttttagagctggagtgggcggtgctggtgtatgtaaataattatctatttgggtctactttctgcttacataatactcccaagaaataatatggttttaaagaatattaatagagctgaaataaacgacattgattcatttgctaaaaaaggattttaaaacaatagaaataatagaggattataaaagtaatatgcttatttgttcagttgaaagacataaggagctacaatctgcggttggcattgcttttgtggtttgtagaaggagtatgtataattgtttctgaatattgccattgcttcagatccagcagggggagctttcagttgttcaagatagaatgtgatttagaagactcatcacactgtactccctcccctttcctcttcctcaacctctagcctttcctttattcatggtccaataaacctgtctcaagggtgtatttcaaattgattacagacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggttagaaaagaacacaaatgcgtcaaatccatactaaaggaaaaatagaacaggttctttcttaatatatgtgtgcactataggagacctcttttttttgggtggggagaactgctttttaaacacctctttggtgcttggtatctcatcttgggttgaaaatattacaagactgggcacggtggcacatgcctgtaataccagcactttgggagcccgaggcaggaggattgcttgagcccaggagtttgacaccagcctgggcaatacagtgagaccctgtctctatttaaaaaaaaaaaaaaaaaaaaagattacagaggcatcagtcatttgtacattccatttaaaatcattaatctttttatgaaatcactttttccttaaaatattggaaaaacgacaattttagtcttctcaagggcagctattaaataggaacaattagatggattaaattatatattaccttttaacgtgtaaa

SEQ ID NO: 64636 - DNA, 1932 bp, Homo sapiens
attttgttgattcagttttgctggatcacagaatagaagtttggtaattgataattgtacttatatggggtcttttaaaacattgtcatgtcattactaattgcatgtcatggttgtgctttttgttgtcacgtaggtaatggcataacattataaataatagatatgttattataagtaatacgttattttaagtctcagtgaatttgttgaaaagaaattgacttgcttcattttctttattaaaattaatttttttatgtttagagtattttctttaaagaggtttatctagggccatgtttgtcatattaaatcaccccatcagcttaaataccataaacctttcattcctttggtatggaaattgtgttgggcttttcagacagattaaaggtcaccgaaactttcagtagagtgttgagtgttgtgagtacaatcatcagggaaattcagtttgagtacttaccatttacaaatctttatcctggacacttgtatgtcagtaaccataagacttcacacctgctctggtacgtttaactcctttcaatgtacatatagatttaagaagttccaacttgaagtttccagtgccaccttctccctttgagagaatcacttaaatatcattctttgtgccttagcttcctttagttcttgtgcagtgtaatttcctccccttggaaatgatttgattaaatgtctataggacatatggatagttgattcaaaaagaactgtttattcatttgcattttgccaagttacgtgccttggatgaatgtgaagcatgccttatatcacagctttatttcttgtttcttagaacgattcttagcacacataaactgttcaaggtatattaccactagaatcttacctaatttttataaatcatttaaaattgagaaatcatatttacaggacatatttttatgcttggcattggccttgtttttatagagtataatttggattttttgttgcttggcttcatgtctttccatgacactatttttggtacatgttttaattataattttaaataaaagtagcttgtgatcttatttctttagataagatgaagataccttttttgaattccagagatatgattgatagagggatagattacatgaactttcagaattccttgccactttatctttttgaagaagagtcatcattggctaacactataaatccgaaatgcatcggtcttctttgttttaagataaacattattcattctgttgtacatttatcacagatcatagtaccatttagtaaagtgaaatttcagtaatttttctttgctgcattctctttattgtatctgcacctgtctcatgcacttggtccacctttatgagcttgtaaattaaaaacatactgttgcttgtgtatgtaaaatttgtagtatataacttttttctttaccttcattcttttttttatatttgtaggaataatttcttgatactttactagtcttaaaatattatcttgctcctaagtattggagcagtaattttgttattttatttttcttagtttcaaggttgatataaaaaaaatttttaaatttctgtttattgttgatttgtattgacgtgttagcctttgttagaataaatttttagaaatggttataaaggctactcttttatttgcttgcgttttcgtatttattggattttttttttttccaaaaattaagtgactgaattgaagctctgctatatacaagacactatgttttgtatactttggatttcattacaccagcatgagcatacaaacaaaaacagatttatatattgtaagagccagaatgaaagattgtagtttagttgagcagcagtgcatggcattaggatagcagttggaattcttttgattaaggggaagtagtggtcaggcagtatg

SEQ ID NO: 64637 - DNA, 1004 bp, Homo sapiens
tattagctttaattatcactctaagtcttatggtgataatgcacgtcaagaggaaaatgtacgcatttttaagaacttgggtcttatttgagtttcagtcttcataaaatattttctttgtgtgttgttgctatttctattctttattgttttcttaggaaaaaaataagcttggtatcccaggtataaaaactgctatggaaactagcaatgtgtgttaatatggcaaatatctcccttaaaaaatttatttgtttagactgtcctataaacacagcgttttcctctctccaccctaggacaaaatacgaacagaaagctaccgagatttcatataccaaaatccacatatcttcaaagacaaggtaagtagtataggttatagaattatacatttcatcttgttcttgggcagtagaaatcctctcttggctcatcattgtgatagcaattgatttaacatcttctgtctgtatttcatggaagacatttatgatgctgctctgtggtgcagagtaccaataacaaatgctgattgctgctgtcattcagtatgctcttttttaaaattgaaagttattacaatggcgtaacttagttataatgacatagcttagttaaattttgcttattcagataattttgcttaaaccatattttttgtttacagttattcccatgaattttaaatgtatcagataagcaccatgtcatagcatacttttaattattactctagtttgtgttaagtaattgagaattaatgagtttaagaacaataagggttcactatggtagtatagtatttagtttatatgctttattttaatactttatttaccccatttagagatactttgtattttacaattaattttaatattggctcaagttatttaaaaaatgatcttataccctgtgtgtgcatgtgcctgtgtgttagaaatttgtgttttttggcttttcttccttacacttttttttttctttattctctttttccc

SEQ ID NO: 64638 - DNA, 1073 bp, Homo sapiens
tgctggagtgcactggcgcgatctccgttcactgcaacctccgcctcctgggttcaagcgattctcctgcgtcagcctctggagtagctgggactacaggcacgtgccaccacgcccagctaatttttgtatttttaatagagacggggtttcaccatgttggtcaggatggccttgatttcttgaccttgtgatccgcccgcctcggcctcccaaagtgctgggattacagacgtgagccaccacgccggcccttcatagtttttgtatttgcaaaacaagtgctggaaagcttatttaatgtttgtctaaaaaccactctgtttccagtgaagcaaattatgttgctgttaatgatgttgctttatatttctagttggatgatgcccagatttttattttattttttccttaatatgttatatagagatgaaacatgagaatcactaatcctggctagtctggaaccagttatatacttttgggcaagtggtgaatctctttgggcctaacctgtaaggtgattgtaaaaattccttctggttctaaaattctgtgggttttattacggtgagagcattatcattgtttttcttttagccatcttctcttaatacttggtgataggaataccagaggagcttgttaagaaagtaagttagaatgttccttcagtatgcttctgaatggacttgtcttataataggtaagtaaatactgaaaaggctcaagtattagtaatcataagattaatcatcaagatattaaatatttttattaaaaatgttttctttccttttttccttcccttctctctccatcccttcccagcctccttttcttccttcttttcttaatattatttcaattcacaaagctcctgtggaggccatatggtttctcagattaatttaactttgggtggtatttaatcgtgttgtcacccactcataattaatttctgtttgtagtttattgaagaaattcccagttaggtgccttctttatgcttgtgattattatctacagttaaaattcattcagttttttaagaaaaaaaatgaatcaaattt

SEQ ID NO: 64639 - DNA, 1036 bp, Homo sapiens
tatctctcttctggagtcaatactaataaattataatttcaatacgtaatggaaagagccgggcatggtgactcctgcctgtaatcccagcactttgggaggccaaaggattacaggcgtgagccaccgcgcctggccagtttcagatttttattgtgatcttttcctagccagaaacatcataatatatgaatagaatttaatatagagacctttttgataacatctgttttgttttggttttttcttaattaccctaggtagttttggatgttgggtgtggaactggaattctctctatgtttgctgctaaagctggggcgaagaaggttcttggagttgatcaatctgaaatactttaccaggcaatggatattataaggtacatatattttaagccttcatttaagattattttaaaatttaatgattatttaatagattttcttgtctttagtagctatctaaggcagactaaagacatttgtcttttagtaaaaattcactccagaataataagattttaagttgaattgagctagacacatttgagctatgctgctgaataatcttttcacagttctcattgatgagaattatttttatattgatttctggctttctgactatggctataaatatgccaattctaataatataaaattaaaaactattgatacttagagtaatactgacagaggactccctacttactaatatatttattatatattagtaatattttctttagcaaataccagttatactaaagactaagagttatttgtcttttccttttgtaacaacactagtccatgtacctccttcaaattaagtaaattccaaagttgctgaaaacaaggcagagtggatttagtttattaccccctaaaacttttattctctaaaaatctctgtcttttgagtatttagctgggttgattgattttacagttggcttataccctagtgagaaggcctttatttgaaatccagctgacacaactgaatttctttccctacgtgcttaacaaaa

SEQ ID NO: 64640 - DNA, 1006 bp, Homo sapiens
cttacctcatgctagatggccatgtttaagattcattatagacattatttttgccaatcattactagagtcatggtcatcagagcagagggaagcatttgttcaccagatccattttgcaaaaatatgaatttttaaaaatctgttcacaaaactgttgaacagctatgtagtctgaaccccccccccacctttgttttgaagtatcagagagttccttaaaaggatttttgaaattttcagccatacatgacagtagagagaatgatatgaattcctgtgtgcctatcacccgcgtctacatttatcaatttttcacgattttttttatacatttccctcccaccttttttgttttgtttttgtttttgttggagtattttaaagtgaaacttatacattatatcagtaaatgtgtcctaatacatttgagtgttggtgcatgagaacatttattgaaaatgacttagcactcaatctttagatatcccagtttaataataaaattgctaacattaatttagttttttctattgaatctcctttggtgcaggtgtaactgaatctcctttgatgtagattatttatacctattataagagattaagaggctgggcatggtggcatgtgcctgaggcaggagaatcacttgagactaggagttggaggctgctagtgtgctaggattgagcctgggcaacatagtgagactctgtttctatagtggggtcagaattagttaccaggcagcctgactccatagcttatcctcatagccagtttgcaattccttatctccattgaactacttacaaggtatgtattggttgtattcagtagtttgctttacttaaaacctatggatgtttgaaaagcaggcctttttgttttggataagccaacattgtactgtttcttcagaaatgttctttgccttttttatattgtgaaaaggtagttatttttatagtgttcttatgtgtctctcctttgtcttccatttgaaa

SEQ ID NO: 64641 - DNA, 2838 bp, Homo sapiens
ctcatctatccatgatgtttctcatgtcttactttacattcttagatctctcacctgaattaatgcatctgcacttaactggaccagttgtttgtactttgtctttgcctcccaccactctctgtcatctgttctctgtagtgcagccagactgatttccccacttaattctcctctattttaaataaagaggaagaaggggtggggggaagatatgtttgtcttgggaagacataaaagagggtaaattacatatgattctactatcagagactactatcaacattttggtatatttcttgccactctcaaaagccttaggtcacagagatgaaattcataggaatgtaaactttactaaaatatcagctccccgtggtgtggcaggaatttttctttttttcattctttaatgtgtcccaactaccaggaaggggacccagcacatcctaggcattcagtgtaagtacttattcaatgaatgaattaatcaattttcaagatttgggacattacatattcaaagccaggtaaatcattgtcaccaaagcctgcaaacccattgtttctgatagattccagatgactatttttatattttttcactttattagaactgagttattgctaatttcgaacaataaatgtcctcagtgttagtaattccacagctacacatttgtaaataaagatgatacatttgggagggagcagctcatagaatagcccgttatggttccaggtctatgccccataccttcttggtagttcgtttctcatgggatgtgtgtaaatctacccccagcttcataatgtttaagaattcttgctttttgttgacatttatgaatgaaggactggatactttaataaagataactggcataggttttgtctctgaggggaaagggtggagactggtcagtttacagttacccccgtaatgttttagtccctttatcactcccactttgtaaacctcttgactccaatggtttgcgttgtgaagaatggctccacctccactgtcatgctcgctgacgtgtgcactgagtactgggtctttcttcacaggtttaccaatataatttcattcccttttttctctcactgaattatgagattctttggctctttgatattcccttccaaaatctccatgcatttatcagtgtcttacattttacgttattgtcatttcactgttcttagggagcaaaagagaaataaatatgtatacttcgatgacatattgaactgaaagtaaatgaatagtatatattgtatctatttatatctattaggatattcctttcttctcccccataagctatcatccatatattctaggtgaactttaaatttgttttatcactaactttaaatgcactcgattaggtgttcattgtatgaactcacatgtactttatgctgtttgcttgtctgtctccccactagaccatcttcttcttagaacatagaccgtatcttttacctaaatcacatagggaaaatgtagattgaaaatttaatcctatattttttattccaaagatcctgaaatgactcttcattatctttaagtaaaatatagacttgaagataagtcatagcattacctctaaatatcccccaactatgtcactgtatactatctcttgttgctctagtcatactaaactgttcagttatttaaatttgcttctctctctctctctgtcacacacacacacacacacacacaggaggcagttgtgcacagacacaaccctcttctactcccatacctgtacacatctttgtgtatgctgtgtcctttcctggctaagctcagatgtcacttagataaggatttatcatttgagcttccatagtccccaatcctgtttactgttctgtctctcttagaccatacccgtaagtgcatggactgtgtcttttatctctgtatgcttcgtgcaagataattaatcatgatgatgtccctgtatcatgaagtgaaagttaaattgctacttttaagataggaaataagataggaaagtatgtgttctaacaaaatttcccctcagaaaaagttgataatttcatttttattggattagtgaagagaattacttaaagatatcctttttattacctcgtcatagttctctacattagaatcatgctagtttttcagtaggtgtttccaaagataaagattcatttggtttatactgaagtagggtttagtgagtagccacttgagaaaactaagtaaaatctgtatatttttttcacgaatggaaaaaatcaggtggtgattaacagtctcatgaaagaggttttctgtgtcagtgatatctgttttaatacaaaattaatgggaattacaaggctttgtcttttttcctgtgttttcccttaagtcataatctttcttgttatagtcatatttgaacaaataatttctgatacaaataggtttataacttgtagcagacaataaacaggcctagcagatggtcttttacagaacacagatcttgtttcggcataaccattctgaagatatttttaagcaatgggaacatttttctcttttaaaagaagcttgccttcagttttctttgaagtgtttgtcattgttaaagccttaatcagtattttggtaagcaacaagcaactatagcaatttcatcagaattttattaaatacccttttgaaaaaaaaaactcataaacatttctgtaaaactttttgtatgaaatatgtaaaatgagtacataaaacatcaataaacatgtttaatatgcataagtatccataaataacaaatgaaattaaacatgtag

SEQ ID NO: 64642 - DNA, 1010 bp, Homo sapiens
taatgaatttttttcacccaccatgggggattgggaatattgttttagaaactgtttttgtgggtctggaataagacccacacgtgccttgggaaagatttttagagattcactttttcctttgatagacttgcttattgggcggttttctgcagtctgaggaatagggccaatttgactgtcagtcttttgttgattaagtgagagtgccatccagtgggagaaaaagctaatacaagttttttaaactttagaatatgcagaggaaattatttcttgtgctaagttatgttctccagaagtccacaatactaaaaagttgggaactgtatgttggaaggtgagagaagtggaagaaagtagtcttgcagaacagtagcacgcatataatagggacctaataagtagccgttattaccatgattcttcttcttgcgtggaagttggtgatcaagttaaataataggtaaattaggagcttctctgacagatatttgtgattaatacatgtaaaattctattgtcattttttgactatgtgatatacagatattataaattttatccttttttgtctttaaccctattactcaggacccacccctggtccccaaaaaaatgttaccagtttctagtatatctgtcttaaaatattacactctattataaacatgtatgtatatttcttggcatactcattcatttaacaaatagtgtggctactatgtacctggcactcttctaggcgggataaagcagtgaacctcatgttcagtgtaaggtatgcatattctacatattgttctgtaccttgcttttttcgtcaataagtttccctctaatgactgttatagctgcatcccacaaatttattcaattcaaaatacacccttgtgatttctgctttggtccatggattatttagaagcatgtttaatttctaagtgttaagaaattttaaaaatgtctttctgttattaatttctaatttaatttggttgtgataagag

SEQ ID NO: 64643 - DNA, 1019 bp, Homo sapiens
aggcttgtgtatttgttgcaggtaatctttaagtatttcagattattgagtctttgtcatcatccttcagattaactcttccattatatttgtaactctaccttgtcttaccttttttttaatagttaaattttgcctagagatgtatcagtaattcagttatttgaactaaaaaaagttagaaaggcaccttatactgaaggtatcaaaagtttcatttatcactaatgtatctaatccaagaagatatgaacagccattttaaagacaagattcccacttcaatgaatgaagttaatattctagtccctgatttaattccatatgttcctttatagtaatcattaaagtataaatgcagtatttaattttttaaaagtagatgtcactgttggaagaagaatgcccatgagcatcatgggagaaaatatcaggcgtaattctccttccagatggcacccctacaggtgaggcagcagcctgtgaaattacagtctgaattacactgcagatgagcggggcatttggaccagagccttctgatatcagtaataaatgacttggttcagaaccaaggacaattcccaggaatttaaaggctgttgtatcacatagggagcctatcgtaaaatgaagtttagcaaagtggaaagttgagagaaaggacaatgaccattagcaatacgtatgtgaatcttttcatctgctaatatttttaactggatattttatctcatgaatgtcttattagttctatatatatgctagtatttgcattgatttttccaaactaatattttcacaatgaatagtggctaagggccagttgccaactgagatattactctgaaatgattgcacacctgttgtaaattctaatcttgtttaatatggtctatggaaaatttttcatttttgcaatgcttgaatccttaacaaatgtagtataatacacatactaaatcttattttcaattagacaaatcaatttaagaggcaacataaaagggtgattcaga

SEQ ID NO: 64644 - DNA, 1051 bp, Homo sapiens
gtagtcagaaagtgggtaatacttggttaaaatatgttcagcagttctctttaccatgagaactactcagaacttttagtgtgctcatgcacattatgaatctctaataggaggatatggcagctggcgtttcttaaacctttttgactaaggatccctccactttcttttttgtttttttttttaataccaaaaagaaagtcactagacaggaaattatttgggaagtggttttctagactagagtttctcaaccttagtgctattgacattttgggccaggccattctttcttgtaagaagctgtcctgtgcattgaaggatgtttaccaacataccttggctctacacagtagatgccagtagcatctcgttcatcccccacccccagttgcaacaatcaaaaattactcagacattgccacgtgttccccagcaggcaaaatcaagtggagaaccactgctctagatggatattgcatcattccagggagttatagggcttgttaataatgtctatccaaacattttttaatgaggaagaaagagtagtctggaaagtagaatcatagataaagaaaatgcagtatattttaccacaataaactttctgggttcactttataagctggcctgattttccaataacttactgcaaaaaaaagtttcagattttgcagaatattattacatctgtggcagaaaaaaaaatattctgtaattaaaagagtagcaccgatgtttaaattgacctgcttatgagagtattgcacatttctaaactctttttttcccctttttttatgcagggctattttcttctgtttgagtctatgttagattctgtcctttatgcaaagaacaaatacttggcaaaaggaggctcgggtgagtataaaattctggttttaataatctaattttagtctagcagaaccagatgaacctttggatttcaaataaactatgcatggctgaggaagttcccgatagggttgaaagatgtttgcattacaagaagctttaagacatttgtttactatattgttga

SEQ ID NO: 64645 - DNA, 1046 bp, Homo sapiens
atgttactagacataatcctcacaagagccctttgagattttacagtctcctaaaagtgtcctggatgacacatattaaatggctaaaccatgattttttttaaactcacatctgccagcctccagtattcatgttctttttactaagccttgttttcctactaaaatgtattttttaaatgtgattattgccttgacgttctagggaagatccaagtaactgtttccagacctgcctgacttgatcttattgaggaactgacagcaacttaatacatttaaattgaattctcactgaaattcattaagaacttacagcaatgtgaacaatggcagagctatttcttatcatcagagggataaagtggaggttcatatatctagctctttctatacttttatatagctaatattagtattaagataatacaggggtatatttaagagaggtcagcatttaactccttaagcagtgctgttgaatcttatttgttaacagaatcaagagaaagaaagttcagaaaagagtaacaaaaaatagtctatttgtgtttttgagtatgtcttgatgcgtatcaccagtcatttagatgctcattgttttatcacaaagcaaagttttcctttctgtttttctgaaggaaagatttaccaagtaattagtagtaaaaaggtgatagaaagaatgaatgcagtatgagagagggaaaatattgaaggcccatacaaacgtgatgggaccacaatttatttttacatgagtttaagttcaatttatgtctcaccatacatattatggtgagcagtaaaggctttataaagcacaggcaataactgggatgttcatctaccccattatcaatcaagcaattccactgtgttttagagttatatatttactatcttacttctaagaaaactaattttgtaaagttcatgaaagcaggtttactagcaacgatttctactatttctagctaatatttactaagcactaattgtgtatcaggaattgtaatgttttacatgcagccaacaagagatga

SEQ ID NO: 64646 - DNA, 1058 bp, Homo sapiens
ttgtcttttttatttttattttttaatggagtctgtccctgtcacccaggctggagtgcagtggcacgatcttggctcactgcaacctttgccttctgggtgtaagcaattctcctgcctcagcctctcgactagctggaattagaggcgccctgccaccacgtccagctaattctttgtatttttagtagaagtggggtttcagcatggtggccaggctggtcttgatctcttgaccttgcttgcttgctttcctttttggtgtttttgttttgtttttgccttgtcatctcattcctttgctcagagcaaaataagcttaaatgttaccattttccttactttgtcctgaaattttatttatctccactcttttcaaccccctttctccttccttctcttccaacaagtaccgtttaccttaggaacctggggttcctctttccgtttcttccatttgaaaagcattaaaatgtggcatcatgcataatggaaagcatatggatttcacaattagaccttaagttgaatctctgctgtgtcagctgactagttatctggttagctgaagaagaccaggtatttatttgggcaagttactttctgcccaagttactctctgaatttaagtttaatttataacatgaagattataatccaactttgtaaaattattcaaaagtctaaatgaggtgcttgacacaaagtagttgctcaataaatgttaattcccagtcagagttacaactggtgaacatgagattagcagtaggtttatactttataaaagttatgaaatgaatttaagcattgtggtattaacacttaccttttatacagcacttcacattttctacacttttacatagattatctcaatataatcagccactggcattggttcatagtgcttaaaggattcctttagtattttcataactgtctacttcctcatcttcagatctgcatttttcacatttattagtttgagtttgttcagtaatagagcagtagtgtcattttttatttttcagcatataatttttcaaagcatatta

SEQ ID NO: 64647 - DNA, 1053 bp, Homo sapiens
gcaatataaaaactgtgcttttctgtatttttgtgaaagacaaataatttgaaaaatacacaacacccaaaaataaaatcatgttcttctttagtttctcttctaattaccaacaatttcaaaattgttttattacttttagtaagttacaattttttcttataaaaaagttacctttagttttatggtgtcactaatatattacttaatatagagccagagataagtaaattttttcagtaaaaggccatatagtaaattttttttcagttttataggccatatagcctctgtcccaactattcaactctgccactgtagtgtagtgtggccatagacaacatgtaaacaaatgaatgtggtagtgttacagctaaactttatatattaatacaaaaactggcagcaggctggatttgactatgggccatagtctgctgaccctgatagagagactgatggcattttaaaacttcagcaagattttaaaagatattctaaaatagcagaactgtatcaactatgttaagtatcttgaatgtctgtgtactgcacaactccagaggatattcagttcccattaactatatagtgtgaacggcactccctgaagtaggaccatatggtggccctgataataacccccctccatttctgctcatttatatcaaggttatctgtatctagcctgctgcctgttttgtagataaagttttattggaacacagccatgctcatttgtttatatattgtccatgctgctttcacaccaatagcagaaagcagtagtttcaacaaaagtcagttttgtccacaaaacctaaactggtaatttcacaaaaaatgtttgctgatcacctgactatacccttattatgttcctctttaatgatgaaacgacagggcataatgtgggaaagcttctgtaattattcagtccaacaaaggatgtatcagaaagttagccacatacctaaagctgcttctgaattcttatttttttattcagtgtttctcatcctaaggatgtggttcaacaaactaaatacactt

SEQ ID NO: 64648 - DNA, 1971 bp, Homo sapiens
atcttatatattatcccttctcccctgctccagccaagtctgaattagctggttttgccatgagctcccttagtaccttggatgctcctgttcttagtatttattacctcacaaataactatgcatttctttttcaaaatagtctaaatataagtttattgaggatagtgatatgtgtccatagtctgtaaattagactggcacatgtgtctggcacatactttatgcttataaatatttttctattaaatgagagtaatatgaagtggtcttctgtataactataaaaccctattacatgattttcttacatgctacatatctttttaaatgatttgtccttttctgcatgtttttagaggaatataggaataagtaaagatctagtaccttttaagttagcatactttaagttttaatatcaataaatatgtttatttcagaattgtttaattatataaccctattttaattcaaaccctatcattggaatccctgttttaattttatcatcatgataatgcgtatctgtttttaaaagaggctacaagatgaagcatggttgtttttcctgatctataccttcattaatctcccattgctagtaatccttactgatggatttgatatttatatttaggctttaaaaaattatattccataagaaagggagataatgcttaattgttgggcattttgtttgttacagtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaaggtaggtgttttaccaactttattttttataatggtattgctatttttcttagttcagcatttgaaaataatatattgattttatatatgggctttcaaaacagtacttttcccattgtaatcagtctaaaacaaattgaggtcataatatttaccagttgactatatcatctctttagaatcacttctctgtatattaaaactccttacactcagttttacagtccttcaaatctaactctgaaccggttgaataatttatatttactttggcttaataaggtaaaaagtcctgctgtattatcagttctgcttcatcatcctccccagccttattttagcttctcatttacagccagattattcattcgtgtcatatattccacacagtttaacttctctcattcagatttcttccagcgttttcagattaagtaattacatatagtaaatttgcccatgaaacgaaagccctactatgttcagatttctcagttaattccttttgtgttttgtcatcttattttttgccatgttaatctctgggtttattatgaatttttctatgttgaatttacatgggttcactaataactttgcagcaaaaaacaatactgcttttcttaactcttggtctgtttcaactagataatcaaatctagagcagtatgttcagtgttaggttcaggatattgtctttgtctcaagagaaaaaaaaaaaaagagtctcactctgtcgcccaggctggagtgcagtggcgcaatctcggctcactgcaatctccgcctcccgtgttcaagcgattcccctgcctcagcctcccaagtagctgggactacaggcatgcaccaccatgcctggctaaatttttgtattttagtagagatggggtttcaccgtgttgaccaggatggtcttgatctcctgacctcatgatccgcctgcctcggcctcccgaagtgctgtcttctcgttttaatcacgctgttactttcatatagcatcaatatttcttctctgtacaaagcagatatttagtacatatttaattttcttaaatggataaagcattaa

SEQ ID NO: 64649 - DNA, 1527 bp, Homo sapiens
ttggaaggatcgcttgaagccagaagttcgagatccatctggtcatggacatcagaatagtggttacaatttgtggggtgacttgatgggaaaggagcataaaagaagtctctggagtactaggagtggtccgtatcttgatctgggtagtggttatacaagtgtgttcaccttgaaaaagttcactgagctgcatcccaatgatttgctcacttctctgtgtgtgtatgtgtgttctatgtaaaaccagtggttcttgcgttagctagatatctgtttttttgcttgtatatagtacttcagttgaaaagttgaccaaagccaaaaaatgtctatctggtggtcagtagtttgataggtttaaggagttgaaagaagcctaggatggctgggacatgtagatcatagtgctaagagatggaaagcaccttgtgctatttggccgtttcagttgtgatgttttttaagtagagtgttgtgatcagaagggccctttagaaagattgtggctagaatatggagaacaaagaggagaccaccagagtggatgtgggaggccaatatgtaggttattctagtagctttgcagtgacttacacaaaggcagttttagcggacttgttcatgagttacctaagagataaaattgacaggacttgagaatgagttagatgatggggagtgagggcaataactcccattgctctcagtatcaatgatgactccaaggtttcttacatgtacaatttgaaaaattatggtcctgtcaaagaaaattggaagagcaaatttagaggtgaggatcagatgctcaattattagtacgttgaatttcatacctttgagttatgtaagtagtgatatccagtaggaaattgaaacacagttctgtggcctgtcttgtcaagtcatacttgtgacatatttggcccagatacataagagtaggaatcaaagaacattttatgaaagactttttgaaaatatccatcaaaatatgctgctgacactttaacaaagcattttaaacaatgataaaattacatgaatgaggatgtattttttaacctatgctattccttgaggctgttggattccaaaagcttgttttttaaaggaaatccagtggagtagcatcatatgcagatataatttacgcaaattaactgcaagcattcaggtaaaaaaaaaaaaagtctgagagaaataatggtctcagtagtacagatgattctgccctcctttttaattgtgaacatgtgccccaaaatgagcatgatgtgagaaacacatctgctgtttctttagtagatttctgtaggatgagcatcttgctagactgcatgattgtctttataaaagtgtgtatttttaatacaatatggcactcactataagccatctacttcatctggagcccagccaaagaaatggtgatttgtaccattgcttaaagaacgggttgtattgaacttactgagggatagtttatatgttagtctctaaaatgacatcttaagagatttt

SEQ ID NO: 64650 - DNA, 1922 bp, Homo sapiens
ggaaccctgcagttgagtaaaataacctgtccatagagttaatagagattcgtgtgcttgatcctcttttgaaagccatgctgaaaaataatgcttctgaatttctgtaattcattgtttaaatttcagagacattaaagaaattttatcagcattttaaaaaattctgattctaaagcctccaagtgagtgatattataaaaggatttgaacatcaaattgtcctaaaatacaatttgagtggaatcttaaaattcttaagctatattaaaatcatttaattctagataggtataggtttatgcttgaaatcagcaatgttgaaggacaataaattctgagaaattagcaggactagaatatctatctgaagtttagcaataagcacaaaatagtgtatttatcaaataatcaataagagtggactcttgattagagatgtcagaggggttctccctagacttatcacagaggctgtcaattaacattattagattgtgataagaaatgagttggaccaggtattttcctttttgattcagccggttacccatggagtaatgacgtataaggaagtaatcttcccaagttcaggcttattttaacttaggcactgacagacaccattatgaatattggcattaagatcttctaaaaatcctgaagtacctaatgtttacagacattttatgtatatgtatgtattaacaggaggaaatcactcctcatggaaagacaagtcaagtcaaaaatttggaaagacaagtcaagtcaaaaattagaaaaataaatttgatatatataccagatggctcagaatataccttataatatttgccagatttttagttcccactctatatatcaggtacataacagaagggcttaggtggtgagttggtagctatctttctaccttacttttcaaaagagcaaaaaaaaactattcatttcagaaaatagggtatatcacatcttctatatgtcccccttttaccgtctgttaaatcgttgtttcagtgttccatctcttaatttatactattgaagggttgtaaagacaagtagcatttggtagaacttggtcacctagacacaaaaattagttttaatatttttcagttttaaacttcttcagcagtcataaaactaatttttttatgctgcgttgatttgtaaattcagtgtatctgttttgttcaggtgaacaagtgtattcttaatattaaaatataatgtttacttacgactgatagtatcttctgtcatttgaggaattaggaatggaacatagggcttttgcatggatagttttgggggaagattggaaagcagcacaaaaaatggaatataaggaaacagtaatcattgatatcaagcagtggaaaaccgatgatgtgtgagggagcaggagaagagaaatctagagaagcagtgggctgcaagcctttttaaatggcagagattgccaaaaaaaaaaaaaaaaaatactatgcaacatcacttttcattcaaacatggactgaacactatgtgtgggcttctgtgctaggcactatgaatacaacaaataatcaaaatgtaatttctagccctagagacattcatttagaaggagaggccaacataaatggagaattgtaatgtagtgctctataatagaatagcagaggcatataaaagacacccgtagccttgtatactcttcctttccctgatccctgctcgtctttaaggtttttactttaagtatggcttcttcttgaaagcctttctaataccatatgtattgtattagtgggaagtaattaattgtacagatgagggaatatttctctgaagttgttgcatctgatagcagttttgagttaaaaataggaagttataagttacagcatcatcatttccttttaccaaaggtt

SEQ ID NO: 64651 - DNA, 1026 bp, Homo sapiens
aagaataaggtatgagagaagtaaatgaacacttgcatggactacagcacagcttcaagtcatctgggtggtccaggaagtctcaaaccctgatattagattaagatctcggtttgccatgcccccaggttccttgcagaaacaaaaattctttctagaagattattacaggtttcaaattattttcacaaagtttttcaaatattaatgttcaaaacatattcagaggtaatcagtcacacaaggacacaaaacaacatgaatcaagaaccagttgaagcagtagacaataaaaacagagctctaggtgctccaggaattagttatagcagacataggttttgaaaaactatgcttactaaattcaaagagaaaaaatactgcaaattttaacaaatggaaacattttttaaaatacggtttggaaaagaattgaacagacattctaagaccaaattaaatatgatttgaacagcagatcttcatgtattagtgtagagaagatctgcgaactggattttagggcagaagaaaatgtccagaaagaagcctggagacatgcaagaatgagacagagggaagggcaagaaataacgtagatacaagaaaaggtctaattacatatacatgtaaatgggcatcccagagaaaaggaggatgagaatgttacagtatttaaagagatgatggctaagaattttccaaaacagatgaaagcaacaatttaagaagtcaacataacctaaatagcataattttaagattgtatccaaatgtaggtgtatatctaagagaagtgaaaacatgtccacgcaaatgtttatagcagcattattcataatagctaagaaatggaagtaattcaaatgtctatcacctatagaatggataagtaaaatttggcatatccatgcaatggaatattattcagctacaaaaaagaatgaaacacgatacaacatggttaacccttaaaaacattacgctaagtgaaagaaaccagtcacaaaagaccatctcttatat

SEQ ID NO: 64652 - DNA, 1056 bp, Homo sapiens
ttgaagtataataggaaaaatgaatctttgcttaagagtattaggataggtcgttagaggcataggtgcatgagggggactactagggtgctgagatgttctgtttcttcatctgggtgtgggtttcacagctgtattcagtttgaaaattcagcatgatgtacacttatgtgcacttttctgaatgtacattataaagcagtttctaaaatgaaaaatcagtaaatttcaatgaatatgggttgtataaaacaattttgtgtttatagctaggaagaaatgtgaggtatcaatttatgaaatgtcaaaatgaaagtattcgtgttacagactctgaagatgatttttgccccctaaaaccactttaataagcaattttgaaattacaaggaagcaatcccaaataaatttaaaaggagtttcagttatcttgaaatattctatgtagatcagaaataaattacattgtgtttttcaataaaagtatttttaaaaatatttttggactattgcctgttttactacttcccatattgctttgtctattttttaccaccactcaatctggcagtatctcttgagacgtatatggcacttaatgtgtattgttccctagaggagaatcatgaaagaaaaggtgcagattttctcttgggatacaatagaaaattaattgaaaaagaaagagtccgtaatttaatgtatagttacaattggggaaaaaatcataatatataattttcatatttgttgattatgtcttcttaaacgccatttattactagcacagttcatgctctgtatgtggcagctcgtatagcttatgtttgtattttcatctccttggtttatatatgatgatctaagctataacagtcatttttatggcattgtctgcttactctttctttgcttgcttcagactcatcagttggcttttgcattccatattgagattttgaaagaaatacttcaacgaaaaatgaattgtatttttgttatagtgattctgctgcatggattacaagcactctatctccatgcttggataaactc

SEQ ID NO: 64653 - DNA, 1023 bp, Homo sapiens
atgtgtcctctttaaagaaatattcatcacactaaaatacctgagaaagtcattttttatcccaaatcattgttcttcaaatgagtgtatattaaatgaactgcatttacctttatacatataaacaaaacatggcttaaaacagattttttcatgattcagtttacaaatgccatgagttttctttttgtgaaatccacaaaaagatgagttctgaaactattacatgctgaggaatatttaagatgtacaacagagctccatgcttgtattttcctatgtgcatcaaagtaattgtcgaggattctcacaaaatatcaagagtgatcaagctatcccagaaattcactatgtatacgtagtttcctttcattctgttttcttctatcattgtttttgtttttttactacttaccactcattctcccttctctcactctaagggacttttataactaaacttttagttataaatttttctgactgtggtataattcagtgaaattttatttaactgtgaccttgcctttgcagattaacccaactcctacagatagattttaatgcttttttccccctcagcagttctcattgccccaacaagatatatacgtgagacaaaggagaaatttcttctgcagtcagccttcagacctctctgatcttttacgagcatatgtcaagttgtagctccagttagttatttgttgccattgcctattagtcattatttcctatggttgtttattcttatatttgaatgacttccacagagataatgtatattcattgaaattaacatttaaaagatgttaagatagcctgtcaaagtgatggtagcaaggtggccaaactgtaattgaaaatagtggcatgtttatattttcctgacaaaataagtcatttattcctaaatcagctgatatttggttatatcattattccttatttaatagctttgcagaaataaaaacactaatcataattcatttggttttatattactatgtttcaaattgaagg

SEQ ID NO: 64654 - DNA, 1124 bp, Homo sapiens
tgttccatgcttttcagagttaaaaattattagttccattcaagttcagttagtcaatgctttaataaagtatactgactatgtaataaagctagccatatttgagactgaagactaaaaattttaatttggctaaaatttattgagaacctactatataacattgtattgggtaaggggcatagaagtgagttatacatatgccttgctcttaaataaattgcagtataaggcaaactgtaatatactatcgtaactaacataacagaatgtataataaacacatttgctcatcaaatattgtattgtattgtatcctatgggccaggttactgctctgggcactgagagtatagtggtgaacaagacaggcatacaggaataaataagaaaacagttgaattggtctgtgaaggggtatcataagtatctggaaatcaactgataaagttatatttagaaatattctaattaaccacgtggtttttatgataatctgtggctgagtactacattgttttataattctatttggcagaattattactagtattttgattctctcttggtatctaaattgcagtgaacctcagggttaaatattgagtttggtttggacctaatccatattaaccctaccagatcaataaaatgtcacatttttaacaaaagtagcagagtacacaaattagctttaccatgatttttcaaaaaatcagtgtcctgttttttacactttctaagcttaatgtaatgccagctttaaaaagtgattaagtccagctagttccaatagtgaaagaaaatggaatggtatttaaatttaaccaaaaaactcaaaattatgtatttatctgagtatgttaatttctttaagagatcttttgtaggctgggtgcagtggctcacacctctaatcctagcactttgggaagccgaagtgggtgagtcgcaaggtcaggagttcgagaccagcctgaccaacatggtgaaaccccatctctactaaaaatataaaaattagccgggtgtggtggcgcacgcctgtagtcccatctactcagccttgcctgaccaacacggtgaaaccccgtctctactaaaaatataaaagccaggtgtgg

SEQ ID NO: 64655 - DNA, 1048 bp, Homo sapiens
accttaaataaagtttaaaaagtgggaaaacatcacaataaaaagaagtgctagttatacattgtttacttttctgctacactgtattccttgaattcttaacaatttttgcctttgttttacaggtgaagccttgaaaggaaaggtcacagttcacaagagtaagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattac

SEQ ID NO: 64656 - DNA, 1033 bp, Homo sapiens
tgggtaatttttctattttttatagagatggggcttcaccgcgttgcccaggctggcctccaactccaaagctcaagggatctgcccacctcagcctcccaaagtgctgggattgcaggtgtgagccagcgctcccagcctaaacagaacattttaaagctagagatggttgacccctgcccttgagctacaaaataacccagctagtgaatgacttctgagccttaaagaaagtaattgcagtggtcttcaagatagctctggacccaaaactatcaacattaggagagacagttggggaactcagcagttttaacaagtcttgggattccttaatgccttccctgcttggatgtcacccaagaacatggcactactgttgtagtgatgcatggggccatggcaagatatgtaaagtgcctgcacagctatccacacacgctttgttggcttggaggctcgtcggtcttaagtctcttcatgattttgagtgtttcgttgctataaagttagagtaaactttttcaagaagaatgatagaagaaacacttctaaaatatcttagtaattcatggacagaaaaccaaacgccgcatgttctcactcataggtgggaattgaacaatgagaacacttggacacagggtggggaacaccacacaccagggcctgtcgtggggtggggggtggggggagggatagcattaggagatacacctaatgtaaattatgagttaatgggtgcagcacaccaacatggcacatgtatacatatgtaacaaacctacaggttgtgcacacgtaccctagaacttaaagtataataataaaaaaaaaacttagtaattcatttgacctttccaataaagttttcatctattgtctcaccatcctggttaatgtggagctgttcacattgttagttctacagtgtagctaaatgcagacaaaaatgttgccacttagttgtaattaaaatgaagataatagataacaaaggaggcaattaattatagcatagtcattttatgga

SEQ ID NO: 64657 - DNA, 1086 bp, Homo sapiens
tgaggtcaggagttcaagatcagcctggccaacatggcgaaaccccctctctactaaaaatacaaagattagctggatgtggtggtgtgcacctgtaatcccacttactcaggaggctgagacaggagaatcgcttgaacccaggagatggaggttgcattgagctgagatggggccactgcactccagcctgggcaacagagtgagactctgtctcaaaaaaataaaaatgaaaatagataaaaataatgacagtaaggattcttgttaagtttttttctctctatctcaaaggtttctgaaggaacaaaatctttcgtgtggtgagtgtctccaggatgttttctgaaagtaaacagcacatttttcccctctttggaactgaagctaaggccacattaacatgaatggagctccaggtctttgtttcattagtgtgggtgtctccaatgagcctcctactgtgaaccctaataggatttccctgcttacacctttgtttgccctggctcctcatgctgctctgtgatgtttggtttaatgagacaactcctgtgatccagaaagaaaaataaaaggaggatcctgtcttttccttaaacagacaaaggtgtaactgagggaattcaagattctactgtttcctggcactttatgttatcaacatgtgatggcaatcctgaacacactgagccatcccagtaaccatttaatctcaaaaagtcagccgcggactggcagattgcatctcacagaagtccatttagccttaataacgtggaaagacagaagacttgagttggaggggcaaggagtgggtgaggaaggcagaacagagagtaggagctctaaagtgtttcttctgaagtgagaacttgaaatgtaacctagtatgggtgcaatcaaagtacatacataaaataggtaaagtaactatggaaataagaacagtaatagatacagtaacagtaacaaagtagtaataggaaggttagggtagcctaaataaactgaatcctctctatcatagagaaaggtaatcatagataatgtctaaagtggatacataaaaacatggagacataa

SEQ ID NO: 64658 - DNA, 1106 bp, Homo sapiens
ataatttttgacatttaaaaaatctatttaatattgttaagtgaaaaaaaattgagttttactgggcatagtggctcatgcctgtaatcccagcactttgagaggctgaggtgggcggatcacgaggtcaggagttcgagaccagcctggccaatatggtgaaatcccatctctactaaaaaatacaaaaattaccctggcatggtggcatgcacctgtagtcccacctacacgggaggctgaggcaggagaattgctggaacccaggaggtggaggttgcagtgagccgagattgcaccactgcactccagcctgggtgacagagtgagactccatctcaaaaaaaaaaaaaaaaaaaaaaaattgagtttcaaaacataatctatctaggtacaattacacatatgaacatgcacacacagatataagaaagaatgtatcatagtggttgtttctgcatgataggaatcaaaaaatatattattttcttttctctgtagttttgtatattgcttgatttcatttttcaaagaccatccatcttttttataattggagacatggcaatggcaatgattatgatatgtactgagaaaataaagactagcatttttggaataaatagaaacgtagttagagaggaaaaagggaccccatattacatgcagcctcaaaaggtggatagagttcagatatgatatataaagaactagaagtagacataatactagttaacattgatttattcttactctaagcactctgataagtgcactatctctcatttaatcctcatagcaatcctatgaggtcataattttaattgtcctatttatttatttatttattttgagtcagagtctcactctgtcacccgggctggagtgcagtggcaccatcttggttcactgtaacctctgcttcccaggttcaagcaattctcctgcctcagcctctcaagtagctgggattataggcacgtgccaccacacccggctaatttttgcatttttagtagagatggggtttcaccatgttgtccaggctggtctcgaactcctgacctcaggtgatccacccaccttgacctcccaaagtgctggga

SEQ ID NO: 64659 - DNA, 1088 bp, Homo sapiens
ggaggtcccctgaaatttaatttctgcccttaagcataaaccttagaaccctccaattatatctcagaattagaataacatccaagctccttttgggtcacagggcttatatgatctggcccttctctctctcccactttggcctctcttcttttttcttttcttttctttttttttgatacagagtttcactctggcacccaggctggagtgcagtggtgctgcaggatctgcttcctgggtgcaggtgatcctcctaattaactgggaccataggtgtacgccaccatgcccggctaattttttgatctttttgtagagacatggtctccctatgttgcccaggctggcctcaaactcctgagctcaaacagtcctcctgcctcagcctcccaaagtgttagaattacaggtgtgagccaccgtgcctgggtggcctcattttctacttctctacccctggcccattcagtttctgccatgctagccttttttctgttcttaggacactcccagtttgttcctcgtttgcatgcacccttctctgcatgtggaaagcttcctcccatcttgccttttctagtcattcaagtttcagcttgaaagaaacttttcaacccccctttctaaagtaggacccccccatccaagttgctttctatcccattactctattttcttcatggtgtttattgccatctcagattatcttattcatttgtttattttttgccctcccccaacctaacccacaggaatgcgagctccatgtgtgtgctatatagtaagcactcagtaatacctgttgaaaaaattatgaaatgaatgaatgcagagtgaatggaaggaagacatctttgggtcaactggaaggggaaaacttaaatcttcagttcaggggacaaggggaagtctgatagaaactgagaaggcagttatagacattttgtctgccttggcaataaccggtttcagctctaaagaggccttcctgaccaaccgtctgttgacagaagcctagcaggtcctgtttcctaacaggaaaagagtaaggaaagagtagatttccttctccaaggctgtaggac

SEQ ID NO: 64660 - DNA, 1046 bp, Homo sapiens
caaatatttagggaaacctgttaaggaaaaagagaaaaaaagaagacatgatcagtcagcccttagatgtagaagcccaggacccattaaaatgaaacattgcaaagccatagcactcagtcctcccaaacccacactttattttcttggtttatatattcagaatgtttatgattttttattctctgatcaccttttttttccaaacatttgggtctcaaaagtaagtttccagggaaggaaaacaacacacaaaatggatagtggctgttttttttttcctttgaaagctttcacatagattaccatctcaaaaacagtgacatgctaagaatgcagaaatcagatgaaaaatgagccaatgggcaacaaaaagtagctgtgagaaatgaggtttattagcatcttcccgggggatgtcagagaataagggaagctttcaggactttcttccaactcttccttactattgttcatgagatggagctgatagtaaggccctgtggggatcaagaatgttagtgatcagaaaactaaattcactgtttcactgctctaaataaaagtggatggacttctgcctcagctcagcttcgagaaggtggaagaggagcgggaacactggaaaactgtttctcctttttctctcctccggccctcatggtgagaggtgagatatcttgatgaaaaagaggatccaggtttgctgggcttcatctcggctctgccagttactagttatgtgaccttggggatattatttcacctctctaaatctcatttttcttatctatatagtgggggcaattcaaatgcatgagatttttgagaactttagatttaatgtacttacattttatagaacaatgttgggcacagagtaagtattctgtgagtgtggtcttttattttcctttattgtcagtaaaatactctcttatcctcactttagatgcatcaagaaccccatatactttctcatacgattcaatgagtcctataattgattagtcagtaaggtgaggcttagttaacctatcaggtgg

SEQ ID NO: 64661 - DNA, 1081 bp, Homo sapiens
ccagccacattatcaaccaaatttaatggtgtgatgaagatattccaaacgagtgaggatagaagacaattttttgtccttcttaggatgctactggaagatgtacttcagaagaataaggaaatacaccaagagttagttaagtgttaagaaattattgggaacatggccgggtgcagtagctcacgcctgtaatcccagcactttgggaggccaaggcgggcagatcacgaggtcaggagatcgagaccatcccagctaacatggtaaagccctatctctactaaaaatacaaaaaaaaaaaaaaaattagccaggcatggtggtgggcgcctgtagtcccagctatgcaggaggctgaggcaggagaatgaagtgaacctgggaggtggagcttgcagtgagccgagatctcaccactgcactccagcctgtgcaacagagcaagactccgtctcaggaaaagaaaaaaaaaaaaaaaagaaaaaaagaaattattgggaacacattgtttttaacttaaaataataaaaccacatggttcctacatggaacgtgttaaatatatcttgatatagccctaaaatagaataaaacagagtagggagtacaaaaccttaacaaagaatgaggtcaacctgtttgtgctgatataggtgatctctctcataacttactagtaaaagaaagcatgacttaacattctatatgattctttccaactaaaggcatctatgtatatgctaaaatatgcattttttggaaagatatgtaagaagctattagtatgaacaatgttactttcaggaaaaggtacttggttttgggagatagaagctttaagatgtatatgtattttacagttcatagattagaaaatactatttcaaagcagttccatccaaagtgcctatgttaaatgagtggggactggggtgagtccttgagtgtttagccctaacctatcctgttcctctctcctgatcccacatataagtcctagtcataaattatagaatgaaaagcatgaaaacatttgtgtcctattatctcaacttcttcattaatttaacaaagttct

SEQ ID NO: 64662 - DNA, 2084 bp, Homo sapiens
tatacacaaagcatagtgttggcatctgcttctggtgagggcctaaggaagcttacaatcgtgatggacggcgaagggaagccagcaggtcacgtggtgagagagggagcaagagaaagaggcaggagttgccaggctcttgtaaacaaccagaactcgtgtgaactcagagcaagaactcactcattactgcaaggactgcaccaagccattcataagggatctgcccccgtgacccggacacctccctctaggccccacctccaccacaaggtcacatttctacatgagatttggcggggtgggggggacgtggatcaaaacattctaactatatcactgtacaacgggatgttttgacacaggtatacattgtggaatggctaaatcaagctacttaatatatgcattacttcacatacttatcattgttttgtggtgggaacactcacaatctacttgcttagcaattgtcaaatatacaatgtatcgttttttactatagttagcataatgtacaacagatatcttgaacttatttgtcctaactgaaattttgtgtttgttgaccaacatttccttaatcccccatgccccagccattttactatctgtttctactatttcaactttttcacataccatatataagggaggtcatgcagtgtttgtctttctgttcctgggttatttcacttaacacaatgtcctccaagttcatccatgtcatagcaaataatgaaattgccctgattttaaaggctgaatagtattccttggtgaatacataccacattttctttatccactcatcttatatttaatttatatttaatttatttaagtttatcttcaatccacctgggatttatttttggctgtagtgggtacaaatggagatattaaatagttttccactggattgcaaagctaacttctttttttaacattttagcttttattttaggttgaggggtacatgtacaagtttgttatataggtaaatttgtgactcagggatttggtgtacagattattttgtcacccaggtactaagcatattacctaactatttggttctttttttttgattctctccttcctcattgcctcctccctcaagtaggccccagtttttgttgttcccctctttctctccatgggttcacattatttagtttccacttataagtgagaacatacggtatttggtcttctgttcctgggttgtttgctaaggactaactttttaaatactaaaattcacatccaaatgtttctagactcttccttctgtttgactatttcttcactaaaaccattctgttttcatttttgtatgcttataatgtgacttgatacctagtaagaaaatattccttgcactattttttaccagacactttttagttactctatctatttttcgactccaggtggactttagaatttgcatatgaaattccatctaaaattgtaatggctttctcattggatgttgttgaatttttatcttagtttgtggcatttttaaaatttgtaagtcttcccatctaggaaaattttctctctctccttttattcagagatttttatcttctttgtgttgtgtatttattttgtcctttatgttatgttatttattctttatagtttctgaacatttcttgttaaattttttcccagctattttaagattttggtgctattttgaagtaccttttgtttctaaagtacttaaagagctctaaaaaagagtcagttacttctgccagtcattatttataattaattattttgccctactctatataaagtattttatttgagaaaactaattatacacatatattttggtgctggtttattaagcttcagctatttaagggttaatttaaatcttgcctcatataactaaacttctaacatttcagaataaaatgttctatatttctcattcctggaaaaggcaatcccccctttcttccaatttcagtatttttagtaacaagcacagaaaatatattcaagtatttttagtttttctctttagattcaatttgtgtgcaatgtgaaatatggaa

SEQ ID NO: 64663 - DNA, 1075 bp, Homo sapiens
ggaccgggttctgtttttacctttgaataagaagttgtatttcatatagaagagttctataataatgtctggatccctttatttttatccaacagttatcagtatattgctatataaatacctgccaggaaggacattttttttcctgcttcaataactgtttaagtgtctgttgttcccattttcaaatctccaaaacttttatgtgaattcttttagcatatttttttcattatttctcaacctcctttttttctggatggctgaagtttccagacatacaacccaaaatgtcttaagagaattaatataaaaaagctaagaaaatggaaagcaaagaaaaatatgcatgtacattacctgcatgtagatatgtaaactcatttttaatttcctttaaaggataatagatgaatctaatttttcttattactctttcactaagtagcaattatgatgtaaaaggtatcaggaaatttcttttttttaaaattacttccagacgtaatctgagttcttagattgggttagtctgttaatatcattaatgtcaaggagcattttccccagagctccctagcattcaaaataaactggctgaaataagccaaataagtgattttttttcattgcaatatcacagaggcattttgttagaatgtaaaaattctttccagtattgtttttatcagttaattaccaagtataaagggaggctttacagagaatattctatcagatttgagggaaccactctaagggaatagagagatatttgaagtcaaaactactatagcttacatttctgttccctttattcttttgaacagattaatgctataatttctgaatttgcatatattatttaaacagatacgttgagtgaaagctcctactcgttgattttgtttgtttttcatttttgagatagagtcttgctttgtcacccaggctgcagtgcagtggcatgatctcagctaactgcaaccctccacctcccgggttcaaatgattctcatgcttcatcctgccaagtatctgggactataggcatgcaccaccacacctggataaa

SEQ ID NO: 64664 - DNA, 1020 bp, Homo sapiens
gtattcatggattagccaaatctaaatccaagacctgcaggtattgactttcagccaaaccgttgagtcatttaagtttggcagtgatttgaaatgtgaaaaaaaggatcatgagaaattggattgagaatctgaattcttttaagaaggggcttaaacagaagagtccttatctatgacagtgactttaggtttctacatatttgacatatgtctaattgtgtaacttctattgcatgttaattactcactaagccttctttctctcacctctgtctcctggggaaatgtaactgtgtttttgcttttttctcaccactaaaattttgactgtatacaaagtaacaaaataaaaattgcttaattattcttattgtttttacttaatgttcatctctaattattagaaggtagtttgagttacttttctggcaaaacacaggacagagtacatgagaaataaatgtgccactgtcaaagaaaataaaaacttcactgtttagaggttttgagggaaaggattgtgtccttctggctcattgaaattgttacatgccattaggcttactgtaaactatcccttgataaattatttgctggacaatgagcttaagaatctgaggtgtcttcttgcttttatagagcaaaataggactctgatgcttaaatggaagtcacagagcacataatagggtgtaggtaaagttactgaacagccacatctcactttcaggaaagtagtggaagagattgtgtcttgagaagacaggcattttagaggtaacccttttaagatttcaattagttatttaagtatatgaatcatgtgcttatatgtattacttaaatgtttctgaggccagcaggcatataggaatcttaaccagctacagggagaagttttgtttttctaggactagacatattttttttttaactggggcagaaaatgctttgggtttttcatgtttaatcacagaatttggagaaaactttaggactttatatggataacatcat

SEQ ID NO: 64665 - DNA, 1031 bp, Homo sapiens
ctttgcttaaccttttaggctatatttttaagggtaatgatcatgtgtttacagtgagttgtaaaaatgctgtcattgccagtgttcagtcataaaatttggtgaaaatctatggttttaaatagcccaaacaatgggagttaacaaattgggcactaacattttaactttttctcgtgtttcaatatgtggaatttcttgcttagaagctggctctttccaagtatattgtttcatacaaacttggagtttcttgtttgattttctatttgacctttgattgctgctgttttcctactaagtgtttggccaaaagtgagagggccagtacagataaagcaaatagtgtttcatggggttaataattaataaactgaactgtcatcagaaaacccgcggatccagttcattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattaggtaaggttataagatctcattttgtgagcaaagacaacagtttttgttttatttttcctcctgtagtgtccttcacctaagcatgtgatagcaccttggaaagaaagacttttattatttgacatttgcatctgggaaacctgaagcaggtggaaaatttaagtgaatttcccaatgtctgtcatattaactgtgcttagtaattccaatatgatgcactcaaatgtggaaatatgcagtcagattgcttattttatctatatgctggtctgatttatttttggcttttctttcatgcagctgaccaatttgacctactcttttgacattgtacacaggccacagtgtctgtaaaatctggcttctaaatctggatttcttt

SEQ ID NO: 64666 - DNA, 1051 bp, Homo sapiens
gatatttacctttgtatgacttttacttgagaaagtgtaattatttctacacagcctgttcttaagaatttgccatggataaattcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgttttttcttcatttgaggtagtacatttcaactataaagtatgtaatagtctgtttttgccaaaaaaaactcacctttcagagctataaaatatacagaattgaaagctgacacctaatatatttttcattagatacagatgttcaatgtaaaattctttttacaagtattcatgaaaaacaggataactaaaaagatataatgtataaaaagtaaaaatcatactttttggtaaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaacgtagaaaatcttgcaaataatttgtaaagaaataattcaacaatttagagtaaagtttatcttctttatcttaaaatttaaacttatttgaataacattataattaagagaattatttctaatatttactttctgtaattttgtgaaataattttcttattagaaaatgtggcctggcgtggtgccttatgcctgtaatcccagcactttgggaggctgaggcgggcagatcactaggtcaacagatcgagaccatccaggccaacatggtgaaaccctgtctctactaaaaataccaaaattaggtgggcatggtagtgcatgcctgtagtcccagctacttgggaggcaga

SEQ ID NO: 64667 - DNA, 1030 bp, Homo sapiens
tgaatctccctctggaactctgattaaagatagaacttgtccaaggaggtagaaggtagggcattgaagttgggggccataccaggaacaaaagcatagcagcagaaatagaaaggtctgcaaggggaatctgtgaaggcagcctatagatagatcacggagtagggtgtagggatgttagatgggaaagatgggttagaggaatacagggagacctttggatattgggttaaagtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacacaaaaaattaaggcaggaaaatggaatcttctgaaacttggattaataggaaacaaaaaaaggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaagcaatccacctacctccggcttccaaaattctgggattacaggcctgagctactgtgccccgcctacctgtattattttaatcaggaaaaccatttcaatagaatctagagatatggttttatacattggccatgttattcaagttcccaatggtggtttttaaaaaatacatacatggttctattttaaattaaagaaaattgatctggctgggtgcacccta

SEQ ID NO: 64668 - DNA, 1038 bp, Homo sapiens
tcttgtagtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttggttagttttcattccccttgattactaaatgatggaactctttcacccaggatatcattttgccaccttttatttgaaataaaactgttatgcagttagcactatgttatgaaaatattaaatgttgagattcttgcaaccaaaggaagatagaaaattccaaagaaatgactatttctggtaagctcctatcccagttatgtaactcagctagaatagcaattttagtgataaaactgtgtcaaatattttatttagtgtgaatctgacatttgattttccttttataatgcttctttttgttatttcagggaaggagattacagcagaaacttttatggagaagttggacaatggtgccttgctctgtcaacttgcagaaactatgcaggagaaattcaaggagagcatggatgctaacaagcccacaaaggtaaaagatcccaatgcaaaaatcactcttaggtggtagattacatttataattgcttataaattgtgtgtaattaaaaaatttattgtgaacggatgcatcaaggtctatactaacaacaaagtacagagagttctttttaattaggtaacatgttatttgcactctaattacataaattgcataatccttttggtgaatctaattaaataaaagcttatgagaaatgatggtattaaaagagtattgtgtataaactcaatgaatctgaaatattgattaaaaacttagcagagaaataattgtgtcattaggcaatgcacagatctagccaagaaagatttactgaatagatctttgttttcaaaaatattatggcagaatactagaacaaaatttctggactgtaatttttggtttattctaaataagtagtaccattga

SEQ ID NO: 64669 - DNA, 1248 bp, Homo sapiens
ttgtaagactcaatgtaagataaccctaaagcattagcctataggtcaaaggctttgacattaagtgcattttgcttgggttctagttttatttattaattggacgtgtctgagccgtactttccttatctgtgaaataggattaataattacatatgtatagcttccatagagcattgcacaaaatagggctcttgataaaatctctttttgataaaatctcttttccttacgtgaaagataagagacccttgtaagtattttcgattaactataagaaaataaatactttatagtctacggccataccaccctgaacatgcccagtctcgtctgatctcggaagctaagcggggtcgggcctggttaggccttggaagggagaaaataaatgctttataaatgtttgtatttagcatgagagctgctatgtgcaaatatgtatacatttgccccaatctccatgataatatggaatattgagaatatttattgatcaaaagttatgtaagtactttccttttaaacagccatttcaatattataatttttataataaaactataaaacaaaaagaaaagaatttttttcagttagtaaaactgcagcaagttattaaacttgaaatagttccgtgaacctgagcaaatttttaactgaatataaagctaaatttttttctgattgtgataaaggttttagtataaaaccttaaatgtgttacttgaacaagtggaggtttaaaaatacttattatcatctcaccaaaaagtcacatgcacctgtatgttcatagcagcactattcactactgcaaagacatgaaatcaacctagatactcatcaacggtggactggctaagaaaatatggtccctatataccatggaataccttgcagccataagaaaccaaaatcatgtcctttgcagaaacatgggggcagctgaaggccattatcttaagcaagttaatgcaggaacagaaccaaatggtctcacatataagtgggagctaaacactgagtacacatggacacaaacaggagaacaaaagacactggggcctacttgagcaggaagggcggcaagagggtgaaggtcaaaaaactacctattgggttctatgctcactatctgggtgatgaaaccatttatatacccaacctcaacaaggtgcaatttacccatgtaacaatcctgcacatgtcccctccgaacctaaaataaaagttaaaaaaaaataccga

SEQ ID NO: 64670 - DNA, 1388 bp, Homo sapiens
gtctagattccagaggctactacatttatttgaatctgcttataaagagccccttcaaaattgttctttttgtctgtgagctcaaaccataatatattgtttggtagtgtaaataacagttgcattaaaggcatatgaaacatgtgactgaaaataaatatgttaaattgaaactccaaaaagtataaaaagaagaagagcaaattctggatagaaaaagggaggttcacacacacatgcacacatacacatttttcatctacgtgatttcctagcaccagcgcagtgttgtcccttgagcatgaaagtaaacctgactgaatttttccatgatgacatcatcccttctacttacagtctcacatcctgcatttaacaacatgcaggcacatcagcaagacaagattgtaaaaggagtctaactggggaactgttttcatgatatttgatagcactaattgcggtcaatgctttcaaagcactgtggatgtagaatattttgtcagaaaaagtcactctcaccctatggaaaatggagaattaattattttaaaatgagctgttactaaatgtgttggagaaactcaagtcgttggaacaaatcaataatgaatatgtatgctatttcttaaagggaaacattcatagattttatattaagaaccttttctaaaaggctgaaatttgggggaaagagttgctttttcatttaaaaatgtctgagaattgctaggtaatttaaaatgtaagcactcaccatatttatgtgtgtgtggtccaaggtatgtggtactggtacattacagagtaatggaataatgctttttagatgaggtaactgagtttacaatatatagagctcttcaactgtatcttaagctcttaggggctgacgacatgaatggcttctattgtttgacttagcagtttgaaaacacattacatatcatgcatgaagcctgaagccttctagtatgtgttttgtgtttatattactgtgctagtcatgtctaatttcacaccagtgtaggctgcttgtctaacagatgcctcgctagcattgctgtttcatataagaaataaaaaatgtggtaatttgcatatcttgaagccaaaagaagcaaacaaaaatcccagctcaatcaaaaattgttaaaaaagaattaaatcttggaagtgacaaggaagaaaagaaccctacaatgaaggtgaaacaactcaataaattcagaaagtcttttgagactctgttttgtaggtgttatggaggatgtgaagcaaataagtcatggattctttcttctagatcaggatcacttaagtgcttttgtgccatgttcttttaggcacttgggtgaagcctgtggatcatttctcctcatgctatt

SEQ ID NO: 64671 - DNA, 1018 bp, Homo sapiens
cgatttcagcatccaagcaacacagaagcttgctggcttttcattgctaatgtttaacctggatgttgagaagctactcattcacgatgataatatgaacttcttgagggcagcagttaaccaaattaaaagtgtgccaccaatattcctaacctcaagatcttgttgtcaaagccactatgtctaagcatttgctaataaaatacattttccctccaaaactttcctggggaggggaggacattgtacatgcagttttatatgacagttctccttagtggaaagtctattcccatattctatcttcctcctccttcacctccttgcttcctttttactttttaataattttcagcctccccttttattccttttcttcattaccctcattcaacactttgctcttttagtttccacttctgactaggatgatagttttaaaattatctacatttttattagggaaagacatagaatgttatccttatgtagaagcatctttgaaacctgttttttttctgtaggaaggaaaaacaagaattaatttcagaaatcatagctaaataagcagaggaaggaactctgttagctaaagcaacttgctttggttacctgttttcccatttattatcttgcataccatcagacagggcttctggccagcccatgaagcccaaagaacaagaaatgaagatacaaatgtttgaagaagtcttgatgcaaattaaaaattcaagattaattagaaaatggtttcttatccacatctgggtatacttttagggttgagatcagatgaataagtaagataaagtgagaactaacactgaatgaacattctcaaagaatttattaataaaatcaagaaaaaaaataggtgaacacaccagcaatttacaacttggctagaaaacttgctgccaattaatagacctttctttgatccaatagaaaattaacctgtaatcagaatatgtaacctcaagttctttaaatcatcatatcaatataatcttca

SEQ ID NO: 64672 - DNA, 1068 bp, Homo sapiens
agatggctgaatgagaccacttatttttgttctcatgggtaaaacttacttttattttcaactaaatagagctatcatcactgaagagtgaaatccctctgctaatatttcagaaaaatatcagtttctgaatataaaatatgtgtttgacttgtgaaaagtaaaactgtgtaaaagcaagttaataaaacctcaaagatatttttactgacagtgttttgatattcattgctgaaaacaaagttagtataaattcagcattttttgactgtagaattaagatgatccttataatagaagtaaaaaaaaaacttttgatattttcgtttagggtcataatcaataatcagtggtatagtggagttttttatgaattttattttttagtatttctttgatttggagcaaaatttatgatcatttaaaagaaaaatactttcggaacattttctttaatctgtgatttttattcattaccttttaaaaggaaatgttacttaaaagaaaaaaatattcttatacaaagatgattaactgacccatcctatttaaagcacttgaactaactgctgagaacatcatatactttcacatggttgaaatttccttccaaatctaaatcaatctttaaattgctttaaaacagaagataaatgaggaaaaaattatcttgcaggaatctataaactgtctgttatatgccttaaaaaggacagtttctcgcactaggctgtaaaatttgtccctctaaccctagtaaaataggatccagatgtcttttgtttgaaaactctagactactaaatagtttgagtaaattttctagtttaggcctcagtttggggtcttagtaattttacctagagctcaaaaactgtgtcaagtgccagaaaaatgagaaatccattcctaaaacctcatcataaagtcattaaccataagacctgttccctatcactttaaaaaaaaatgagacaaaaatatgttgccctttgagtattcgccctactttcattatcactggggtataaaggtatgaggatatgattttagtggattctaccttct

SEQ ID NO: 64673 - DNA, 1062 bp, Homo sapiens
tgttatttttaaaagtcagtgatttactcccatggtgctcatcatcacatgtaatatatggtaattgtatcattataagttatgcatatgtaatgatccagggtctttttaaaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtaagtaaaatcagtcagacttcttaccaacggttagtctttcttgcactacaaaacatattctgtgcaatctcgtatcagtctaatctttacctatatcaattttcttgaaatgtattttaagcccatatgaaaaactttgtagtcctacaattcattttgagattcaaaactgaactagttgttcaaaataaagtgtcatttaatgctgcagaccaatatctaaaactttagaataataagtcaactccctgaaaattgtatttgaaaacatgaaagtctctttgtcactggatcaccattccccctttcacagatgagaagtctgaaaacaagatcttgaggattgttaaagaagggaaagtaaatgtatgatagagaagttaagtgccttttatggactaccattgtttttcaagtgctctcatatatgaaaggcaggttccctcttgagaaatggaaacatagaaattgagtaacctgctgaggggaggagaggagcttagattccaacaaaagttttgtctaactcttcaaggtcgctctacttagcagagcccttgagtcacaatttttggtagttaggaaatgttttaacagaatcacagtaaaccgtttttaggtataacagcaaacatggtgaattaaaactctcaagtgaccttggttgtctgttaagtagttattggttatgaaaagtagtgtgcttgagtatgtgtgtgcatatgccctccacatatattttaagtgcaaatataaaaaaaattaataaaggagataaatcatgagtgactgggatgttgttt

SEQ ID NO: 64674 - DNA, 1010 bp, Homo sapiens
aagagagaaagcaaaagaagcagatctgtgttaagatattatagtccagtgaacagtttcagcaataactgccagttttgaaaccttcaatgtttcttcacatttctttgtttgatacttaggggaatagtgggaaaaaataggtgaccctttatgtggaaaatacatcaccttctttaatcaagatatcatgaaagaaacacagtggtttccattcagattaatttattctccagatgtcctgatagagtgattcagctgtgataaaacggtggagtcaggtttagttctcctcttcgcgagctagttctcacacaatgagttgaatacagttctcagaaatcattcttactttcttcctcttctccatcaacttcctcagtctggggatgagagatagtataattctgagtaatcaggctcctcttgaaatcccatttcagcagaaaactggctgggttcctagccaaaaaagaacacctgccagactgacttttccctaggtaatgtaagaagcacagatgtcatcagtcactgtttacttaacaatatatttccactggccacagtctggccttgtttcttccatttctgcttccacctctcatacaactacaaaaacagcccttgacttttaaaatgaactccattttcaaagctagaaaggcatttgagaagggcaggccacttgagaaaatgtttcttgtattttatttcatttgataccaagagtttctgtcttttgtctaagaagactgcaaaatggaattactttccatacagacttgtgattgtcattttttagtggaggaaccagttgaacatcaatttactctttggttaattaccacatggcagcaaaattgtgccaagcatgatcctcctaaagttcaggcctcaggccatgtgctttcttgatgctgtcagtctgattttcttctggatgatcgaccccttctcccaatgcccctccctttcttcatccttgctttcctcatggaagcccttat

SEQ ID NO: 64675 - DNA, 1024 bp, Homo sapiens
aagatcctcttcattagggtaaagttttacttttcacttatcttgtttttatgggaagattcagaatttgagttaggggaaatatgacagataagagcaggaacttccatatggtgcttacgtttaaagatacatggtatgaatttttttaaagtaacatacattataatgtactactgaaggctaaatacaactgttttctctttgtacatataccaaaacgcatatacaccaaagacaccatggagatcaaatagatgaagaaggctttccacttgtgttatgttttgctaagaatcaagataatttaatctctcaaagtaagtttgtggcttttactaagaccaataattctttttttaaaaaaaagaaaagaaaagaaaatgaaaaatagagatacattcctagaaatctgcagttgtaaataaaagtaatttgctgctttatggtttagtcatttctaaaggaacagaggttgtgatgttttttaaaaaagctatattctttcctcagttgaaaaagttaaaaaatatcctgctgttttgtagaatagaatgatttgaatacgtacatctagtaccagcaatgtgtagtctcacaatactcaaatctgcaatgactctgttgaaattttgcccttgtaaagttttcttaatttctacttttgaccaaaacttattggtataacaggtctttttaaaggccctgcaacatgtagttgcaaaaagaaagtttaatcataattttagccttaaaatataatgttaatggttttgaattttaatctaattttagattagcatttactaatatatttcttaaatttccaggaaataattgctattctgctttggaatagcagcaaaaggatataacaatgtgttattattggagtatgagacagatctgcgtagatggcctcactaggaaaggcagttgtctgagttgcttattgttcttttgttctttattgcaaggatagcatacatattttgttaagtcaaactgcctgctgtcatgttag

SEQ ID NO: 64676 - DNA, 1045 bp, Homo sapiens
tctctttctgattttcttaaagtgaagggctttctaaacaagacctatgtttcatgaaaatgtggttagtatgacattttaaacaaggcattttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtacatttcttctggttaaatttggggttgaagttgccagtagagtttacctatcgtgattttttttttttctgttaatctggatttcaagagtcaagaaagggtatctgcagaaagtcatgtctgagatgagactcaaagaataagcacatgttggctaaacaaagtagaagtgaaagtgtttcaaccagaatcagaaagaaaggagacagcatacaaaaaggcccagaagtaacagaggaggagatgaggggaagagagagagagagagagacctcatcagaactgtagaagtgcagccttgagagttgaggacaaaaggaggagtgggcaacgagaggctggtgtagcaagggagacatgatgccaggcagacacacagagccagctcatggagagctacctgtatgatgagagctttggctttctcctgaaggcaataagaagattctaaataatttttagacgaggagaaacatgagtagattgcattttaaatcattcaggctgtagtgcagataatgaattgaaaaggtataaagttggaggacgagcattccaccgttttggcttggagagtgtggaggtcaagagggtggcagctcattctggggacctacctcttgaaattccaggtatatatattattatctactgtgtgaggctatcttgtgtcttggttatttaaaattgaaacaccgttaagtttatctttgtcctgcaaacgataacagaaaagcaacatgttgattttggc

SEQ ID NO: 64677 - DNA, 1043 bp, Homo sapiens
cacttgctatataaccttgatcaagttatttaaaatctctgtgactcatctataatgtgaattataatgctactcagttttagagggctgattattcattcagccgatattccataaattattgtctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatagggttcaggaggggttactttgggtaaagcttgaagagatggcctctccaaggaagtgatatttgaagtgagatgtaaatgatgagaaggagccaggcttgcgaagagcgggaaaagcagtttagaggtaacaggaagagcaagtgcaaaagttggcttatttgaggagcagtatagcagattttttaggaaatgcacacctacaaatgtaatacttaattgtcagtctgtaggtagaaatcatagcagatttaaaagggtcacatgccctctagtgtcctctatgccttatttaatcctgttaataggcttttccaagtgccatgaagaatgttgaaactgtgtatgtgtgcatttgttctgtgaaatgcattaatatttctttatgtaggaaacagaattctgagaaggcagcttctgttgaagggggatatatttatttatttttgtaaatgagaaggaatggaaacagaggggaacaagaagtgttctgttgaaagggatgacttgcatattttagtttggtctgttcattcttacataaactagggcaaaacaatgatcccattaagttttttgtttttttttttttctcttcagtgtttttcttttttgggtttaaaataaaggaaaaaaaatagaatcagggaatactttgattctgttgtgtgggttgaaattctatctctccacccacaaaaaaattctgaaaaatgggtcttggaatttttttcttcatgagtcctagtcatcgccctc

SEQ ID NO: 64678 - DNA, 1891 bp, Homo sapiens
cctgtctctctttctacctggtttccccaactcattgttgcttttaactataagatctgaggtcatggtttagattcatttgaagaccactttgcgtcttctggcatggctacagaaggttccagtaaacctgacacaggcaatcctgtggttaaattgcaaggacaccttcagtcttagaggacaaaaagaggaaaagggatagcaaaaattccagtgttcctccatcacactagacatattccaaatgtagagattctgaatgccaagaacagcttgcttggtctgtgtgagtcgtggatgttttgtcatctaagcccgatgtactctcccacactttgcatcattactgagggataaaaaacaaaaacaaaaatccccccatagcactcagaaagtgcatctttatagtccgcatggaaaaagaaggtcagtggcacaaagcatttgatgccctaccacctcctcttttttccattcatcctgggtgaaggaagagtgtgtcttttctcccactcctacctagcctgtctgattcactctgttgcattgtcctcattggaaactgctttcctggactcttgacacattcttactgtatcagagctgtgcttaaccaggaagtgccagatggtactgaatcactggctgcttaatattcaagaacaatattacatacagaacagaataatgtatgtgttgattaaaggactttgctgatgtcttgggaatcaggaaatgcccttgtcacctccacagctgtgccttgacaatttatgcagattacaagttttgtgggggactctttgctaagcatgtttctaccttttttttaaactatatcttcagcacttggttttttgctctaagctgcttgccattcaaagtcctagatatatgctactttcgttgaaaagattgttttctagtgtcctcttccttgtcgctctcttcaggattataagtctataagggagtataggacaaaaactgtaaacatagatagctgtacttttttcggggaactggcattataattctggaagatgtcaacatattggcacattcagaaattaccttcatgatgctatggactgtgagtaatatgtagttatctgaaacagtttctgaacatgaaaggatataataaattcaaggcatacttcttggataaatccttctaaaggacttagttttctaaggggagttttggttaaaatccaaagcaaaccaagcagagaactacccttttattgttctatctgtccacaaacagattctgcttctgcggtatccacctcagaatagcttaaaatgttcttaattatgtcccttagttctgttaaaacaatcacaaagcttaccaggcttttatttttgaaaatagatttacatttacatgagttggataaaaaaaaattgtgaaaatgaacttcatccgagctgtcaccatcaatctttattatttttgaaaacaattggccagatagaaatactggtaaaaattactgagaatgtcttgaagtgggtttttgaagattaaccaataagatcagctgcatatctcattacctaacaagtcctcctatgtccattaatctacttatgtatggatagataagcgtttatccacttattcatgcagaaagaacttatcactgtccactatgcaaggactggttttcagtaatagtaatataggatagtattagtaataagtcatatctcaagacgtgtcttgaacaatttgctgaatttctagaagataatcggcaatgtagtacagaaatgattgtaattgtatctaccgtttacttctatgaatgttggccttgtgtggaaatagacaaaaatagatacctgtctctgacaatgaagttacaaaattgac

SEQ ID NO: 64679 - DNA, 1063 bp, Homo sapiens
ttcatagactatatgctaactcagacattttgcaccaagtagaaaaacaatgggtcatgaaatacaaaccaaaacactaatttcactagaaccaggggttgattcaaggtactgtaagaattctcggaatttaacacttttgatattttttcatttcagatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgt

SEQ ID NO: 64680 - DNA, 1003 bp, Homo sapiens
gaacctgagttggtggttagggaaacctcaggaacattttaatcacattgggattcagaagagcaacagaaccaaaggttgtttggtgtgttcatacaatccctggatttataggtggattttctataaaggaaaaatgatgtaattagtatcctgttttttcctaaagaaataatactatcataaaaattctgtctatcctttgtaccccaggaaaatggacatgaactttgaattttccctttctccaaatgtttgactttttattttcactgataagcattatgctatgttcttagaagacaaaagcagctcttgccagttttgaataatttctgcatgaatagaccagtaagaggtaagtagccatgactgcctatatgtgttgagacataaggtatatttctttaacatctccaagcaagcatttcaaattctcttaactactaaacatgctctaagctaattcaaatatagtattgtggcttttttcttcaattttctcaaaagctacagacacaaggcatttgtatgtataacagactttgatgaagttttggttccagtaactcaaaacactaagtttcccatttgatatggctttttattgttctagtctccctcttctagttatgcttcatcttgcaaatattgactttgaatgtgataactattgcctacaaattaagtattcatacattactcctgtggatatcatacttttttgttattatatcctgaattgcattggctttttttggttttgttttgttttttgagatggagtttcactcttgttgcccaggttggagtgcaatggcacaatctcagctcaccgcaacctctgcctcccaggttcaagtgattctcctgcctcagcctccctagtagctgggattgcaggcatgtgccaccacgcctgactaattttgtgtttttagtagagacagggtttctccacgttggtcaggctggtctcgaactcctgacctcaggtgatccc

SEQ ID NO: 64681 - DNA, 1039 bp, Homo sapiens
ataattgagtttggactttattcttcatagatgtccatagctagattttctaacgcaaatggcctttgatatcccaaaaatttacatttaaatgtaattattttcaaaatgatttccttatttatatgaattgcattaatatatttatattaatatatgaaaactatcatatcttctctaaattcagatactcttttagtaacatccttccttttaaaatggctgtgcattgtaaaatacttacagatgtgaagcaagtttaggggaaaatttgtatagttacaaaatacccagtgaagaaatgatgttttatgtaaggctgttgtagaaacactccttctatgttaccaaaaataaaccaactccctacccccaaagaaaaacctagaaagcaaagatagacaaaaaaatgttttgcacactggacagatttttgttgtctttctgtttttcttatcaaatttcttcaaggctgcatctcggggaattttagatgttcaatctgtgcaagaaaagagaaagaaaaaggaaaaaatagaaaaacaaattgctacatccgggcccccaccagaaggtggacttagggtaagtattaaaattttcttagtgattaacttaactggcattttaaaaaaacttaagtagcaatccattcataattttctcctgaaatgtattatcagaaaattttgaaatagtttaaaagcatgagtagtaaatattggaagtaataccaatttattttaacatttattggaatcaattagcttttttccccaaaatgaaataatagatttattattttaacactatatatattttaatactcttatgcttactactaatcttaaataattcaaaaattcaagcaatatggagaagtataaagaagtgtaaaagtcatccaaactaagtaccattttgacagacataatttctaaccttcatttatatatcttattaaattggattacgctataagttctgttttatggcctgagctcttttacgcattgatttggaatctttgatctttcca

SEQ ID NO: 64682 - DNA, 1085 bp, Homo sapiens
ttgatgtctctctgtgaagaatggccataagccaacgtagccactctctaggacagccctgattgggggaaatttaggttcaggtgagacacaatgaggagttaaaacaaaaatgtataaaatagcatatgtttgttacttacagatcccagacaggatataggggtgccagtagagggctgacaggaaatctgcaggaggctgagagctcaaccagtgggtggcaaacatgagagaggaaacacctgtacaactatgtctttattaaggtacgtggcattatcccttaagctttcccagggggttgaagataggttcgtttaaaaaaaagtgcaggggtggatacttatttacatgactctggcataaaccattaggttttaccgtggtcaacacctgtgagatctgttgggctttgggtctgtgggttaaggaacaagtgggttatgtgtcaatcacaccacatggggagaggaagttttaactaggccaaagatgataaggtatgactgagtttcagacaactcatgttaggcctaaaaatgaatgctgaggcaggaaatatattaaacaaattcatgagaatgagataacccatattttgttgatggtaaagcaaatttaaaacttgactggcttgaagtacacaataaggaagtaaattcatttgtttatctttgttgcttctctcttggcatctcccaagcttaatattgctttgtacttggtggttttactcatgcaaatagtgttgttaagaaatgaaacctaatactttatatttagaaatatgttaaatatacacataaatggagaaaatattcagtggtgtgaccttgaaaaagagactgctgttttattgttagccaataaacgagtggtagagaaaagcaatctatgggcatgcctttgattcattgaccttaaaaaaaaagaaaaaaaaaaaaacttatgaactcaggattaaactaaaggagataattttgaggctttgcttaatgtttctctgcttagcacctgtcatacttctaataatttgagcttagggtttaattacatagcacctgtcatcatcacaatacatt

SEQ ID NO: 64683 - DNA, 1030 bp, Homo sapiens
tttaaagaaaaccagtttgcttcccagtattataattagttgctctaaatacagagcccattttaatatttgtggttagctctcaacagttcaatacaaattatgcatcacagttattctttaaattcttgccattcactcttatgttgtgatttagtcttctagagaaaggaaattttctaactttggacacttaagtagatgacagtcaacacatgcataaataataggaaatatttaaacaatagaaatccagcccacagtgattttagactgtgaacatctctagagttccaaaagtacatttgctttttaaggatactataattaaattgaatgaaaaagctctatagtctctagcgtccaaagatttaatgttcgatatctaatacagggtcaaaaagccattatcttttcctttcatgaaagtgttgattttgatagggataaatttctttaaaaatagttaacacacttattacaacaaaaactggaataatcatctatttcactttagctttgaaacttctgcaatgcttgtggtatgtgaaaactatggttattaaattttaccagaagagaatgctgggcttgaaaaagatgaaatatttataataagtagcatatcttattaatgtgattactctgtaggaattcattttactggatacccagaataccctgtgatattgaacaaatatgaaaagcaatgcggtactatcagtgtcattttgcaaagaagagaatatgttttaaagatctctaacagaaggccattctgtgtataatatttaacagttcttataggcacatggttattgtgcagattagaacctaaactgagcagctttgaaaggacagttgtgttagtagggatgagcttattgtcctgctgggaaaagctgagtagctcagccatggccacctgggacagtgggttttctggccaaagacttctgttaacttagtttcttagtcagtagtcctgtatgtgaagcaaatggtatttcacatgtttagatcacgctgg

SEQ ID NO: 64684 - DNA, 1053 bp, Homo sapiens
tgctggtatttgtttttctcacatatctcaaactatttattcattcagcacattattttggctagcactgagcaagctgctgagatataagataagtaacaaactaacaaactcactgccttgactaaatttacagtcagtataggagtcagacatgaaatctgtatattcataacaggtattgctctcagcttctacctagttttcttgccagaaagctcagattctcagttctgagtcttcctcttccttattcctccaaacttttctcaagaataatactggatgttagtcatccaaaaagggtcctgttccgcttttaaagggaagtctatttattctagagctctcactctcaaatcactcccaaatggtgtctttgtttaggttgaatctcagcaggacagtgtccatttgtctactcttattcctgaacagagagggttctcatccacaattacagttcttttagtccacattcacattcttaggatttgtttcctactgttaaataaattgccaggacagcatgatcaggaggtgtattcaacctcaattgcatgttgttggaaccagtcgtccctgcaaactgctaccattgtgttgaacacaagttaccagtcttgactttctctgtcctcccaactgtgtacctctgacttagtttcctaacagtgaaaaggttaaagctaccccagttttccagaacagatattattagttttgaagccgagttgggagatttttatatcttccctctgaaaaggccatagaagccttatgaaattttacccaaacctctgtaaaaactctgcctatgcaagcaagggaaggtgctgcaaattaagaaaacaaacaaaaaaaaattttttatactctttccacttgattaatacttgcacaactgagagagtacttcagagactgcacaagaaagatgatctgacccagggtgactttcaatctacacttactaatacaatgcttaaaattctttaataggataacctttatcatttgaaactgtgataagtggctgaaaaggaaagtaaa

SEQ ID NO: 64685 - DNA, 1032 bp, Homo sapiens
aaaggaaagttaaaatcatttatatttacctttttggggatctgacgtatttggaaagagttttgaattattggtgaattttaaggtaggctgtagagttgttttttcttgataaggggtaaacccagtgaagctatcactgtttgtggtaagccatccacttggttccactatcaagggggtcacagatggagaagttggttctgaagagaggatgctaactgtaatggaactgttatcaggagttttcacggtgtcattgaccaaagaccaagtgaagttttctgaagacagagcaggtgtagcattgggatgtgctgagatgggcaaaagatcttcatctgctataggtgcattccaaggcactttagaaacaaagctatggatcaagggagggcttgtggaaatggtagatgtgggttttagactgcccaaagaatgctctgctgatgagttactggagaaatctgttattccgtggctgttgttgggtagattcaaaggaggggaatgactcgccttgagatttgaggtggttatattttctttatctgagtttaagtttgcttcactttccaaagaaataggtttattttccattgttttaaaaacttctgcaatgttctgtgttgtgtttatgtcttgattttcttttccatggctccccgatagaagtgaataaaacaacgttgaaatcaacagaattttggctaaggccaacattgtaggcttctttggtattggtttttttttaaaggaatctgaaagaaaataaccataatttgaattccttaaataaaatactctgagtttttaaatggatctatatattttaaagtgataaaaatctagacataatatagagatggtaatatcatatttttattccaaaattgcttattttggattatgtacttaaattagtgccattgagtactgctttccacgtaatctttcttccttccttgcttctagggaaatgccatgcaaaaacttcctcaagccacacactgctatttcaaagaccattta

SEQ ID NO: 64686 - DNA, 1038 bp, Homo sapiens
aagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgtaattctcagaaccagtctcagggagatatatgcttggagaactctgccttccatcaactgcagtgtaatgggaaagagggtggtgaggttttgaaagacagatttccatgtaaatgtgcacaagccaggcatggcttaaaatatcatgcagtcttcactcacatactaatttgactttggaaagtatggttgagttcagatacttataagaaatgacttaaacaaatccttgccttggctgccagaactctacatcccttcagtttacaggttggtaggaattgcccatgtctcttgctgagattatggatctgtgccacaggggatttatgctgctttacattgactatgcagttgaagagttgcacatcacctttagtagtcaaaccaaaaatctaagattccaaaaagaacagcattcattgaaataatattccattgcattggctacttcaagtctcttttacccctggcagagccagttgcagtgcaattttttgtactaaatgccaataaagccacatacttataaactatgaatggctattcttatatagtttagaacacaactaatccatactttattgtggaaggctgttttatagtttatttaattttttctctatgatttattacaactctcacggaatattaacttgaaatgctgtaaatacgttggttttccttgtccctttgcaccttgacagtacgtagtatacattgtggtttatgcagctctgacaccagtttttgctattgtaatatgtt

SEQ ID NO: 64687 - DNA, 1073 bp, Homo sapiens
cagaagaaacatggatagatgatagctgtttcattgtttgtttttgtcaagcatattcactttcctccttgtcctctgattctgagcaaagggcctcagactctgaacttccctcaagtgccgttgttatgtgaaactcttccattcagattccagagaggttctcatgctcccccccctccttatttgtagcaatcgtagcaactaattccactaagtacaagggagttttttacactcctccatttttatagcatctgcatttctttttctttgttaggtacatgtatacacctgcctgagtataaatactctctctacctaataataacatcaaccaacatcttttccaaattagggccacagaacagcaacatttgtctgacagtagtataaagaataatgatagctctatccttaagaagtatttcctttcctttttatatagtcccgttagggtttaaaaccatattgatcaactagaaagaaaaatatgaaaagagaaaaatattttaatttaaaaattgtaatacattgatttataaaatgccttctctgatacttttgaaacagatgtgaaaaacagaaaaagaaaaaattgtctgaaatgtttattttgcaaaacagtgcaatagaatctagttatgccttcatcactgttgacagtaaatactgacagccccttgcagtgtgttagttttagatcactctgttttagttgagagaaatgttttatatcatggtttttatatgaatacaaattatttctcaaagatttatagcacacactattctcaggaattctgtattacatgaatgctgcttatatattttcatattctaacttgtcttttcaagcaaataactaatatatatgtgcatgcagtctgccttgacaagttgttccaagctgaagagctttcactgtacaatgtgtggaaaatcaccatagatcatggctgaaatagtttgtaattgtctgagtctgtgcacgtacttttagataaaatgctgctgagtgactgcatgatgagatacaacttctgaatgctgcacattcttccaaaatgatc

SEQ ID NO: 64688 - DNA, 1777 bp, Homo sapiens
atcttggtgaagtgagtgttggcatatctatgccaagtgggttgccagtgtctgaaagacacattcctgctgtcaggattaggcctctctcatatgtcacgaaggtcatctgttttagctactgagcatgtcccgctccttctttttgtttcttgcttgaaaaaaagagtaataagcagtggctttaacccagtaattgggtagtaaagttaaaagtttaggtgggaatactaaacatattgactagaagttaactgctaaaataatggattgttttattaattttttgcatttttaatgagtttaattctaacaaacagcatatttgtctgcaaatgctgtacttaagtttctttattctttatgctcatatcatttttataaattatgaaataaaggaatttttgtgtcagtagtgactgaaggatttggagatgatatgtaaaatgttcttccttcaaatgtgtttattagatggcagacatcacaatactttaaacacttcatatacattagcaaaagaatgctccgtaactcataatcacaattacagtgatattgtgaaatcttattgacactgattcagaatttctgtgattctaaacaagaaccttgatttactataacttcatatgaaaaataaatgtttttctgtaaacttcagtatctgacaagaggaagctagtacacaatcagtagtttcccagactgagttaagaaaatgaaagttttgttgaatttaaggatcataaaattaatttcttagtaaaaattttataggagtttgatttacataggttttaacactaatgttatttggattcttagaattatcatttatgctttaattttaactaaatatttactgtatttggaaagtgttacttatttgaaaatatcaaggagtttaagtttcaaataagtcacattggcttattagtgataatttgtccatttgacattttaacatttttctagaagttttaagtggcttctttgatgtcaagaaagtttttccttgttttgatctgatttttcaataattttaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaactttttaaggttgatcttggcatgttgttttgcagaataagtggctgaatatgtaagaattgtgtttgtatttagcttgtattaaaagtacactgtaataccaataaaactaacaatttttcttgtattgttttatattgttactagtttacatttatgaacataagattaatttgttcaaaacaagcacctctaaactgcatgcttgagtaacccttagaagaatttaaagcaaaaaaaaggaaatagaaaaaaagtttaagggatggtgggttagaatttaagtgggttagcaccctagagtaatcaaaaacagtctttgctgatgggt

SEQ ID NO: 64689 - DNA, 3333 bp, Homo sapiens
ttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaaactatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgat

SEQ ID NO: 64690 - DNA, 1031 bp, Homo sapiens
aaggtgataacgagctttctcttagcacttcctgaagggggaatagaaaggaaatttaaaataagagtttcttgtattatttggaagcctgataaatgatgcagaactggcttttgaggtctgtgaatatcttaacaatttaaaacattttattggatatgtcattttcatgaaagttcataaaacatgttttttagacagttgtaatacatagttttcttgtgtttcatagtcaaaatcttgtttttcttttctaatttttcagtaaaacagttgtaatttgtgtcataactagcatgtcaaagtcagttactggaacatggagttcagcgactgaatgagttcttgcaatgctagtttgtattatgtaggattttattgtacatagctttgtatgaatagttaacatcaccgaggtgtagtcctagctatattatcttactgaatggcctttgtcagtttctttgaaatatcagtttctctggatgaaaaatggggataattatactgtcttaacctgcttcatcaggttgcttttgaaagtcataagaaaatatataaaaaatatgtgtagatacatacatatacatacatgattataaagtatattggggctagaaaggaagaagaaaagggagctaatatttattgaagtctaactatatatccagcatcctgcttagttccttatgtgtataattttacttaagctgcacaactgtatgaaacaggcattattatccacaagtgagaaaatgaatacaggttaaaatttatacaattttaagttgctttcttaaggtaagaatagcaagttatgaaccatctcattccagaccctcagtcatcaaatacctcttatgccctagatattgtgctatgtaaattagcttagatgcaagaaaaaatgaaaaatttcatctaaatatcactctttatcaaatatttaataaaagaaatatttatagccttaccaaatatttaataaaataaattaaagtcagtttatttttaaaatagcctggtccatg

SEQ ID NO: 64691 - DNA, 1344 bp, Homo sapiens
actttgtgtaagcctgggcagtcatagggaagaagactggctcctagttgccatcacttttagaaactgataagtgacactaagaagctggtcttttcgtgatttggaaccaagtgtgttgagtttccttgttatctaggaaatatgtctcagaatgaatttactcaatgtttaaatttcctttaaggttcagtgtaagtgtgtttgtagattatttctgttttattaattctataatatcagaatttctcagggtgtgttcctgaatacggagctggctgtactgttgatgcaatttttatatcgtgcttaggaaaagaagggtatctgcagccctcctggaatgctcttgtttgcatattgattgtttgtcttctctcggggccttatcactaacctttgagaaggcaaacaatacgaagtctgtttttattttcagctttttcagaaactgagcttttcctcactgagttagcagtaccaaaggttatatcatatcatttatatgtttgaattggtatcagaatgataaagtgggaaaattcacacctgttttgaaacagatgccagctagaattactgctgtacagaacatattccaagaaatagattgttgtgaaggagaggcattcaacataaacatgaaaaaatattgctggccaagattgaagatctttgttatcttatcagcgatattgtgttactacctctaattctaaagtatagtctaagtaagtggcattctgagtgtttatttgaaagattaacatgttactcttataattgcagagatctgagtagaaacctgatacatgaaattcacagtagagcttttgccacacttgggccaataactaacctgtaagtggatgattatgcagtaatgtcatgaaagtagtaactagtgctatagaaacatctgttttaacattgtcgaatcaaaatatttttctgtttagttattcccttgtataaatgctaagctgtatttatagtaaaagtcttcttaaacggcaagatacatgctagaactataattttagcacccccacttgaacttcatcttagggatctaatatttatgatgttaatacgtgtacagatgtttttatgtgatttatatattgggcattaacttgaagtctcattcatattttagagatgtaagtttcaatgaattaacttcctttcctacggaaggcctgaatgggctaaatcaactgaaacttgtgggcaacttcaagctgaaagaagccttagcagcaaaagactttgttaacctcaggtgtgtttttgcttatttttcttttttgttgaagttatggtaggctccaaaattacaga

SEQ ID NO: 64692 - DNA, 1036 bp, Homo sapiens
gatgtaatataactgttttttaaaatgttgataagcataccatttctcttagagcttttcaacaaaagaacatataagttatttatgggataaacaatattgaaaaaatacaaatttttaaaccgtataaatacaaatttaaaaaaatgtagctttaccacttaaattttatatattttgtatatttttctatatttgcctatttaattttatatatttatgttatgtactttatatatatactttatagaaatgtatttttacatatattagtgtctatgctcaacaatatattcttgaactttatcaatcttaggcttattgtatcactgaggtatttgagaagctgacaagtcttaggaaaaaagacttgtttttcttattcaggcatatctctttattacttatcttagctctgctttcaacgcttctgagtaccactcttttaatataatactctgataacatagcattaatttgttaatttccattgttttaagggacttgtcttacaataatataagagaccttccaagttttaatggttgccatgctctggaagaaatgtgagttggtctttgacttattccttttgttgtggtgtattgttagtttgttgagcatttcgtatttttaatagatggctttaatagtaagaaattagaaattcctgtaatcagatgttcccataaataacatgtcaaattgaaccagatgtgttcatgcaaccagcatgtattaggcacttagctatcaggcatcccatgaaacgctatgcgggggggagttggaagttagtgtatatttaaaagaaatagaagacaaaaacttgtccagctattgagggaaaccagacatgaatgccagttcccatcatgtcctgtgttgcacagctctggtggaagctggttgggagatgggaagggggaggcattaattctcccattttaactctatgtagtcctgtaactttattcctacggtatttgtcatagttgtgttgtcttggttccttttctccctgcatcatcttcct

SEQ ID NO: 64693 - DNA, 1040 bp, Homo sapiens
acagaggaagaaataacaggaactggtgatagactacagaagggaggggaataagagaacattttcgaatgctgagccagtttgactgaaagaaaagacagaaacaagatttgggggcagaatgcaagttggtttcaaaggtcttgggtgtaagaaggtgacaacttgcaattaactgtgatcagactgtgtgactgtagattagtgttttcctcctggtccatgtgggaaatcaagcccagtatcaacatctaatgtcacaagtgtttttgagttactgtgaagatgatatcagaattggggttcagttcaccttcttgcatgtctaactttatggaataattaggccatgggatgtatagaatctagtccatatgtaaatatgtgagcacttattctatatgggaataaattttgcttactatcttgagttgaattatttcttacatgaataatgtttttccgcaggactttgacaggtacaaagataagcagcatacctaataatttgtgtcaagaacaaaagatgcttaggactttgtaagttggattcttcttcccttcccctcataccttttgtttatatattcacacatgttcaattttattttaaggatctactttcataaggtggttttgaggtataattacttcttagttgttgtaaaggagcagatatttgagtcatctccagggtgggtaatgtgcatttgaattaggttttagggttttgaatatatcatatacttgtgactttattttgaacaaagtaaaaccaagataggttctttcttcattttttctcatcctgctctttgtctttattctagtttctccaggggtatctctcctcatagtctccttctttcatctgcagcctaagcagagcctaactctttattcagtctggaatgaactaaagcttgtcgctttctaaaaactttaggctgacctagaaactaaaagtaaataaaggatgtaaaaatgtctccagaataaacgattaagttattaagttgttaataagtactcagtggcag

SEQ ID NO: 64694 - DNA, 2467 bp, Homo sapiens
ggtatttttagtagagatgggttttcactatgttggccaggatggtctcgatctcttgacctcatgatctgcccgcctcagcctcccaaagtgctgggattacaggcatgaaccactgtgcctggcctccttctgattatttttatctcaggtcatcacgctgatggtggaactgaggtcagctgctcttataccagaatttcaggaagccactgtgaactccaaatggaaacctcagtttcacgctgtcatttacaaatggatattcaatgaattatattctagaatgaattttcagagaaataccattcagatgatttatgtatttaatgcatcagtaatacatgattctgaaaattatttgaacttgtaagtttcttgacctaaaaacatcatggaagaagaatgatttctctctattcattattgtaagaaaaggtgtaaattcagttaaactcctacatggttttgaatgacgatatggttgataaagaaagattaccatacagaggatatgatttaaaaaaatacttgtctgtaacaaaatgccttatgaattatgaccactatttaatattttgatatattttcacccatttttttctagagacttgaattataataacttgggggaatttcctcaggctattaaagcccttcctagccttaaagagctgtgagtattgcttcattctctttatgtcttcatatccctgaaactcaccatttaatgttccaacaatgggattttagaacatcttgttccattacgtatatccataatacatgcacacaaacacacaaataatcataaagttggattgtgttcgatgacagagacaattttgagtatagattgatgtatagggttagatgctggtaaaacaagaaggcctgatatacagcgtctgcctttaaggagcttgtagtcttagtcttactggggaaactgatcatgttaagacagacagctgtttctaggtagaaataaatgctgaatgaataggataaataaatcattctggaagaatacctaattgaagtttggagttactgcagaaaacatcaccaaaaggaaggagtttgaccagacttgaaagaacaaaaatatttaaacacaggaatgagggagcatttttgtttttatttttttttttgattgtttgtatgttttgagacggagtctcactctgtcgcccaggctggagtgtcacggtgcagtggcatgatcacagctcactgcagccttgacctcccaggctcaggtgatcctcccatcttagcttcctgggtagctgggactgcaggcatgcaccaccacgcccagctaattgttaaattttttctagagatagggtttcatcatgttgcccatgctggtctcaaactcctgggctcaagtgatcccctcagaatgctgggattacaggcgtgagccactgtgccctgcctgagggaacattctggacgtcgggtttgtcatgggtagagttagtgactgtatatggcacaacagggactgtgtgtcatgagctagttgatggttaacattctaagatgcattgccaagaggctaaatacaggctacagtgagagagattttgaggttagaacacctgtttctcatggtctaaagcttttttttatgatgaagcaacagataaatgcatatgagggatctgatagataccaagctaagcagtgggttaaaaaagaattaggtatgatactgaaaaagataaaataaaattaaaatttgagatttcctatgcttttgaaaattttcatgtagtcattatcagttgtattttatataatgctgaacagcagtagatacttgggttttatttcgcaagaggataatgcatttcaaaatacttttctcctatctttctagaggatttcatagtaattctatttctgttatccctgatggagcatttgatggtaatccactcttaagaactatgtaagtatttttgaaagtttcttttaatgtataattatgtgaagctgtgtccgtacaatgccaaacaccctgataaagaatgagaagtcaggattttagatatatgtacattgtgaacatagagttaatattagagtgcttgtgaacatatgaaaattttactttttttggatattttcacagacatttgtatgataatcctctgtcttttgtggggaactcagcatttcacaatttatctgatcttcattccctgtaagtatgtgaatttaaaaacaaacctggatatttatacagttgttttagtggaaaacaagaatttattactggaactccagaaaacaaaatctttaaaatttttttctcccttgggcagaatttataattgttcttatttttgtgaatactttgccacattatcatactttcaagtacattcaagagatgaaactagttttatttttagttatagttgcactgtaattttaaactgtttaa

SEQ ID NO: 64695 - DNA, 1408 bp, Homo sapiens
aactgtttagctgtttagctgttgatatgtttagctacatcattcctttacacaccaactcagacatataaaacaatgataatagttgccaatgggagatggaaaagtcattttatgctttttttcccccttaggcatcttcataacaataaaattagaagcctgagtcaacactgttttgatggactagataacctggagaccttgtaagtatattcatattttgggcaactgcattgtgatattgaaagtataattttatacttcactgcagaaaaagaaaaaaatattggccttaagttcagctccttattaattcactttgatactggattaaattcttgctatcaaataacctaattatgaatactaatctaagtccatggctaaaaatggcaaagtgtgaattgcatattttcccccaaagaatacacattcaaaacagctcaatctacaaagatttatacctttccagaaatgttggttttgttaaatgtatgacagttttggaagttagaaagttctaaaatgaattctggatagtgttattttttccatgatctcagttgccttctaattgttaacactgggtttgaatactatatctgcttttacaagtaacaaatgaagattttatattctgctatgatacttttgttgttgtttccacgagctaaagtgtttgagacctctggctgtttcaactgtacattgcaccactatataagtaaaaggcattgtgtagctgtgtataattgagaataggatatttatttttgttcttttagcctatattagttgcctttattgccttcattcaaagataatgtaatttttgctgttgtgatgagtaaatgattcagagaaggtcccaattacatgggtgagtaaaacctgattagaatgctcagggtatgtagtattttatttgactgaattttctggttaactgtcaattaatgagaagacttaaaatcttttaggactctattatttcacttttctatctaaattagaggataggaaacatcaatggatatatgaaagttgaaaatcttgtagaggatagttccaaactcagatctcctttgctaagtgtgtgagttctagtgttataaataaaagattgaataggtttcctaatcctaagctgtgtacactatttcaattatgttaaaattaaacctcttcccagttaaatttttatttgccattgtttcttctctgttacaaaaaggaaaaggaaaccaaaataggtctcaaaggagctgagcttttaattttattttactttcattctgaaatcaatcatgcaaatcgtatgccagtgtgctctttatgttaaaagaaattaaactttaaacactctcagaactaagactttttagtacagatcactatggcttgt

SEQ ID NO: 64696 - DNA, 1022 bp, Homo sapiens
gcaaagtagcctatttggtcagtttagtttcttttttttttttgtatgcctgataattatgctctaaaacataatttcaatatgaactttgcaagtgtttttaaaaaatatatctttctgctataaagttacttcttagccaaaagccaaagatagttgaagaatatagatttggatacatgccattcttatgaagaaagagaaagaactgactttcatacactatacagatcatgaaaaagttattagatgttatgaggacttctagtaaaattaaagatgataatttttataagtcctttttgttttgaaagctttgagttgtgagacttgaactgactcatttcactagaatttgttactgaacatggttgtttttgtttctgttaggcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgtaagtatctatcccttttaattccatatatttgtgttaattggggtacaaaaacagatttcttctgacagattattatcaaggcatctcgctgaatatgctcctgagtagttagtgctttgggagctgcttttgtacaatattaaacagaataggataatttaaaacattaccagctgatgataattgttgaatctccctaagacaaatgaccagttataatcatgagaagaaattgggtcattcagcacacacttatacagcttttacgtgtgtcccagcagcgtattcaatgttaaaagaagggaagtcatttcgaggtgtccatagaagttagtcccagggatatttcgtgttttccacttgttcagagagtatgtgatgcagtgtgtttttaatcttccaagacataacaa

SEQ ID NO: 64697 - DNA, 1038 bp, Homo sapiens
tttttctcatttaacctcttatttaagagtttcatttttccatagttctttttaatccctacttatatgtgacttcacaattttttggaaatttttagtacggaggaaattgtatccatgcttttattgttgtattatgctattttgtatagaagatagctttattactgtcttagctcaaaactcacctagttttctagcagtaagttaaggctatcttttttccttgatgacacagaattcacaagagtttaacggttgtatacagtactgaatttatattaaaaaggcactgaccactttccttgttatactattttctgtatcagtggaggcattgtaggtatttggaggtgcattacatactattttattgaatatgaatatacatcatcagcatgataaaataaacaatttaaacttttcagctgcagtaacactaaggaacttcaatttgtaatgaaaatacaacccaaaccccctacctggcctatagggacttaaggaatgtggaccctgtttgcatcccctgccacatgtgtgtccctggtccctctactcccctcctcctgtgttttaatcactcttaaccttctgggagttgctggatcatactaagttggtttctgctactgggtctctgacgtggctctttcctttgcctaaaacactccttgcccagctcctactttgactcattcttgcattttctttaggtctcactttaaatgtcaccttagaaatacttttcttgaccaaatgcgttttgagtaactaccctcctcctcagagtccctcagtctttaacctcagtgccctgtttatctattccagaggtagtttttagagtatttgttatcattttgtaacgtgtttattgtgttgtatgttacctccgccactggaatgtcagtctcttgaggacaggcctcatgcctgttgtgttaactattttatcctttgtacctaacaagatgctcaatttaactgcgttgagtgaattgcaggtaattatctacaagtataatttagctacat

SEQ ID NO: 64698 - DNA, 1063 bp, Homo sapiens
gctgacttcacacactctctcacctcgggtggatatacacaggacaagtcatctgacctctcttggacctgaattcatcaggcattttaaatagtcatgttttcttttgcttcttaagaatatattttacttcaagaccttcatattgaattgtcattttgtaagatttaataatcaaaatactcaattattttgtctagtttaaagggtaataaagagaagactaaaatctcattttcaactgtagaacagaaaaattaccaaaaaaatacaaatattctctctaatttgtggtcaataagtacattaaagtacgagacatttattggtaatgtagatgatttaaagtgatgtttttcacagaaatcataggtttctctttcatgttttagaaaagcatactgtgcttatcattcatggagcaaattgcttagtttaaattatctccaaaattgggatgagtgtatggagtggaggtaaaacaaacttttttttaaaggctttgggatgttttcatatacatcagaaacacaaagagctgctctgtgtcaggcctgttttctttaaggaggaaatgttcatacgtttgttagtagagtgggtgcagtggtgaagttagatagagttaaagttctctcatggtgtaaaacagtcttatcagcacttgagtcattttgaaaatctgttcttcagatctgaattacatgaaagatttcattgtggttttgaatagtgcttaaaagaagcaaagttcattagggattgaaattgaccagaagtggtttgatgcaagtgtatgtttgataatgactataaaatctgaaagccaattgttgatactaataaaaaggtagcataattgcctcccataaagttaaaataactaaaacattacctcagcagggtattaaaatgacatgtcataattatctccattagaaattttttaacatcagattacatttttattgactattaaaagatctcaaagattaactttcctaggtttttctcagttttaaaatatgtttataacacttacattattggtaagttagaacag

SEQ ID NO: 64699 - DNA, 2090 bp, Homo sapiens
ggccttgtctgggttgaaagaactcaaagttctgtaagtaatgcaattttagagtttcacagctggctgtgtattttctttctgcgtagtcaacatgcttggaactaggttaagcacagtttcttttagttcaggattaaaagatttaaggagtggccagtgagtagtatgagaggccagagtttgatttaggcaaccctgcatctagattaacaaaagttaaaactctaaataatacgtattctgacctccagtatattacggttgaatgttaggctttttgggtgcctaatgcattggagcaaacccttacttcagttttactggtagggttttgtttctacttattttatagctataagaactttgaattacctgactctaaaagggaaaaaggcttacaagtgctccaaatgttaaaataattttagagctcaagggaattcagatgcctacaatttgtatagccagcgaatggtgaggaaataaattcttggcagtggtcaggagcctggagtatggcagattaggaaacaggtgaactgactgcccccacttctgccactaccatgctggatgaccttcagaaggtcattagacctctctggttcagtgagctaggtgggacctttatctcttctattctgtggttatgactcacgtcaggcagtcattttattaatgtgacaggaatggcttcaggcaaaaaaatcaaaagaatttcattttcagtatggatctatgcatctatttggcaggccctaactagtagatgatcaaagctctatttctcttctggccccacatgcattgaggacatgcctgctgttccttaagagcttgggatctgccatccgcttgaaaaaattggctttacctaatgtccatgtttccgggctctgctttattccaatttgaaaaggcattaggaattccaacggatttgcttattatacctcccagttaacttgttatagctcctaattaacattaactaatagcacccagggtgatgaacattaactagtgtgccttaattaccagaaacaaaaccacccttggaaacatggattacccagcaagtctgtattagggcatggcttgggatagcagtatagatttcctttctggctttacaacaagtgcttcttgaagttttgcaattctcttgtcttagatgctttccacctccacctcccccccattttcccattggaaatattttttgaaaaaaaaaaaaaaaaggctctgaatttttctaagaaaaaatggtaactatcacttgttactcactaaccaaaaattttctttcagaacgctccagaataatcagttgaaaacagtacccagtgaagccattcgagggctgagtgctttgcagtctttgtaagtaacttcttggtttcttgactcaccaagagactactctggctgttaaagatgtaaataactagaattgtaaggaaagaggagatttatcctttcatctgagataaaaacagagatagctagtcaatgttatcaaaacgtcctttggtgagggagaaggaggtggttctgtttacctcttctcttgtcttagaggctgagagaaagctactgggtattcactgctgggtgtacttccatgaacttgtgcactgctggtgatcagcatccctttggaaccagttatgtgtgtacagaagttttagtgtcttgtgccttgactgtcaagaaacagccacaaagaggtttctgtttcgtgtggtaatgataatcagaacaaatcgattgtaattcctcaattttgtcaagggaacttctcggaaaaaatgaaaaagtattcttcaaaacaaggaacttcattagcttctactagaataatgaatacaaatttgcattgcctcacttcatgtcctaaataccaaatgcaatgggactctggggcatagtttctctaagtgtggtactttgaccacactttgcaacagactcactagggggagactgctaaaatgcagaaccctaggctatatcctagaagtaatgctggttttctttttaaaggtagaattcagaagtctaattttaaataacaaataatctcc

SEQ ID NO: 64700 - DNA, 1023 bp, Homo sapiens
tcgttggcttgtatttcaggataagcctcatgcagagctcattttgtcatttatattaaagataaatagaggagaaagagaatgctttttgaagttaggtgactttagttttctcatggtttataaaacgggcagagatttgggaaaaggaagcaaatattttggctaatgtggtcaaacactcttttctgttgacaagttaagataatcaggtgttctgcattttgccactttgttactttataaaatacttttttttttttatgagcccagcacaataggctgaactcaaggaaagcccatagatacaaggacattcacaactaatattagagacaaaagaataataagaatcctgtaacagccttactctgtttatagtgtttcttttttggaggactctagctttttaacacttggaagagcagtcacagggctatctgaggccctggggaaagatggctactgcctcttatggcttttatggtgcaatttgatcttttaaaatgtgaccttttaagcactttgcattacagctgtgagcattatcagttgaatttaatgggtgagaccggggtccctttgagattgcttgtaccaagcttgcactaaggtagactttgggatgctatggcatcggaatggtgagcattttcaaggaggagcttctgagaaagcagtttctgtttcatgaattggcatgttggtgggtggtaacagaagtttgagatgcacatcctgttcttgaaggcatttgtacttggcccacaagactaatgtacaagaaacaaccagtagacggtagcttgtgacccaagtttatgagctccgagtgttcaagcatagggcacatttataagaactgaagctttcaagaggagcagcattgcagttgggtgtttaagggggtacaaatgaggttgctaggtgaaacatttaaaagatgtagtgctttgggaggccaaggcaggcggatcatttgaggtcaggaattcgaaaccagcctggccaacatggtgaaac

SEQ ID NO: 64701 - DNA, 2638 bp, Homo sapiens
tcacctgaggtcaggagtttgagaccagcctgaccaacttggtgaaaccccagtctctactgaaaatacagaattagccgagtgtggtggtacatggctgtaatcccagctacttgggaggctgaggcaggaggagaaatcgcttgaacctgggaggcggcagttgcagtgagccaagatcctgccattgcactccagcctgggcaacaagaatgaaactccgtctcaaaaaagagaaagagagagagagagaaagaggaagaggagaaaacattgctgaggggtagataaatgttggtcagaagggaatggtggtgctcgaagtacttttcaggcaggacttgacgggagcccaatgccaggccatctggtaaccacctctgcaaagggaaggtaggaacatgagtgaatgggaggctgtggtcactgtcttctggctttattatctagtcttcaacctctccataaggggaaagggaaattgccattagtaagaaagcactctattatttgtgtgcacagttgctgtagtctccctctgctttttctgcccgacgtctcctcgcaacagctgctgaaagccactgaatcctcatgtgccctccctgctgctcagtccatatgtctaatcagtgtatatatggtatttcttactccactaattcttggctagaattccagccaaaaggctacaatgaaatttctgtaatagaccacaagaaacctaagtcccatcatttctcagagaaataacaccaattggtaaattctctatttcacacttgcctctcttgttttttaagctgcttcctaagtgaagaaactctagtgtcgctcagtgcatttcatgaaggagttaactttggcccagattaccatctgacatgtggcctagtccttcacacacacccttgaccagtgccccatatttaagacagcgcagttcctgcattttccccctgctggaagggagagcagataggaaatttcaggtcatatatgcattaagagtcaaggatattattgaaaattcttgctttccaaaaagctttccctggaaggagcccctaatgtcaatccatggtctttatgaataataaatgcacacaaaagagattcatagagacattgcacactgagccacttgtatgccgcttcctggaatggttccaaatccagtgggaaagcggaaatctagaggattactttttgcttctcctctgccctttctctttctctccattctctgtctttgctctctttgcttctggggctgttgtagcaaacagagtaagtgggagttgccttgaggtaaacggtgtcccctttgaaatcctgctagacttgttttaattctgtgtgatcatgtgcacaacacagcgtgtgttgagatactactgtggaccagtggactgatgttcccatgtttagagttcctccccacctttccttaagaaaatatgcttccagcatatgtcgagaaataaaatgtttgccctggcattcgacactttagccacgtagttctttcctgttaggagagtgagggagtagaaatgaaataagaaaagttgcagaaaagggaaaataatcaggaagctttctcacccttttagtagtaatattagctttgcaaatccagagtcttacaatggggcttagcggagacattatagcaaataccaagtgtcttgtctttgtaaggggtcatacaagggaatatagaataaagatgacctagtccctgctcatgagggacatataagatcattgaagaagatcagagcagtacaaaggaactaaaggcagaataagatgcacccaatgggatagctttgtctaaggtacccgtggaatcaaaggaaggtgatatcatgagttcataccggtggtagcgtaccctacttggacaacttgaacaaggcttcagtttgtagagggcagagttgtgggtatttcaagtgaaggagatggtgtgagccaagagtcagaggtggcaatgcatggtgtgtttggatgtaataacggtgcttagttgcaccaggggaaaagagagcctttgggaaaatgcttagaattgtgctttttcagattaagtggtttgagacaggaatcctgtggaagttcatggcagtagtccaggaggaaaaaaaatcaggtgataacaggaagagtcaaagagtggatgggttgaaaccttgcagagagacactctcgtggtctttggaaacagaacacggaggggaaagaactgatgcctgggactctccaccttcacaaacagaaaaccataccactttcactcttattttttcaccctaattatctttttcctttagtatttcacagccactggaaaatagtaaaagaatattgtttgtgggacaaaaagaaaaatataaataacaagatttagtcaatgaaaaaggttttctgagggcagccaataggtcctgaagtagtgagaagctacgaaaactgttggctatagcacagaagtgcaaacccaggcatggaatgggaagtggctggtctttgctaatagagggccaaattcctgctcaggatcagccacctctttttcctccggagttgcctaaaaaaataaaaaaaataataataaaaaacaaacaacaga

SEQ ID NO: 64702 - DNA, 1730 bp, Homo sapiens
agttggtatttactcatggagctgagtcatgtggacgggaggatatttgaacaaatataggctctgccaggaaggcgtgaatgggtgttaggtgggcaaccaacagggtctgtctgccagagtacctctctatattcacattttacccatttttatagagccattttgagccctttctgccatatgaagccttctctgatcttccttttccaagcccctcttgcactctctacttctcaccacttagcagcgtattgcatgccttgttatttcgtgcttcaagtgtgtcagtgtgtacttatcccctcaactctattgacttttctctaaggaagggcagggcctgttgtcacacttctatatgaccttggtgacagttaccacattcttgaacttgaaattgagggaggggttaagacaaaggatttcttctcattttgaattgattgatgtaagaaaccttatcagtctatataaaaacggaattctgttgaagtttgtgattaatgaactgtccttatttaaaagaaatgaaatgagaaatgtcctgggaaaactcaatacctcctttgccatgcttagggtacttagcctgtagtaaaaactcaataaatatttgttggttgacgttagctgtattttttttttaaagctggaacatattatttcctcacatgggtggatattgcatgtgtttattgccagagggtaaatgactaggttgtcaggataactttgctcaggaagtataactgttgcctgggtttttactgatttacctctaaaataaagtattccatgggttcctgtaagaagtgggagacgcaaaggccaattcggtgcaggtggaacttaaagtttccgtgaattgaatataaagctctttagtaggtagaagagttctagatggcctataaaccaagttttagcagaaacgtacttattttttgttaagcattactgctttcattgttgtgcatttaaatggaaatatataatatgaaatatgtgtgaaataacttctcccttctcagcaaatgaaagctattctaaaaccttgagaatttccataataagggtttcttaattcatgtatattcttaaaacatataaaatttttacatatactttcataagagttatatgaagatgcaaaagtcttccctagtatgtgaagaaatggggtagtacatcattagttgatataggactgttctgatgtgctttcttagatgaggtttatactgatagcaacagtgtcgaagcagaactataaaggatgctattagttgttagccctctttattcactaagaaagtaaccatatcctccggtcctcttgaagtcaacggtagaaaataacacaaaacaggccaggcgcggtggctcacacctgtaatcccagcactttgggaggccaaggtgggtggatcatttgaggtcaggagaccagcctggccaacatggtgaaactccgtctctactaaaaatacaaaaattagctaggcatagtggcgggcgcctgtaatcccagctactcaagaggctgaggcaagggaatcgcttgaacctgggaggtagaggttgcagtcagccgagattgcaccactgcactccagcctgggcgacagagtgagactccttctcaaaaaaaaaaaaaggaaaagaaaataacacaaaacaacacttttttgtttctaggatttacattagtttatttacattgtttt

SEQ ID NO: 64703 - DNA, 1795 bp, Homo sapiens
gtaaaaatggttggtttggttgcaattttgaattattgaaaggaagttatggaaaagatacgcagagcttagggctagactaaggacattttggcagactgaaacagactttaaactcttgagtgactcttgaagtttttttgagctagggaatgatttgttcagatatgaccttcaataaatgtagtctcatagcagagagtttgaaattgagagagttcagggagaaatgaaaatgccactggcaatcgtctaggtgagaattatgagaatccaaattagggcagatgggaggcagggatagggaggagggcacctattcaaaagatgttatggaaatagaatcaagagaatgtcttggctgggatgataggggtaacatcattaacaatgaattttaagattaccaggagtctggtggtgctttgacgaaaattagcaataatgcagaaagagaaatttttttagaagagaagataattaaatgctgtttttaacatacatgtggagttcaggtgggatatgggtggaggcatctggaaattcaggagtggagtccaggatagagatcgaagggcatagattatagaatagtgtatcgtgggtatagatttaggagtcttttattttgaggtcattactggaaacattagattgaaagagcttgccaagggagagagggtagaagaaaagggaagaaggccaaagacaactccttgggaaacacttgaatcagggtgtgggaagaagaccaagtgccggaggagcaggagaactggggcagaactctgccccaggagctgtgggaggagaggtttttcacaaagaaatgagagatcaacactgacatgctggagaaagatgcccatgactagtgagaaagggccttgacttctttaagtatttttggaatcatttcagtaagttgttgaaagtgactttgggtaaagaagctcatcaggaaacagacatttggggactgctaataggtggtttttggagagtggttaaagcttagaagttgtactgcatttgactggagtctattgggtttaagagacagaaacccagctgaggcataatagaggatttattgttgcatgtagatagaactagacagtccagaagtggagttggcttcatatgttactggatctcgaggcttaaaagctacaagagttttctcatgctttccatttcttagcttcagttgtctctacttttgtgttctggcttcattctttcctgttgcaaatagcctgtctccatagagtggggaaatacacctttcagtacattgttgcttctaggcacccaaaataaatatctaaaagtgttcctcactgcaaaactcctagggggatcctgattggccagactgacctcgtatgcctgtccttgcaccatcactctgtttgagatggtatggtgcaacctgggttttggactcatcctaataggactgcttagagttgggaattccccaaaggaagcagaagaaaagagaaaggaagacctgctgggcagaaagaaaccatagttattcactggccactaggatctagggactaggcatactgtgggaaacatttgtttaattgggccagtctgaaatgaacaaagtattattgaagaatcgtaagccctcagttgggcttagatagtataaatttgtagtgaaaccaactagatctttaattttgtcccatagtgcttagcagcccaggaacgaaggtgatgaaagatgtgatggactcaaaatttggatttgataaatcaggacttcataggagac

SEQ ID NO: 64704 - DNA, 2674 bp, Homo sapiens
gttaatgaggtgtgctttacaagatgtgactgggtttggcaaaatttgatgtgatgaatgtttaaatgtgatagaatgcttggggtattgggagaaatcacttcccaagaatacagaagaagtatgtatagatacttacacatttccttattctttcaataaactctgaatcctactctatgccaggtggcaggtgctgggaatacagatacaagcatgacccatcttcaaagttgacagaccctctagagttgtgctgtccagcaccgtagccactagccacaggtggctattatgtttagatttaaaatgaataaaattaaataaaatgaaaaattcagttcccttagttgaactagccacatttcacgtgctcatatagctgcctgtggttgctactatattagacagtgcagatgtggatcatttccatcattgcagaaagttctattggacaacattgatctagggggagaaatgaaactaacacttgttgcatcatagtgaagacgtgtgtgcagggaggaaaggcctaaaacagtgtattttcttaagactgtaggatttgggatagtcttccacagtagcttctgctgagtgttgaaggacatgtaggaattaaccaaatgagggtagtagtaagggtgttgtaggaagaacttcatagtatgtggaaggcatggacatagaaaatttcagaagttttaggacgcataaagttgtgtcttgttatgacaagactaaagggtacatatggaaaaatgtcaggagacgaggccagataatgaagggtcattttaagataagaaatttagacttgttctgaaggagtttaatttgatatttggggagtgataggaatgagactagggtttttgccctgaataactgggtgccatttgctgagaccgggaacacagagagctgatctatttgggacccaaagaattccatttgataaagataagagtgtaaatagtatgtgtttagagctttacaatgaacagaagtccattcccataactctgtaaggaaagtcagtttcacaaaagttgaagctgaactgacaaggttaagggccttattggagttcatgagcctggtatgctgttttgctgggacttgaagtcaggcccatagagcccagttctttctggaacactgtgagtgatgtgctgggacttgaagtcaggcccctagagcccagtgctttctggaacactgtgagtgatatgtatttgttctcaggaaaatattccatccaactttttcagtgaaatgtactttagatactattgttgccatttgttttgttttcacatttaacctactttttttcctccttctttttccaatcctgcttcttctgtatatttaacctactttttgaaagttttatagttcataaatagtgttacctagtgattcctgctctcccccaacacctgttgggaatatagaaacatagattgtggccccaaattcagtacatgaaaggttctgaaatctttgcactttactttcctattctttacaatggaacttctcacagaactaccgtaaaggaaatatgggataatttatgtaaaagtgatttgtaaccataaaatgctatgtcgccgtgagaaattttactaatcatcttaaacattgcagtcttccttgatatcatttggaagagagatggttttgcttgggggtagaagttggagtttctgttcacaatgtaaaaggaaagccagaattttaagaaaacattcacttagcgttgacaggctctgctgcctgatgtgacgttgtcagacatgtttttggctctcctttaggcttgttgggtattggtagtcatttgggggatggctgaaatttggagctgtgaaaatgttggagttaggaacagcagaaaggaatatccagctaattttccataagctgtcactgaaaaaattgctgtggctgttactttgatgtggcaacagcagtagaagccattgccagctttggcacttggacagttattgtttaatgcacactatatgactaggataattccagttgtttcaaaacatgatttgactttggaagacttcacaatgctaaagtgaaacttaggtctctgaatactaattgaagattacctgtcattttgtttcatctgtaggacagttaattctaaatggaattactactttaccaaacggggctagtaaataatttaaacagaaaggtttaaaatcaaataaaaacaggggtgggtcaaattaaatagttttaaataattgaattacatatttatacacacacacataacatatgtcaaatacagctattcaattcatatatgtaattcaatccatgataataacatatacaaacatatttaaaacattctgcacacagatctatataatattctgtatcaaggtaatttcagactttcaaaatattgcaagcataatttttcatatacccttcactccaatttcccaaatgttaactttctctctctctttctttccacacacatacaaaatatatgtacatttttttctgaaccatttgagagtaagttttagataaatctttaaatattgcagtgtgtagtccagaaacacaaggatattctcttgaataaccacaagatgattgtcaaactcagaaaactagctttgat

SEQ ID NO: 64705 - DNA, 2105 bp, Homo sapiens
aagtggagtgtggcagagaaagccagttcaaaaggcagctgccagggaggagggaaatggttaataaagtattttttagctgtttgaattagtgaattgttgagttatattgctgggtgagttttctttctgcggacgctcttaagggaaaactggaaatggaccacatacctatcatgtacgcacttgtccttagcctgcatctgttcataggcggaacatgaaatccactgacaactgttacctggaggacttttataggttttgaagaaaatatgactagggtagagctaggacatgcttttattgtccttgagtgactccagaagccaccctcacctataaattctacatatcgttcctagggtattcatttgtttattttgatcaggtataggtagtactgtgaataccagagcactgggaagccaccctggcccacttattttaggtggtttgagacttttttccaaggatacttaagaggggaaaatacaggatctgagtacatttctaaattatgggacataatttataacagaacatttaacttttctgtgttttctgaatattgcattctgaagccaaattgtgactgtttctatgtgtcttctatgctctttcacaaaattgtaacacctagttagttttctgttggattaaatactttaagcttcataccacttaattaacaatattcttaactttacgttttccagggatatcagtatgaacaacattactcagttgccagaagatgcatttaagaactttccttttctagaagagctgtaagtattactttgagaaatgtgtgtgtatgtctttttccccaattcattttggaagcttttgctacagagaaagtctgatgttttctgttagacattctgatagcttaatttcagtgggctttgtgaggaggaaatcatgtttcttgggggaagtaaacttggttttctaagcagcatagttgctgaagctatttttgaaagccataactaaaaaaatgctacttccataggacttcttttttgctgcaattattataactacaaatgctgcagtgacaccagttaattacagtgttattctgagataacaaggctgctgtataattaccattgttaccaaggagttgctatatgggtaacagaaccacaaaaaataacacaaggtgtttcagggccatgagcaacaatttcaacagtgagccagcagaaaactgagggtaggtccccttggacaattgcagatgacctttggaaatggggtgaaggcatgaaacactgtctaggtctctaagagcacctttaactttaagaatgtttctgaacttgtcagttgcatctcacatttccaatttaacagtttgcactgtggaaatattttctccttgtttcaacctcctttttgttgtgctctccacacttttttgaagtccataatcaaaataggcactttcgggttttaaaagaattgggaactatatattatattttgagaatcccagtgaaaaaataaaatcgacttgaattaagttaatataggcttctacaggccaagctaatggattatataatatatagaggtaggaaggtgatggtttgatactaagaacatcaaagagatatagccctgaaggaatctaaattcatattacagattgtgtcatacagcccagctgttgagtattagatccaagtcagcgaatgtcttccatcttttagctcggccactcccctagagaatggggaacaggagtctaataagatatccaggttatgtactctgatagaatattgaaatagtagttaaagagaaatgtttcttcccacactacttagtcaaacataatgctcccactgcaaaagttgaacagagattatttgccacttacaagtttatgagctaggtcaaattattctctctgctcaatttctttgaaaaaggtgcagctaataatagtccctccctcatagtattctagagaagacagagtgaattcatttatgttaaatgcttaggacagtacatgaaacagaatgaatgttatataaatgctgactaatgtttattttactattttcaaagtgcataagaaa

SEQ ID NO: 64706 - DNA, 3796 bp, Homo sapiens
cccatgatgtatgggctgctaaaaatagcattgatatatattagacttcagtgtttacactttcattcaaaggtattttcaaggaagatttttttcattttgcaaatgaagaatcttttaggtgtcaggagatgaacatgttcagaactatacgatttcagatttgtaaaaatatataccatacatagaaaaaaatctgtaatgaaatccatgaaatatggctgtggttaccagtgggtgttgatattgtggatggttttctctgtatttcaattttttaaaaacaacagtggttacttttgttatcataaaaaggtggggagaaaatgagattacttgccccaaaatatggaatagtgtcagaaatcaaattcttaatgaactttgattagaactttggtgttatgtgtgtctttactacttgtggttgagagagaccttcccttcaaatttgttccactggaggcattttgcaaagttcatttttagttttcagtttttggtcatattgtagacatccgttaactggagattggcctgaaatttctggttgattaccaaagaccctggaaaagtcattgggagagttttttttatttatttctaagatttgaaggtgacattcttggtcattatcaacatgtgttttttgagtttatggacatcaccatcattttttttttcttttcctagagaacattttagagaaccctgtgttctcttgaacctgtatataatttagtgactttttaaactgccagataatatttgagataaaattaacaatatagtagtagcagtacagttttatctaatacaaataggagggcttgttcaaatttagataacattgggtcaatcacggtatatttaaaattaaataattctgtggcagaaggcccagacccagtaaggatgcagtgttagagtccacagtggtacatgcttagccatcagcaaacaggttaggcttgcttagggatcattttacagggatcttaaaaggtaccttgttgaaacatgatattctttactctgtagatactttagcattagtgaattttatgggggaaaagacgatgagagtttaaccactggagagatttggcagtttcaattaaacagttgcaccctttaaattttaattttgaaatcaatgactgctggtatttgggagttcatgtttatttttctaggaaggtgatgtgcttttgtatttctaatcttttgtttaaatgaagtatttgatcttgaagggttctcccagcttaaaatctttgtctcctggggttctggagtttagttttgtgtttaggaacaactgctccaagttttaggtcttctgcaacatttagtgtcttctgtaaaagtggtttctttctgagaaggccaacaaaggcagtgtggtgtctccttttagtctggtcttggtccactggattcagatggcttccaggagcagcgaaaacatggatgatgataagataacagctctttcttgttgaacttattatacatgacctgacattttctgatcttcacatcaatctataaggttcagttattactgcctccgttttacaaacgaagaagccagggcagagaaaatatcaatttgccaaagatcacacagctggtggtagtaagtccatatgtaaaccttggtctgtctggcgccaaagcccgtactcccagtaaggccatcagctctctggaaattgcccttctgagacatttgggagttggtggtgctttgacctcatatgatatatatttacatttggttttctatcccagaaggtgaaatcctgcgatttattactgatgccactggtaagattgtacaactcatgtgaatttgaaggtactaatctgtaggagcatcttctggctgaaaattctttaaacaacttccttatatttatgtatcataataatttatatggcttttgagcctcatatatttgtaattattgtcataggtcatcctttctaacctcttatttataaagtctgtgtacttcagattctctttatggtgttggtaatgtcagatctagaatctactcttaagactatctatagattgtttatcaccatcagccctcattattttaaatggatacccacgcaactatactctgtaactacaggtttccagagcttctccggagataacatcttgtagctcaccactgcccccacacccaactttttacttcataaatgttgtaactgaatcccagaaagtatgagagaaaacatctgtaaagagggaacttctccgggtgtgtgaaattaagaaaaatttagaaataagtattactcctgaatctgaagctttgaaataaaaactcaccgtgtgttttacatatgttagtttgtaaatatggagtctcactaattgcatttacagctcacagcaaaactacctgttacgtcttgttactataaggaaaaaaatcagagctgtgcgtgtgtgtgtgcatgttttaaaaaactggaatgcagagaatagtgtggtgtaaattgtctctaattatgtgtctttttctggtgaggcaattaattggttctctccagacctttttctgatgaggaaattaatcagtttttctgttacagtgataactcacctgaattcaggtgtgccaagcttagaggaaactgtacagaatgcctcattttgtaaagcaatcaattcttgttgtccttcctctttttattagaatgactgaaaagcaccaaaactgtctgatattttacagaatcattgtttactcattttggatcattattttgctttcgatatgattaaatgttttgttgtattcttgagaatgattttattggttaaggccaaatgtatctcccgtgagagtgacttagtaatttaataatgacagagggatagtctttaaactttgcattatgataaacttttcagaaacattctataaaatgaatctcatctgtttttatctgaaaaggtagactcctccatgaataaactacagaaaagggtgaatcagtatataatgtcagtataaaggtgacagtatatcatgtcaggccaggaagccacccaagcaatcagcttcaatttactgatgagcagatggaggcccactatcgtacaatggctatgtggcagtgtgggagttgcgcctgccttttctgacccctgttttggtgccatttctccagtatcttgctagagtgtttatgaaaaacaaaacatttcctcgccccttcccccagggataatgatcactgactaaagtagtattggggcctgggttttaaaatagtaattcctagagaagcatagtaatttggcttttcttttaagctcctttagtaggatttgagttgttttcaatgatataacattttagagtgcatgtatgtctctatggtcataagactcatctaaagggaaatttcttgtgctaagaaatgtatattaatgttggttaatgttggttccttaattgctaaagctattcctggtcctctttttcttttttctttttttttttaaaccccggttgtcaagcaaaagtgctcttccagagattcatggataattatgtcaaggtgttaggggcattattcctcccagtttttaagcttgatgggactcaagtatttgttttacatcttggctaccactggagagaagtattaataacaggattcaaataatacttaagaagactcatcgtttgcacttaaggtcatgggctctggtgttttctgttacactgcttattgaatggtcttggggaagctt

SEQ ID NO: 64707 - DNA, 2812 bp, Homo sapiens
tctttgtaggtgggcaccatctaatagttttattttttagttacccttttaagaatttgtaatttaagccacacataccttttgttgtgttgtgatatttacacaccagtgttttatcctcactcttttctaccttctagtgttagcttccccttgaagaacacacccttaaatgtctcctaggctgtattgcttcatcaagagtgtaaacaattacagcataaaatggtacctttggaaatgaagtcatgcgtctttcttaattgctgaactcttgtaattctgaagggggtctattttagcctgtacttactcccatacttgctaacacaagcaaatgggcctacacatacagctaggaaaagcatgaatctaagggtttcttagggttccataattatgcatggaatgtgcaggagcaggaatgtcaaagtaggagtaatcatgatagatttagaaagggccttagaggttagttggtacaaaatattttacagtgaaggaagctggaattaagcaggtctgggtttcttcttcctagcttcccctcccttcgtcccattgtaatatatggctgtcaggatgacgtttctacagcaaatttgatgtgcataaactttgctggcagctttccacacttttagaataaagttctgatttctaaaggtcacatatgaaggccttttgggatgtagtttttgcttgtcttggtagcttttctcaccacttgtacacatactgcctataatgatcaaattccttggtggtcttatctttttggaccatactgcttgtaattctctaattccttgatggttttatctctttgaccactctggttttatctcatttgaccatgctttcacacatgatattctttctgacaagaaggcgccctccaccttcccccaagacacacattatctagttcagaggctttcaacaaattttttcttttagtatgaacccagtgtggattgcaattacattatgaccatatacatatataggtgtgtgtgtatgaatgtacatgtgtgtatgtatattatacgtaatatatattttatataaaaatctaaataattgttatgaacatacttatttttatatgtgatatacttaactttgatattagtaatatctgccctttgtacctgtgcacaacagctttggtgttggaagccttttttgagctccaggtctgattcgatcatcttcacttgctgagtcacacgtcatagtatttacttgttttgttcctctcactgcctcagacagctcttgagggtagagactgtgtctcacttgtcctagcacacaggcacagacctaataggtgctcagtaaagagataatgaagaaactggacccagtgttctgctacaaattgatagccaaaatcgcaaagacagaaaagagccccatatttctcgattctcaagacagagctatgcatcagaatttttcatttagagtaggacttggagaatggctagacataggatgaattattttttttctgagggggaaatgtgagaagacactatcatatatactcttagttataaaagaaaaaacccacaaaatacaggtattgagacttaattacatacagccaaattcacactttttaatatacaattgttttgaaaaactacaattgtgtaactgctatcaaaatcaagatatagatcatttctatcaccacataaatttttttaatgcctcttcgtagccagccttttctccaccccccaactgttgccaccactgatcaattttctgtgtctataggttcaccttttccagaatgctgtataaatggaatcgtgcaatatgtagcctgttgcatctagcctcttttacttagcataaggtgtttgaaatcatccatattgttgcttgtatcagtagtctgctcctttttgtgctggataacattccattgtatagacataccaaaatttctttatccattcactaatttaggttgtttccagtttggggatatatatacacatatatatgtgtatatatataattatatatattattatatattatatttatatataatacatatatattaaaacatataattatgtatatataatttatgtctaggattgctgggtcatatagtcataagtatatgtttaattttataagaaattaccaaactgttttccaaagtggttgtaccatcttgcttgttgccaacagcatatgagagttccagttgttccacatctttatcagtacttggtattgtcagctgctatttaaaaaaaatttagccattctaaaagttgtatcatgtctcattgtggtctgatttgcatttccttcgtaactactatgaacatcttttcatgtgcttatttgccatttgtgtatcttatttggtgaagtatctgttcaaatcttaaaagcccattttaaaatcagacttttcttattattgattataagagttctttctacattgtaatataaattctttatatgttttgcaaatatttcttcccaatcttttttgtgttgtttcattttcttaacaatgacagcacagctttgaaagtctttgaagggaatatcctaaaaggtactaaagtagaggttttaccagcctgggcaacacagtgaaacctggtctctacaaataataataaaataattagccaagtaaggtggtgcttgcctgtagtcccagccacttgggaagctgaggtgggagaattgcttgagcctgggcagttgaggctgcagtgagccatgattgtgccactgcattctagcctggggcaacaaa

SEQ ID NO: 64708 - DNA, 1082 bp, Homo sapiens
tttttcccaagggctctaataagggaattcggtgtaacttcctgaatagtaacttcattggcattcttggaatagtcatagcaatcagtttcttgaagctgctacttctaacatcactcattgtgggccaggagaagagtgccaatgtgctgtttcaataaaggtagttgcaaaggtgtaggaattgtaaaaattgtgcctacccaccagaatttctttgtaaagcaaccttgtttatgtttcttaaaaaatatttcataccttcttgctccattctcaaactctgtattatatggagcttccctggcaactgtaatatgagcctgggttatctttctaggttgttccgagactgcagcctgtacctgccaatgtgctgccccataacccagccatacttgtctacttgcagtttcctgaatggctctgtcctctagactctaccttcatgccagctgttctttcgtttcggaggcccttccctgtactcctttacttggctgttttccctacttgcatacagctgctctttttccccttaagatcagagggaatgttttgctcatcatgccaataaagatatgttgatcaacaaccagaaaagctgtgagttttttaagtaaaactgaacatactaccatcaataatacatccactccttttaaaggtacccagaattccatgttataaattttgcctcattttaaatttattaaacttctccaagcaccactattattaataagcaagaagagacttttcctgcatttctttggttaggtacaggtagtactgtttttctctttgttttgatgttttgttgtaacattaggtcattactttagctacagggagggactcaccccactgtgacccattaacctcatagtctaagcaccatttgaccattgtttctggggaaattattttcccaaattccaaagcatatttttaaaacatcactgcaacacaatccagcttaaggtagtggaaagaatcatggaccaggatttatcatttggagtctgatcttgatactttaatgaattatttaacccctctgggtctcagttccctcatta

SEQ ID NO: 64709 - DNA, 2535 bp, Homo sapiens
caggtgacattggaccactttctgagaacccctcgctcagtggttaatgctgaagaaagtttgttttctaataaagtaaaaggaaagaagataaatccaatgataactagacagaggaaataaactggttggtaatatagagtttactgggggccattttaggggggctaagaagagactgtctgaaggggtgacatttgagagaaaaccaggaggtaagaaggaggtgctatgggaagagctagggaagaatagaccaggcagagaacaagtgcaaaggtggaaggaggagaggtttgcgtgcttgtgggggttgggggagctgggagtggggtggggatgatttgagatgatgttggagaggatgcaggagcaagttcaggtagggccttgatatagaacaaagagactgctaagcactggattggcatgaattgtcttcttgttttaaaaagattgctttgactgccatgtgtaggtcaaattcagaggggcaagcatggaaagagggagaccaaacagaaggctactgtcgtggtcccgggagagatggtgatggcttggattgaggcaaggggtcgaggggtggagaaacaagatagaagtgagctggaggaatgcactgtttttgtttctactggcttatcaccgcctggggatgctcataatggaggcccatgaaaagcttaaattatatttcctatgtgctgttttagaaaacagagaagcacagataacattttagaaaaatagtcattatcaagttatttaagtgtctgtgcctccacctcctccattcccctgaaggtaaacctcagctatctggaaagcttggctgtccagggcaacttgttctctgagatctctgatttagccctgttaacgtggagtataatctgtgtgtgtcattgcttaattgttggcatgtagtgactcaactggtaatttaaattaaaagactgcatataagcatactattgttcttcttggatctcgatggagctttgagtggcacttaagtgatggtgtctttgaattaattactatagctggggaagagctgggaaaacacactagggaaaaaatgcatagttgtgatgtaggagtgagaggagtacgttcgatgtgagagtgagcctagaatgaaccataccggagttagagaataaaggaatagatgccaagtactcacagatgtctggggccccatctacaccactgcaccctgctgaggtgtggtcagctggtagccccacctgctcactgatgggggaacttccccctgccctgcagggctgcagggggaacagtcacatggaggtcccccctcttcctgtctctcaggatcccagcccaggcaattccacctcaggcagtctctttctcacatgtttacacacatcctcttcaaaccttgtgtttcttttcctttgctcttttaaatcttgcccagtcacctcaggaaattctctccttttctttgttctattccagagccaaaataagggaaaaaactttttagtcatggttaatatgcgtgagattcatgctatgataaacatattgacaaatgatctaattaccaaatcctgtggctcctctatttgcaggttgtttggacagcagaacactttctatcctggaagcttttcttttaggttcctcctccacttcctgatcactcctgtttcccacctccccacctccccttcctgtttctattcccttttttttttttgagatggaatctcgttctgtcacccaagctagggtgcagtagcgcgatctcagcccactgcaacctccgcctccagggttcgtgattctgctgcctcagcctcttgagtagctgggactacaggtacctgccaccatgcccagctaatttttgtatttttactaaagatgaggtttcaccatgttggccaggctgatcttgaactcctgacctcaagtgatctgcccacctcagcctcccaaagtgctgggattacaggcgtgaaccaccgtgcctggcctgtttctattcctcaactctggttatatctagaaatgtttttctcagccattttctttatttttctcctctttatctctaagtgatgccatccacttctgcagttttaatgctccgtgttgcccactccctcacctttacctcctctttggcatttcttctcaattctaggcttgaagttacaactccctgctggataacatcacatgacccaacagatccaacacactttttcctcctgttgtgtctccaggtgacagcagcatcactctaccggctacatggacaaaaaaaccaccatgtcatcttcagagtttgcctttaagctgcacacagtggtacatgcctgtagttccagctacttgggaggccaaagcaggaggatcccttgagtccaggagtttgagtccagcctgggcaacatagcaagagcctatgtcgtaaaaaaacaaaaaaaagaaagaaagaaaagttcacctttttttccaacctctaatcagtaacattcagtaacaaag

SEQ ID NO: 64710 - DNA, 1128 bp, Homo sapiens
ttgcctccagaagcaatggggggtcctctgtaagatcttaggcttgtcagcgctttgctttagacactctcggatgtcctagtaattctaaaatatttgctgctgtctgtaagttctaggtatatccagaacttcttcgttatatgtcaattgttcttccatgatttcttttctctttattttcctctgttatttgaagggcagaaataggctgcttttttccatgtccacctctttgaattttgccattgggtcttctctgggacaaacactttatatgaagtaggtgagccagtctcctgtactccttatcctgtggcttgaccacctctgggcaatttcattcaattgcagacatcttccaggaaatgtctaatttgttaaacaaatacttgttttatttctgagcattttgaaagcaaggtcaaagatggtggctggggagagaaggtgttcaagtggaaaaggctgctagcgtacagtaggaaactgtgggaaggaggatttagggaattgtaaagactagcccatcttaagtagggttagtgctcctggtatgtggaatgcctttttattccttgcctaggagtgagtggcaatgctctgctatgtagatcagtatttcagtcctgaaccaccagggccaagaatttgccatcctgctggggataataaccggcaggatgtgacatattacaatcaatgtgcatagagtaccttccttatgtcagcatgatccaaacactttacatgatgaattactttattctcacagcaaccttgtgaggtggatgccatgattcattatttatagatgaggaagctaaacacagaatttaatccatctgtggaagatcacgcagctaatacatggtagaacttggatttgaactcaggcagccttgctgaaagtcatgttctactgcctgagactgaaataatattatatggatggagtgctcttgaagattggtcatcttacacggattagtaagttctttggatggacaatccttttgtcctgagtgccaagaaatatggaagaaaaagatagtgacccaagagtcatggaagaagaaaaacagaaggaagagcaaacccaggctaggcagtgtctttgggggacga

SEQ ID NO: 64711 - DNA, 1067 bp, Homo sapiens
ccccatttgtaaaaggggacactctcccaaccctacctgccttgtaaagttgctgtgaagtccaaatactttcacgagcataaaagtgctttgtgagagccgggcagtggttccccgttgtgccactataatgtgtattcgaatcaccaggagggctgtgtaaaacacattgctgagacccacctctaggatttttgattccatcgacctgggtgggggcccagttacttgaatttctggcaaatttccaggtgatattggtgctgctagttctgagagcacaatttgagaacccctactttaaggagttctagatatgtgagatactaccttaccctttcagacagttccatgtgagtatgttaaccatacttcttagtgaaaaataaagagaagcctccgggtctttgtgggaacaaagttacaaattaattgaaatccatactcttcctaagcagcttggacctactactgtcccacatgtaagtatgcaaaactacattttgccaagaattaactcatgagaaccattgaacttgtattgaaagtcaccttaacagtggtattgtgctctgtaaaactggaatcttttcccacaagatgcatgtaaataagagatctcaaaaatagaaagactctctttctcaaagaatacaaacaggtgtcacatagaaaactcgagatgacatggggattatttttctcaggtttcacagactgcggtctgggttggctttcaggattggtttggagaagggtccatctgctgggtgggcaggtgtattccttcccatgtgctccgtgcctctccacacccctccactgtggtcaagatgcattgtagaaatcctacctcaaggctgggtgcagtggctcacgcctgtaatcccagtactttaggaggccgaggcgggcagatcacctgaggtcaggagttcaagaccatcctggccaacatggtgaaaccacgtctctactaaaaatataaaaattagctgggcgtggtggtgggtgcctataatctcagctacttgggaggctgaggtgggagaatcgcttgaacctga

SEQ ID NO: 64712 - DNA, 4758 bp, Homo sapiens
ttgtgccttgcatgtaacatactcttaaatgttgaataatttgaaggacatagacagattgtctttcgatattctattatattttactggtgacattttattaattaacttgcttagccaaagtttataccatgaacatcaaatatgtggctactgcactttttttttttattttttgagacagggtctcactctgttgcccagcctgtagtacagtggcgccatctcagctcactgcaaccttcacctgtgggctcaagtgatctactggcctctgccttcagagtagctgggactgcaggcatgcaccaccaggcttgaaaaatttttaaatttttctgtggagacgaggtcttactgtcttgcctagctggtctcaaactctttaccttataccatccttctactcggcctcccaaaatgcttggattacaggtgtgagccactgaaaccagcctctattgtacttctaagtgtgctgctgtattcgttgggggaggagggacaatatgaactgtgcttcctgttttaacatttatgaagcccttcatgtgtaccagatatcatgctaagagctttatatgtgtgagtttacttgatcgtcataacagctgtataagaggtattctttatctccattttaagctcagaaaactgaagtacaaaatgtttaaataagcgttagtcaaatatattgaaaatatatatccagggtcatgatttataatctgtaaccagaatttgaacccacatagtctgactccagagttcgtgccctccagtctctcacactggcccgcacgtgtccataggtgatagggtttggtggaaaagacagacatgcacgaatcaaatacagtatgagagtaccctaaaggagggatgaacaaagggctgtgggagcaaagaggaggggaatttactctgccttggggattggaaggcttcacagcagaggtgacatttgagctgggtcatttagtcttctgtagggcagctgcccgagttctgccttgtttgaaataagcacatttacaagagaatagtggagcacattccacttgatggattggattgacagattgaaagtaactccccagaatgatggctttgttaggtatttgttctctgagaaccctacctgccactcccctttggtgaattgtggcaagaaagctgtcacattaagctgtcactcaggatacttgtgagagggggagggaagaacaaattatgggcagaactaggtattttcagaacagtctaaaacccggaaagattatatttcagagcatttaaaagtgaacacaacagcctttatttaagttgtgcaaaaagaaaattgaataatgaaaacttaattaggctatggatatttttaaagctggacattctgattcttatccaccctaattatatgaagctttttaaaggccaagatagaaaaagaaatcaattatagacctacacaaagttcttatagagattgtttaattgtaaaaatatctttcttgtgtgtgatttttaaggagtgtttcagaagtagattcaattccaacttgtatgaccctttgtctcggttgactagttgtttgctctaagaatatttcatgttttgctgtttctttcagtttgtaggtgctaagctattgaaaggtttagagactaatctaggtctttctaaattatggctgcttgcagttttattcctggagaaatggtttaacagcacttctttgagttggcactcttctgcctgtctcagctctaactttcccgcctccttctcagtagtccctctttcaccctccactccccaagcctgaaatggaaagaacttgctttgttactgatgataatatttaagctctaaaattttaacagtgtttcagttgcaaataaatggaaattgtgtattctgtttaatgtgtttcagaaaatccctgctattttttttttctttaaatacaagaaaacaggcgtgtaatgcctcattgaaaaaagcctgtaggggtgctttgtgcaggtcttaattaagggctttgaaagaccaaacaaaaggaaaaaggaaaatgctacagggttattgttattccaccccattggctcagctagctgaccatccattggagcattttgtccattttgaaactgaatgacacttttgttcgtgattaacagaggtgaaagaagccaattattgggccgtctttttccatagagcagctgctgttggatttaactgcaggcaaatatggccttttactaccacaaggatgttgtgatgacagtttatttttatagaactctggtagaaaacaaaatctgtctgactcctgttatgaatatgccctggaattttcatgaaagggtcattttaatgttctagctgtcccagagttctctttaaaaaacaatgtatatgtatataaatacctatgtacatatttttaacagctccttgcgtatggattcagccttaaagttatgtaaagatattttttaatttgtacatttgtaagctgcttcagcctttccccattttcattttagtaaaatcccccaaagcttgttaaagtggccaagtaattaggggaaaacagagtcgtcttgctgaagctgttttgatatacaggctacttaggtgggacgcatgagtctcagagaccacctacccattagttcagacttctaacctctctggtgttcagtggtaggaatgagcttggggaggaatttcccatcgtgcagtggtattacttgagtgtgtaataacaggtgtacctgggagaggggcacatggttcagctgtcaggatccacccaactctgatatgcccttagacaatggagtgggagatggggtttggagaccagagatcagccaggatttctttcagtaagactctaggccttccatttttgaggcatccttgtgttgtggataaagtgccctgtccagtgtttccttgggcaagtttcttaacctttctgagcctcagtttcatcctccagttggagttaataatacctgtctctcagaatggttgtgagaattaaatgagttgagcacgatatgtgtctagtacagtccctgttatataggaaatatttgatgaatactaacttcctttatttctcttttgctgtgaacagctccttataccaaaatctgaaaccaaactctgcttcttacccaattagtcttcttccttccagattttcaagtagcagaggattcagttttcagggataatttaatgaaaataactgtcttctctctacggccctctcttcttcatttgtctagaatagaaccaacacagctcttgtgtataatgtgaagaacatggaatattgactctttctttgtgaatgattgtcataattcattttagagtcttctcaggtctggtgctgttttgctctgtaatcttttgaaaatcacctgtgtttttttgttgtcgttgttgttgacaacatagtggtaataacatttaactcactacccctcagatgtgtttgaagatgattataagtggtttataagccctctgtaggtatcactacattaaaatggaagaatgaggcccctaaaattgtaaaacaaaacaaaataaagttttgcggcaaggtaggtaacgtagttgtgtagctgcatgggactaagttattagttgaacaaggtgtttaatattgaggttcatcttgtggcctatcaggctctttggatggcattttcacccctacaaaagagtgagtagttctatttgtagacctcccacaaaatgtggtattggagctgggttgctagtctcttcttctctggtttgatttcccactcctcttcttaatcccaagcccttgcttgccccattctgtctaaccctcttccatggttgatatgcttttctccatctcagcctcttcactagctcttctctgaagaactgcttcccctgcagacttttggttagaggctgctcatcttcctacactgttaagagaataggattgattctcaccgctcctcattgttgcccataggtcactgggctttcatcttaactcacaatctctgttccatctgtggtccctgacctttagttctgatccttcgcaaatactgtcatctactggcttgtctgttggtcccctttaaaggaggattgggtgccaagttcatgatcttatgatttctgccatcctctcccctgccgtaagttctgtcattcacccaacatggacaatccttttgacacttttgcctctcatttcatttatctccatcacattggtgagccctgtctcaactccacttcagccttttcctcccatgaccaaatcttggaccttgtgaccacagaactgctaaatccctctgactacagcccctctctctctctttttaagaaaatttttagctcagtgtatacaaatttttcagcctcattaagccctcatgtcccttgaactttttactttctctctatcattcatttctttctctggttagattaagatctgtccattcctttagcctcagtgtccttaaccctcttaccctgttgtcttattaaaggcgattttttatgtaatgatgaaatcaatcttatttagtcacccatgccactttttttgtgtgtgaaatacctagtaagtcccaaactaagtacttatcatacatgacttaactcatcatttgaggaggtagttaactagtagaggctgactgcttagatgtaatggtttaatggag

SEQ ID NO: 64713 - DNA, 1109 bp, Homo sapiens
attattatgatactatacattcaatattaaaaaataaactcttaggcatgtcttgaggattcactcattatacttaagtaggtatttattattttacagcagctgataaatactggacagtgttgatgatgggcagcatgttctcttggatgaagataatgcaaataatagtcttgacttctgatagttttattattataagttagctaacttatgatagttagatattgtcaactaggtgagttttacctcccatttgcatacttccatagaaaaatcagaaaagatgtaaaaatttattatagtatgtgtttattatgttttatttagtttttattaagtatcagtgagtgaatgagaaaggcatttgttggtagtcttaatctagtgagagtagaagtgaaaggcaatacttctgtcctcagggggcttgctccaatggttgatttaaggagctcatttttgttagtctcattactctcttctagaaaaatggaatacagtaaacctacctgatattttcaaatgcaaatacatatctgtagctttaatgttttattcagactcatgaaattagtgtttcatgacaaaataatttggattgtgaacaaatgtacagcaaaatcattttgtttccatacattcttttcagctaaagaacaactgaggcagggcgcggtggctcacgcctgtaatcctagcactttgggaggctgaggcgagcggatcacctgaggtcgggagttcgagaccagcctgaccaacatggagaaaccccatgtctactaaaaatacaaaattagccaggcatggaagcacatgcctgtaatcccagctactcaggaggctgaggcaggagaattgcctgaagccaggaggcggagcttgtggtgagctgagatcacaccattgcactccagcctgggcaacaagagcaaaaactctgtctcaaaaaaaaaaaaagaaaagaaaaaaaagaacaactgaaactctggatgatttattctaatttaaacatgattctaacttactgatgattttattaaactaggtcttactagattgccacatttaagccagtgatcctgtatttaatggtaaggtctttg

SEQ ID NO: 64714 - DNA, 1121 bp, Homo sapiens
ggcatttctttgcagtggtggagcagttccttaccatgattgtagtggtagttacatgaatccatctgagtagggtctgtagctttagtaaatagtgttgcatcaaagtaaatttcccggtttagctgatatattatggttatgtaagatgttgccattgggaaaagctgggtgaagggtatgcaggaactgtctgcactagttttgcaacttctagtgagtcttaaaccattttttaaaataacaacaacaaacataccagatctgttgagagtcctgagaagtcttagccatggccttaccccttaaagaagatgaggaaactgagtctctgaggtaagatgacagcctgaggttgcagagccagagtctcaatctagatcttttaactttcacatcaacattattttgctccctgagagcataaccagttttaatttgctattgagcaattgttggaagattacgtgggtgtccattttttcccccagcttcatgcccacattccccccagctatgtatgtgtgtatgtgaattctcttttatgttctaaagcagagaaagtacaatatgcaaattatgcattaggtttataatttaaatggtttgaatcatatttttgaatggaatggacatggctctcctattatgaaagtattttattactgagtgcttggtacagtcttagtatgaggaatgaccttggatctctgcctgtgaattagtagctgaatggtgttttacttctgatgattcagtatatttgccttaattactggattaaccaatttcttgcctcccactaaaagcacacacatttatctaaacaggggatgaatgaatgaagttttagggactaatttttgtggtatttaagcaacaatagtctagattacccacaaccttaatttcctttcatgagtcttgtagatgggctttgtcaccatttacacttgattacttcattgttaaccccagtgatgtgatttagcatgcaaagacttaattattcctttctggcctagtgagaaatttccttccaataattgcctccactgccctttagcctccttaaaacatttagtttgtttgaaacaacttggttgctcagtaagcaattc

SEQ ID NO: 64715 - DNA, 1199 bp, Homo sapiens
aggttataggtagatttaaaaattttcggattggcaattggctgaaagagtttagtttttatctaaaagcctggaataaatagaaaggaatgtccgagttccaatgataagggattgtggagaccaaagttttatcatgcagatgaagcctccaggtagcaggcttcaaagagaatagattgtattataaatgtttcttataagtcttcaggtctgtgttgatgctaatgctggttggctcttactaaattccaaaagggtgtaggatataatgaggcatgtccaacttccccttcccatcatggtctgaactagtttttcaggttaactttggaatgcctttggccaagaggagggttccattcagaaggctggggcccttagaattttatttttggtttacagaatcagtactctttcaactttaaaataataattacttactgagataataagtcagaactttaaaaattaatttgttcaacatttgtttattaagtgtctgatgtgttagggactgtttttggtgctggggacacagaattgaacagtatctgatgccatccttgcattcctataacttacctggcaggggggtgggggattagtggtagacagtaaataagcacaatgaatataaaaggtcaggtaatgttacataccatcaaggaaaataaagcaagatgaaggtggtttgctgttaaagtagggtagccagggaaggctggaatgaaatttagatattaagataattagtcaatatctataggaatatgaatccatcttaagcaatggcaaaacaaaatttaaaaagttcctcttggccgggcgtggtggctcacgcctgtaatcccagcactttgggaggccgaggtgggcacatcatgaggttgggagttcgagaccagcctggccaacacagtgaaaccctgtctttactaaaagtacaaaaattagctgggcatggtggcaggcgcctgtaatcccagctactcgggaggctgaggcaggagatttgcttgaacctgggaggtggaggttgtggtgagctgagatcgcaccactgcactccagcctgggcgacagagctagaccctgtctcaaaaaaaaaggtttctccctaccccatagtgacaacttaattaaacataaaagtcactgtgcatgtaggaacattaaaaaagaaaataaaagataaa

SEQ ID NO: 64716 - DNA, 1203 bp, Homo sapiens
tagctttttggctattataaataaagccaccataaatattcacacagagtttttgtatgaacataggtatttatttcacttgcataaatacctagagtgagatcctgggtcatatggtaaatgtatgtttataagaaaatgttggtctcaattttaatgtcttagactgtggtgaggtttgttatcaccaattacttatagtcacaatatattgttagcatggtatgtagtattagcaaaagctgttaaaaactgattttgtttaaatgtctgctttctttaagttctttaaactcctctatgctgagaatgtctgcttttaaaagagaagaattcttagctccctttatgatacctagcagttgctgtaatccccgccagagactcctgtagaaattaccctaatgtgaagcattttgcttacagtgaaaaaagtttgaattattaatgtattcatatttggaatgtctgatttttttaaaaaatggatatttagtgaagaattgctgggcctacctatacattatgcattttacatgtgctaactagaatttccacagtaaccatcttggtccatggcaggattcccattttatcactgagcaaactgggatttaaaaggattaggtaacttgttcaaatatcccacagttagtgggtggtagtttgtgaagctcaggtgttccatatttaagtttgctcatccctgtagtttgcttagatatttgacaatttatcagaagaggaacaggtgaaatgagaaacaaaatggtgagaagctacaggttattacaggaaaaaaaaatcagaacagaaaaaaatgtgtacccaaaaagcacacatacatctatatgtctgcatacactgggagactatgacttgatttagagtcaaaaatctacacaatagattcaaaatctgttgtgtaaaatgaagttgtctgttattcatagcagaacttttaaaaagtatctctaacttggtctttttgctttttatacatacttgtttaaaagctttcacatcatttcccatgttaatagtgtttttttgtgtgtgtctggaaagtatcagtcatatgctttttgactggctttttctttcttccgtggacttcacttacatggtatatgaggatcagatctgttagcagactcacttttctgtttctaaaggagcaaatttctgaatgtgctcctttaa

SEQ ID NO: 64717 - DNA, 1643 bp, Homo sapiens
aatctcagttttcatcccttctctgctatttctgctatttatctcatttgattagtttttaaacatcttaattttttctacaaggaaaaattttcttgttggccttccgttctccaagttcattttgagtccatggtcatgtcatctagctttttatgttactatcaactccccagtctttttatttttgagacaggatctcactgtgtcacccaggctgaagtgcagtggcacaatcatggctcactgcagcctcaacctcccaggctaagggcatcctcgtacctcagtctccgaagtagctaggactacaggtgagtgccaccatgcctggctaatttttgtatttttttttttttttttttttttttttggagacagggtctcaccatgttgcccaggttggtcttgaactcctgggctcaagtgatctgactgccttggcctcccaaaatgctgggattacaggtatgagccactgcgccaggccctcagacttcttttgtaggcatatttttatgaatagattttcaaaaatggtttgtttttttcctttctttttcttttttttaagagtctggcacaggaaatgaagacatccgagttcaggagggcattgtagagcttgggcaggtcacttaaccactttggacttagcatttcccatgtgcaagaagaggcagcttgcattatcttcagggttgcaccaaggaaacgcttcagcatgacttttttgagtgacgccgagtgagaatgcaatttgtcatttcttgtgggagtgactaagccgttgtctgtgtgttataacagtgaattaaaattctaaccctgtttctttggttctttgaatgtatatcaggttcaaagcccatagacttcacaggtgagccactgtgctaatggaaaaaggctactcatctggtagattcttcatataaaaatccatgaagaccctggtagagaaacagtagtacatctgattttataaagataccttcttgtagatggtgctacttccctctaacaagaaagccttatggaggagaggtacagtttatctggaggagggagctcaagggaaatcttacatttttgcctgggtctctgtgacttgttgctgccttcctgagatggctggtcaagtagaaaggtgctgtcctaacatgggaacgcagggtttctcttcagagcaaatgggcgtgtgatagcccatcctttaaagacagtgtcaatgtgatctgtagatactgactttctacttccagactttgtgacactgaggactttcattaaaagtcctaactcagtggctgggggctgtggctcacgcttgtaatcccagcactttgggaggccgaggcgggtagattacctgagatcaggagttcgagaccagccaggccaatgtggtgaaacccttctctactaaaaatacaaaaaagaaattaggctggcatggcgacgggcacctgtaatccagctacttgggagactgaggcaggagaattgcctgaatccgggagggggaggttgcagtgagccaagatccagcctggacgacagagtgagactccacctcaaaaaaaaaaaaaaaaaaaaaaaaatcctaactcaatctttgggaaccttcatgccaatgagag

SEQ ID NO: 64718 - DNA, 3386 bp, Homo sapiens
agggaggagaatctcttgaaccccagaggtagaggttgcagtgaaccgagattgtgccactgcactccagcctgggcaacagagcgagactcctctcaagaaaaaaaaataaaaaagacatgaaccagtaattctctcacttagggttccttaacacttgcagtaaccaataatgttttataatttccagtcaaactaaatgctctgccggttatggtatcataagtgtttaatgtccaggcccttggctcttaacattaggattgtaaggtaacatttgacaacttaatctcttaggaaagatcaaagttctgtattagtaggtagatccaggcaagtttaggcatattcttggcctctgtctctgtcaggtctatctctcagcttcttattttagtcatctttataataatggaaagtactggcagcctgcaagtttggattttggtttctggtctccttgattgtgccttttattctcattcttctaatcaataaataatggacatttgactagatgatggctaatgcctctctctttgctttgaatttctgtgaatctgagtagaatattaagtaaagttgcaagaatcatttagtaatttatggaaatatttttaagactgtctcctgccttttctctattaaaaaaagataaatatctataaaagtacagtatttgttggtatacttgagttaaaagttaaaaccctgccaaatgtgcctttaactctgaaaaataaaagtaatgtaacttagagtattctttataagacacctttgctcttttaattttttaaacttgatctcaaggttttggagtgagaaatatgttacccagcttgctatttaaccgtcccgtgcggccttcaagttgttggcaatgttaaagcttgttttcctatacataaaagaatatggatgactttttttcttttttcccccaactttgttcggtgaagtgtggttttttaaaagcttgattgaagatgataaaatgctgtaattgtaaatcctgtcagtgaagaaaaaaatctaggacatttagcaaatcagtactcttacacaatggctaatttgtctgcctctcttgacatttcttttgtgcctttcagcacctgatggtcacactgtatgctaggtgtcaactctattgtctaaaattgtgtgagttaaaaattgagtttagaaatcagtcttagcatgagacagatcgtgattttttagctcatgtacagttgataacttctcaactttccgaagactaacaagttagtattcaaacacctcttttaaattgcaagatgtaattgtgtgctagtatactctgagttcactcacacatagacaaatattcgttattaaactttgtgtatggctgagctatttttagcaagatctttaaagcatactaaaatattctgtgtcgtgtccaggcaattaaaactctgaatgattgggttggttggttttaatctctaaaacatgtttttcataccattacgtattttaattgtcagaaaagctcactagcctggtcttcccccaaccacaagatttggcgttatgcatctgggttcagcaatgcctttctaatagtccaggtccctgaaatgaatatttaaaatatatatccttcttagctttctgtcatgaaagatcttatgggtaagacattgaaccaccctcctgtggcaacatgttggttcataagaatataagcatatccttgtaaggaaatgtaaaccatagatattttgggaggcagctgggccaagattgggtatacgtttagatcccaggctggcctgctgtttgtgctagtgagaaaatgtgcagaggaagcatatttaatatgttacaagacatttagtggttctttattccttatatttaatttgtaattaagtaatctgaatcaagataagcctttttaaaaggctgcgtaaacccctttagctggttgtgttttctagattgacactaggagaatgcaggttttttttttcaaagttttaaaaacaaaattgacccttgaaagagtgaaaatctcattgtaccctggcagcaaagtacttttggtatttgaatcagagtgtagaacccgatatccagaaaaaataacaagttacattctctctatccccttatatttttaaagttctatttggggaaatttttcttcctaagaagagtgacataaatttggcagggagatagctccttaccttggagctgtactaggcatagctaaggaatgtgcctgggattgcttcaggtcacacttctccactcccctcaggctttgaggttccttatgtagctcttagtgtaaacagcagagtcatttagtacaagtggtgacatcgaaactcccctaaagagttttattagagctgttttcatgtgaggggagatgaattttataattcgcactctcttcaagtgtctggttttgaagttgctgaatgggaggtgtgtttgcaaactggcaatctcttctctgaaactagggagtaaggagtgggctatggctaacttcctggtttctcccatttccctaagggatcagctgtatgcctagaagcccttgaagaaaccataagggtcacatatgaagggcttggcagaccagatattttcaggagggaggaaactcatggttgccactccattctagattgccagccttctcctgtgtgcaaaccgtctcagagaactgcatttttgcagaataattctccagaaaatgagagaacactctctcttgagtaacttaacaggaactcttaggccagcctatcaactcttttctgtagtagggaagagaaagcagatatgttaactgtggaccttcagatttcagttcgtggaaactgttcatgtgctcttcagccttctgttttaggtactaaattaattcagattttgcgtattttaaatgtgataattgctcttcagttgcccttcaggatctccttctctcacacaagttgaagtgtacgcggaattcttacttaatttaatcagagttcataagaagggaacattaaatgaatttaatacatttcaaatatgtttctgtcattttttttgttttgttttgtttttttgagatggagtttcactcttgttgcccaggctagagtgcagtggcacgatctcggttcactgcaacctccgcctcctgggttcaagtgattcttcagcctcagcctcccgagtagctgggattacaggcacctgctaccgcacccggctgatttttgtatttttagtagagacggggtttcaccatgttggccaggctgctctcgaactcctgagctcaggtgatccgcccgcctcagcctcccaaagtgctgggattacaggtgtgagccacc

SEQ ID NO: 64719 - DNA, 1964 bp, Homo sapiens
ggatgcaaggccacaccgaggagcagaaccgtggcatggaattcagacaccattcccacaggggattttcagattcattctcagcacttagccttttgtccagatttgagaaggtcccagagagagaatacctgcttcttctccttgaggctggttgaaacttgttcagtctaacagtgtctatttcctggtgaaagccgctttaccggagtctggggacagcgtcagatgtgatcctcagtactgtgaatgggattcctgtattcacaccatttgctgcacctgtagcaactatttatgtttttgaacaacagtattcaatcttgtgtcacaatgcactggcctgtcacaattcaccccgaggagtgttcaaggcagtaatcttactaatattaaaattccgaagtttaatcagaaggattcaaggttattactgtatttgtgctaataactcaatcacctacattccaagattgggagaagagatgaagtcatggggaggggaatgtgtatgtgagtcctctggtttgtgtgttattgctacggtgtttgagaaacgtagacctcgagcacaaatttgcatgtcctaggttatgtttggcacatagttttaagattagcaaggctatttctgtgacttcgtgaagaaagtggtggacctgagtccttgatcatagctttactatgccactgagtaattgaatggccttgggcaagtcattcactttttttttttttttctcgtgacaatttcctcatctgaaaagtgaagcaactggattcacttgatcacctctaaggctgctgcttacttccagaagttctatgattttatattttttacaccattttaggatggcaaggtgacaataaggttatgatcctctcataaaaatatcccaggagtagcagaatatccttttagttgagctcacaccaccctctttattacttggaggagttctttgtgtttagaagtgtgtgttaggaaatttgccatggagacttgttgcagaatgcatgactagctaaggcactttgctagggtagaatagccctggttgtttcctgtgggtatggcttaacacttggaaaataaaatcactctgtttcagtaatttggatactgtacaaaaagttactcaacatcctcacttccatataattagtcataatctctcaaaccttcacagtgtatgtatcctgtacatgagcaggttgttgagctttttatttagaattgagttacctgaaggactttaaagtgtttttaaagaatctccttttggaaagatcatctcagattcttccctaaggtgtattttttttcccccactactccaagcacctttcttcttttactaataccatttgaaagtactttttaacgtattctctgatatctactgtgtatttcctggcaggtcaggtcagtagtcagtggctacatgtttgtatttattgatggtagagttttgttatcttttgatttctgaattacagaaatcaattgttggcttagtttgtgttgtgtgtctttctagagatgcattagttttatatacaagtgaactttgttcaaaacaagaacgatgtatgaatatctttaagtataggtcctttattttccaaactagtgaaccatgtgttctctttaaatataagcgaggaaaaaatattctgccaggcatagggagtgctgggttccagatctgtcaataattcacaggagtgaccttgaatgagtcatattcttaacccttcaggaccttattttcctcatctgtaaatctgtaaaacaagtcaacaactcttaactgccaaaagtgttttttattgttgttctctatttaatttgattttttttttttttttgagacggactcttgcgctgttgcccaggctggagtgcagtggcacgacctcggctcactgcaacctccacctcccaggttcaagcaatt

SEQ ID NO: 64720 - DNA, 1097 bp, Homo sapiens
agtttgagcaggaattgattgaatcaagagaaagaagacctgtggagaggaaatgggactaatttttccccaagttctctagaaacgtttagggaattcgtgcagaaagaaatgcagaaagaaaggtccctttacctgaacctcttgcaaggctctgcatagaatagaaaagcacaattttactattttgaccagtagtaaagaccttgtttagcagattcctcacattttagtgagtagacttgtcctataaggaaacgggctgttttacattagtatctaaaaccacagagaaataatcacacttttatgagagcatactcctctctccaaagcatcttctggtagaactcactgaaggtggtgaaatgctgtatcttcaactttgggccttagaataagttagtgttcatggcttaggaaacagaaaaataattggtaccagtctcaattagagtgcctaaactagcattatcttagcactttctgagctttggtggtgtgcaaatgtgttttattttcttagatttgtgacctgtaggtagagtgatcgtacattctggtgactccttatttctccttagtactcatttcaccctcaaaaatatatataaccaccctctctaaaagggttttcaaggacagcatatttgcattttactcatggggaaactagctcattcagtgattctcaaaagcaatgtatgaagcaaggccagtgctgcaggtttgcacactccagtcgatcatatatgggacatgttgcgatcacctagggtctttttccaagtacttccagtctgctctcccatcgcagctttactgagatacagttacacatcaggagactagttccgtggtctctaagcgtttgttcacctattcttaattgctggagcatgtgaaccaaaaacctctgtagttatacagaaaattacaatcatgaaagtagaagttaaaaagatgaaactataattactaatcagagttcttcattttcttctcattgctcaatggcttgtcctggagtagtgctttcaccttccctggggacaggggtggggggtgcatttcactttaaagatcctgggactgac

SEQ ID NO: 64721 - DNA, 2363 bp, Homo sapiens
gggaagttctacttaccaggtcatccaatttaggagatccaatttctgcggagggaacaaaaagacgggtgggggagggaaaaactagaccccttgtcctactatccttctaccttcaatccacaacctgccagacaaatccagccaagtcaagattttgccttgaaccaccaccaccaccaccaccaccaccgccgccaccaccaccaccaccaccgccgccaccaccacaaccaccaccaccttgtcactcacgcccgagaaacacgcccctctggtcctcctcttggccaatggcggctctcctctctgcatagtaatgagctcgagacctccccgggccaatggcgctccgggagaagggatacttttgcatgtacctaagtgatttgcataagccagcggccgggggtttgggaaccagagcgtgcaaccctagaagggaaaaggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcgtgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctgtgagtgcgggcggcggggacgcgagggggggggaggaaacggggcccagcggggggcgccgcggggcggagccaggggtcagtcccaccccaccccgccccgccgccgcccgggcctggggagggggtccgccggtcacctgcgtgcgggctgcctggcacccactcctgtgccacgggctttccgcactttgctagtccgggttcgagccagcagtagctttcgttcccagactttttgggcacaagcaccctcccaccccaccgcgcacacccccaactcacaagtgcatctggggccaagaaggaggaagtaatctaaaaacgcttgcccctggcagcctgtccacgcgaccttcccttctcatgagggccctcgctcagcgggcaggagttccgctactggcggggctgagggcgccgagaacttggcctcagtctgcataccgaggcatgtctcgtggggaagcacctggagcctcctgggttccagcatgtggggagaagaaacacctgtacctcagtcagggcgaatctccttccaatttggccccatccaggtagtgcgtcccggcacctacctcggcccagttccactcgggactaccccactaacgcccaggcttctgcagcacgcaggggagtccgagaaaacaagggagaattacagggttctgttggtggacatgctcttacccaacaaggccttttaaagaaggaatgctgacctgaggtgcaggatgttggaagagaagcaagttccggagcatatgctcagcccaggctgcaaggtagcagcaggtttctaatgcaccttcacgcagccagcagatcttttcttttgagctgcctgagatcgagagacacactgaaatgtttcagacttacaaaatcgccctgccaaaacggacttgagagctttagacgttcccttgagaaaagaagaggaatctgaactaggttgtggaggtggtggcaaaggccacggatagaggaggaacagggtagggtttttgtgttcttattgcttcttgcgttgcgtggccagctgaatgcttaaatcaggagcagtcgaagaaacgtgtgagagaggaagggatcctgaggggccctagggtagagggaatttccttttacctgtagtggaagggacctcttagaaatagacagttttaaaggaccctgtgaagaaatctttatgcaggcaggagcattgctgtatttccaggtgggtggtggcaaaggtgttccgcttgccctctcaggat

SEQ ID NO: 64722 - DNA, 1049 bp, Homo sapiens
catggtggcgggcacctgtaatcccagctactcgggaggctgaggcagagaattgcctgaacccaggaggtggaggttgtggtgaacagagatcgccccactgcactctagactgggcaacagagcaagactccgtctcaaaaaacaaactaacaaacactaaagtttgcagtttgctccagtgtatctcaaaatcaaactggtaggaacagacttataaaaagctaatagatatatctaacttggaagacttgtatccttatgccatattttatcatttgactactaaaaaaagaaactgaattaaaataatccatcacagcatgcttctccaaaacgatagtattaacacaatgcaaacatcagaatgtccaataaagttaacaagccaaggcaattttgttacatacattaacccatttattataggccaatgatgtctcaaagagtagaagagcgtctaccggtctttgaattccttcagtcttctgatggcgactttaccgtgacagcagaagtggtattgtaggtccaggcactgccagccactgtcttcatgcagaaaccacagtgccagatccccgtagctcatctcttcatcttggttttgccacagaaagagcaaatgtacttggtgtgctgggtgatttcaattcttcttcaccattttccggagggaggccccatagcgggtcccatatttactgatgattctgactttcttggtgcatttggccatgtcaccgcaaactaagtctaagcccagagagctatgtgtttttttgtttgtttgtttgtttgtttgtttgtttttttaagtagagatgaggtctcgctgttgcccaagctggtcttgaactcctgagctcaagcaatcctcccgcctcagcttctcaaagtgctgggattacaggcgtaagccaccacacccagccttatttctaatttttaaagcatcaagaagaaacagtttgtcacaacgtaatacaactttctaacagccagaagtgcccaaagatggactactccccatggaggtatgaatatgc

SEQ ID NO: 64723 - DNA, 5672 bp, Homo sapiens
gtctctaaaataccttctgtttagcttaccttctcagaatcaccagtgaatttgtgagcattcagacgtcaaaaatacgtgctcaaaagtagtttttaaaaagagacaaaagaggccaggcgcagtggctcacgcctgtaatcccagcactttgggaggccaaggcgggcggatcacgaggtcaggagatcgagaccatcctggctaatgtggtgaaaccccatctctactaaaaaaaaatacaaaaaaattagccgggcgtggtggcaggcgcctgtagtctcagctactcaggaggctgaggcaggagaatggcgtgaagccaggaggtggagcttgcagtgagccaagatcacgccactgcactccagcctgtgcgacagagcgagactccatctcggggggaaacaaaagatgaaagaactgaagtaaataaaagtcatatttttaatatgtaaaactttctttcaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtggtaaggatgaattttatttctatttgtagtgatctgttgtgaccacctgggggcgtatttgagtaataggagaaacctaagaaacttgtggtttagaaatgccttgagggaatcctaggcagtactattaatacagtgatccttttttttaagcactataagtgtattttgcagtgtaaattagcagtgcttaatgtcatttttatgacataagctctttattaaaggcaatacattaaattagaagtctaccctcattttactcttataaaatgccaattgcttgatctactgaaataataaggcatatagattaatatgctaattatttggaacttaaaagccagcttttagactataaacagaatatgatgtaagagaggatttcatatagattaaaatggtaaggcaggattatttcttagttttgtaatgttggaataatataacattaaaacttttcttcattatatatattgtaaacatttttgcattttgagttactttcaaaacttagatattagtgtatggttggttgtttttttttcccctagagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcgcccgcctcggcctcccaaagtgctggaattactggcgtgagccaccatgcccagcctcaaatatgtttttaaaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagttatgtcctcgttctttggatttgaaaaaagttgatataactacacaatagataacgtttatgaaaggtatgtataaaaaaacataattcctggtggctgctgaaatgaaactttgaatttctatattttgctttgtctttcataaaatttaaagaaaacattttcttgtgttatttcaagagcggcagtatgacgtgattgagagcacag

SEQ ID NO: 64724 - DNA, 1024 bp, Homo sapiens
ggtaaatttttattgactagtttctgacaatattgctagcttttctgaagcagtacaatgttcatgtatcggtcacatttgagtcacagtcctttccgatgacatttggtattttgtgttcaatttgcctgtgtttctccaaggtcttattttatgcttctgtaatctcagtagtttttcctatctactgtaaaatttagtgttcttacattttacattctcaccctccatgtgtgtacacacacacagtctccttcccaccaaatgtgcaaattcaatgctttttttcccctcgattgtctgtatattatttgcccttgaggaatgaatcctaactgccccactgttacataggcattgagaaaacccttggagaaaattatctgtgtgtgtgtttaactctagatatttgtagagcaattgaattattggaaaaactacaaaggagtggagaagtaccaccacagaaacttcaggctttgcaaagagtccttcaaagtgaattctgcaatgctgtgagagaggtgagtaaacatcattaaaatttacaaaaatttgagttaattaggtcagataatactctaaatttgggttcaacatttcttaagaaaaactttagaaaacattaaaaccagtccctctcatttttggaatttctgataaaaccattttataaagatgcataactttgcctgaaattttaacttcacagagaactcaagcatggtatattctgagatataactttggcttttacaggtatatgaacatgtctatgagactgtggacatcagtagcagtcctgaagtgagagcgaacgctactgcaaaggtaaatttttttgttttccaaaagtaagaattcttcataaattagaagtttaaaatatggagttattaaattcataataaacttactttgaagactaacatgtatctttcaagctacaccaaatttctcaagtactaagaaataagacatttgtttctattgcctttacataaatgctgcatgataaatagct

SEQ ID NO: 64725 - DNA, 1047 bp, Homo sapiens
tagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaatctgggggttctgggtttttttctctttactgtaaaacaaacatgaaaacgtgttttattataaatacgtgtgttccttgctttaagactaatctgactagttttagtaattaaacagccctccagagaggatacttatttgaaagcctgggaggccaatcctgcagtctgtgagcttctgagaagttgtaggattggatctgtcttccatggtggaagatgggagtgtcattttctcggacacttgaaagttttacccctttgaagtgatatactttcatcagataccaaaccatgtatcct

SEQ ID NO: 64726 - DNA, 1047 bp, Homo sapiens
agactcttcacttactcttcctgtgtcatggaatgcctgctcttggagccctggaccaccatgtaaaaagtccaactaccctgctggagatgcaatgtgaagcagtgatgagattacatggagagagtgaaaggcccaactgagcccagccttccactttgccctgctgagatgctgggcatgtgagtacaactcacttggacactccagaccagaccagccaccagctgaaggtcactaagtgactccagtcagtgccatgtgaaatgaaagaattgcctagccaagacctgccagaattcttattcatcagctataatatggttgttgagtaagccactaagttttgttacagtgcttgttaacgtgttacaatgatgtaataaaagtttctgaactgatttactagacatttgtgaccacattaattctgtacaggctcattcttaccaggtcttgttttgtgctcacggagaaagtaaggtgccattatgaagggattggggtttggactgagatttggattcaggtaagctctgccattaacaagtcacttggtttcttcagacaaataatttgacatctctgagtctcactttccttatctgtaaaatagggataatcacacctgctgtgtggagttttgtgaggacttaatgtgttaattagatattttattgctaggcagatagcatcctataaatggtaaccactctcactgcaatagtgatgccactgctgctgctgataatcatgatgaaaccaggtcatcttgcctatgactgccagtggagttggatgaaatgccccttccaaacaagcagccctcctcggtctgccagaaggctaaaatctcaccattggctttttcaagttatggcatttcagtttaaggactcgatatcctttaaatttccagttacacctggcaaggttaacacaggcaaaaacattacaaactggaaacagaacagcaaagtgaaaaaaagcatgtgatttaaaaaattttagaactagttttggttacaagtccttccagatctaaac

SEQ ID NO: 64727 - DNA, 3572 bp, Homo sapiens
aaaagattactagctataatttttaaaatttaaaagcctaaaacaattaattttgattacatttaaaattctatatggcaaaaataccataattaaagataaaaggcaaagaacaaattgggaaaaatatttttcaacatatataaccaagggctaatttctctaacacctaaaaagttcttataaatcaataaaaagaaaaccaacatctcaatggaaaaagaacaaagctcataaagagttcacagaaaaaggatatacaaatggctttaaacatgtgaaagaatgttcaacttcactcacaataagaaaaaatacaaattatgagttgcttcagcatcctggtgttgctgtgccgtgggtcctgtgcggtcacttagccaagatgcctgaggaaacccagacccaagaccaaccgatggaggaggaggaggttgagacattcgcctttcaggcagaaattgcccagttgatgtcattgatcatcaatactttctactcgaacaaagagatctttctgagagagctcatttcaaattcatcagatgcattggacaaaatctggtatgaaagcttgacagatcccagtaaattagactctgggaaagagctgcatattaaccttataccaaacaaacaagatcaaactctcactattgtggatactggaattggaatgaccaaggctgacttgatcaataaccttggtactatcgccaagtctgggaccaaagcgttcatggaagctttgcaggctggtgcagatatctctatgattggccagttcggtgttagtttttattctgcttatttggttgctgagaaagtaactgtgatcaccaaacataatgatgatgagcagtacgcctgggagtcctcagcagggggatcattcacagtgaggacagacacaggtgaacgtatgggtcgtggaacaaaggttatcctacacctgaaagaagaccaaactgagtacttggaggaacaaagaataaaggagattgtgaagaaacattctcagcttattggatatcccattactctttttgtggagaaggaatgtgataaagaagtcagcgacgatgagactgaagaaaaggaagacaaagaagaagaaaaagaaaaagaagagaaagagtccaaagacaaacctgaaattgaagatgttggttctgatgaggaagaagaaaagaaggatggtgacaagaagaagaagaagactaaggaaaagtacatcgaccaagaagaactcaacaaaacaaagcccatctggaccagaaatcccgacgatattactaatgaggagtacggagaattctgcaagaacttgaccaatgactgggaagatcacttggcagtgaagcatttttcagttgaaggacagttggaattcagagcccttctatttgtcccatgacgtgctccttttgacctgtttgaaaacagaaagaaaaagaacaacatcaaattgtatgtacgcagagatttcatcatggataactgtgaggagctaatccctgaatatctgaacttcattagaggggtggtagactcggaggatctccctctaaacatttcccgtgagatgttgcaacaaagtaaaattttgaaagttatcaggaaaaatttggtcaaaaaatgcttagaactctttacagaactggcggaagataaagagaactgcaagaaattctatgagcagttctctaaaaacataaagcttggaatacaagaagactctcaaaatcggaagaagctttcagagctgttaaggtactacacgtctgcctctggtgatgagatggtttctctcaaggactactgcaccagaatgaaggaaaaacagaaacatatctattatatcacaggtgagaccaaggaccaggtagctaactcagcctttgtggaacgtcttgggaaacatggcttagaagtgatctatatgattgagcccattgatgagtactgtgtccaacagctgaaggaatttgaggggaagactttagtgccagtcaccaaagaaggcctggaacttccagaggatgaagaaaagaaaaagaaataggaagagaaaaaacaatgtttgagaacctctgcaaaaccatgaaagacatattggagaaaaaagttgaaaaggtggttgtgtcaaaccgattggtgacgtctccatgctgtattgtcacaagcacatatggctggacagaaaacatggagagaatcatgaaagctcaagccctaagagacaactcaacaatgggttatatggcagccaagaaacacctggagataaatcctgatgattccattattgagaccttaaggcaaaaggcagaggctgataagaatgacaagtctgtgaaggatctgctcatcttgctttacgaaactgcactcctgtcttctggcttcagtctggaagatccccagacacatgctaacaggacctacaggatgatcaaacttggtctgggtattgatgaagatgatcctgctgctgatgataccagtgctgctgtaactgaagaaatgccgcccctcgaaggagatgacgacacatcatgcatggaagaagtagactaacctctggctaagggatgacttaactgttcaatactctacaattcctccgataatatatattcaaggatgtttttctttatttttgttaatattaaaaagtctgtacggcatgacaacaactactttaaggggaagataagatttctgtctactaagtgatgctgtgataccttaggcactaaagcagagctagtaatgctttttgagtttcacgtcggtttattttcacagattggggtaacgtgcgttgtaagatgtatgtaacatgatgttaactttgtggtctaaagtgtttagctgtcaagccggattcctaagtagaccaaatcttgttatcgaagtgttcctgagctataccttgatgtttagaaaagtatttgttacatcttgtaggatctactttttgaacttttcatcccctatagttgacaattctgcatgtactagtcctctagaaataggttaaactgaagcaacttgatggaaggatctctccacagggcttgttttccaaagaaaagtattgtttggaggagcaaagttataagcctacctaagcatatcataaagctgtttaaaaataactcagacccggtcttgtggatggaaatgtagtgctcgagtcacattcttcttatagttgtaacaaatacagatgagttaaaagaaaaaaaaagaaaaaatacaaattatggctacactgaagaaaacattgttcacctaccattttggcaaagctccaaaaatttgatatgggactcacacacttcatatatatataccttaaagtgtctgtatttttgctgtgttgccccattcttttcaagatggtaaaggcatgcaccttggagtcaaacagacatgagtttaaattctgattgtgctgctcccagcttgtcattttgggtaaatgatatcatttctttaagcctcagttttcctcatctgcagaatggataagacagttttgtgggtctgttttggacagcaaa

SEQ ID NO: 64728 - DNA, 1048 bp, Homo sapiens
gtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagtgtttcattttcttgtctcattactacccctttcatactctaaaccagtggtccccaacctttttggcaccagggactggttttgtgaaagacaaaacctcagactgagagtagggggtggtttcaggatgattcaaacacattacatttattgtgcattttatttctattattattacattatatattacatatataattaaataattatataactcaccataatgtagaatcattgggagccctgagcttgttttcttgcagctagacggtcccatcttggggtaataggagacagtcacagatcatcaggcattacgttctcatagggagtgtacaacttagatccctcacatgcacagttcacaataggggtcacactcctatgagaatctaatgccactgctgatctgatacgtggcagagctcaggtggtaatgccagcaatgggagcggccacctaccactcgcttcctgctctgcagcctggttcctaacagaccacggttgggaacccc

SEQ ID NO: 64729 - DNA, 2050 bp, Homo sapiens
tatcaattggcataaaaataccttattattagggtttcttagttttaaaagtaatgggggttatttaaaaaactaggaaacattatcgagtgtctttttttatttttttgaataggctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggtacaaaaaaataatatttgccaattctttttttttaacatagactttcaactattagttgaggtttatttcataaaccaagtgtgccattttgattataaaacagtctgttttattttcattaaattttaattatctttctctctgaatattaattcactaacaaaatattttaaagtcttaaatttgatatcttaagtcagttgaccgtcgttagtctaggagagaccttaagatatgtttagtttgttcttcttactctgaaggtggattatacaagctattgttggaggattatcatgtttattattcattaatattttcactgaaggaaatttcacactttctattgatgtttagcaaacctcaacttactctgaaatggtcatacccctaaagtatggttgaatgtgtgtcatccaagcaaacatatccttctcactttatctgcataatcatacccaatctaaatatggaaagaaaaataccttcactattctatgccactgggaatgcagaaatctcttgatagcaactttacctgtgttataaagagaaaagaataccccaggacaagcaagggaatctttacagtatagcagaatgtttttctttatatattaataccaaatggttttctaattatggacacatttgcttccttttctcttcatagttcaaatcaaaattattattttttatttgtcactattaatatacaggcttgatccttcttcattctcaactaagcattctatgcctgtaccaagcatggtgccatcctacatggcaatgactactgctgccaaaaggaaacggaaattaacaaggtatgattaaacataaactggtttggttctgtagttatataagataatctttatatattatatgctattgcttttttattttttataattagactctcaattcatgtttaagcatacttaggataaatttctctgaatggggtactggatttatattatcaaagggagatcttgaaaaactcaagtatttcacttgatattttataaaatatttcatattacagacttaaaaataaattgaaaagttttctgtcaaaaactacttaattttaacttttctggggtgacaatttttacttatttcgttatttctacttacttcattatcctttttaaacattaccaaatttcttccatcatagaattatgttattttaatggattaagatatatgactaaaatataatgagtgaagagacttttatttctgcctaagacagtgtagcttgtatcagaccaagctacctatcaagaacagttgtaaaaagtgcataaaatagaaccaacagctgcttgaaggcaatggagaacaaccatgatagccaggatggagagcctgagatcccagagaaaagagaaacatgctatagacagctagactttctctgcctctgttttttatttagcatttgccaatttatggcataaggcatagag

SEQ ID NO: 64730 - DNA, 1381 bp, Homo sapiens
ttcagatacttccttctttattaaatcttccttttaatggatcatctttcctttgcctgcatatattcatctgtattcccatggcttttaagttttttattcctttcactagtgttttaaccttgttactgtcttagcaataaatatttgtttattttaatttggaaaaaagtgaagccaaaagaaacaagatatactttattaacttatattagtatttagttttaatagcctactgaactttttttctaagcatacatttgtggtttgcttttttaaaacaagaacagtggaatctattatatatatatagttgataaccagcctctttttcactgaactacttgctgtagacacattttgctatcaacgaatatgaatttaagtcatttttaatagctgcatattatatttgcctaatctcctgctaattaacatttagtttgttttcactttattattacaagcgacaccccattaaatgtctgtgcatgtgtatttattttgcaacttgcctaattatttccttaggctaagcccttagaagaagaatagcttaatcaaacagtatgtatactttaaaggcattagatatgcattgtcagattccccacccccagaactattataagtgtagtctaccattgtaagtgggtaatgaaggtgaaggtgaacattttttcatgtgctttttgtctagttatagtttgttctgaattaactgcctcttcctttgccttattttgctcttatccattttgttttgtaagaattatttctctcagagacagaccagccaacctatatacacatgtatacatagacatacatacatacacatacacgagctctaaatcctttgccaaatgtgttacatgtatttttttctctcttattcatggttggttttgatttttatgtaacccaattttaagttatgaagatattcatattttatttgcctactttctcttttcagtaataataggaaatagcatttcattttgggagcaatgaagtagtatgttgcctcctattcatatttttgagtctgtgaagaaagttttatttttttaagtctccattatgtttattatatatgttattactctgtattacttgcattactttttacctgacttctacctggaaaataagaaacatgactccaactctggcaacaacaaatataattgctatcatgactttgagaatgtcattttcttgctgtgagcaacaaattataaaataatgaagtttaaataaacactaaaaccatctagtactaaattctggttgtttgtataagatgatccccattgtaactttcctggtggccagtagttaggaccactcttttaaagtagagattcagtgaaaa

SEQ ID NO: 64731 - DNA, 1561 bp, Homo sapiens
ataaaagatactaggagaaccagtctcttaacatagtaccaatattctgattgaatatagagttcacacataagtttaagtttcccctaaaattacttgaatacaaggaaatttcatttgaaagataggaaatctctatactaatttctcatataacaaatataaagcaggaaaatgttaataaaccaaatcttccatattttttccatttggcaacaaaatttaatcatgaaacaatggaaatcatgcttgtatccctaaatacattttgtttgacttatcatccccatgtacataagacagtatttagttattcatctatagctgcaaatattactgtgaattaaaaggttctttgtattgtcccttcttttccatctttggtaagtgtaaatactgagaaaatgaaactgagagagaaacatgatatctgctatttcccacagaaaaaatatcaaaaggttatgggttgatttattattcaaagtgctggattaatttaaaggactataatagttccctatgtattaggacaatagttccctatgtattagggaactattatacatccctaaccatgagagtgtctcataagtgtattataaaatgtttattagtttggttaatttagtggtaccttatcttatatttggttaatttaatggtactttatcttataagataagtttacgtatcttataaatagttaaaattcatttacctgtatcatttgcaactatgaattccatgagtcataaggctgttaaaaagaatccagatttatgatgagtacactaattgtatcaatcatttgtagcctagaagtttttattgaaatgtatacattaatatttgatttcactttagaactttgccaactaattttgatttagcacagtttcccagaatttctcctcacgtacatattaacaggagtgcttgcttgcaaaggaagaatccttgccatcgttttgtaccaaacctcaattagatctaatcccattcatcaatgtctccctgtcatgaaccctactttgcagcctatgactcatgtttgctaaataccgcattcttcctttacaataacatacagctctataaatctcttaacgtttacagtcttaaacttttgataaattacttcctctgggtaaaatcattcagaacacatgatatggcacatcaaaagatgaccccaaaagccctgcccatttttaagagagggattttaaacccattagtgataaattatctagtctctttattttatgtaaaggaaccatctgtgaaatatttccaaaagctgaaaaataaatataaagccccctctacttaagaaaccacatgaattgccatttagcaattatgttttagagatttatttaaaacaaagagagaaaaagatgtttcttaatttattttaaaatatttttagaaaatttggcataagaaatgaataatatagtgacatctaaactagttttaatttctcttgtctctttccactgcagtctacacttcacactgccaacaaagtgatcttcctaataaagtgtagacc

SEQ ID NO: 64732 - DNA, 1474 bp, Homo sapiens
ttttaattgaagagtcttttttctgtgaattgcccagccatcctttgacatttttctgatatagtcatctttagtaacaatcgttacttttttacaagatcttaagtgtaggttttttttcattcattcaacagtgtttaacttacagcagtatttcaggcacttgtctgatgatagggatcaaagtatgaaacaaactccaccaccctcaaggagctcacttctagtagagaaagacaataatatagtaaataaattaaacagaatgctaggaggtactacatgctataagaaagaaataaagggagttcaggagtgtggccagggaggagagagattgctattttcagtagcatggtcagggaggatctcactgataaaacttgaaggacttcacaggactagctatatgaatatctgggagaagaaacttttttaggtagagggacacaatcacagtgcaaaatctctaacataggaatttgcctgacatattcaaaggctggtgaggatatataactggtacaaagaaaaagagaatgaaagtagtgaggagatcagagagataaagggaaggaaggcagatcacatagggccttgtaggttactatcaggacttaattagtcttttactctgaataaaacaaggagccatgacatggtctgagcagaaatgtaacatacctcaattgtgctcttaaaagatctctctgactgctgtggtgagaatagattatactatggcaagggctgaaacatgaggaggcactagaataacccaggcaaaagatggaggttattcagaccaggataatagcattggagctggtgagaagtggtcagattctaaaatgttttgaaggtagagccagcaagatttccaagaaaattagatttggaataggagagaaagaaatgcttaagactgaatctaaaattttggaacttagcatctaaaagaattgagtcaccttcagagagataaggaagacttcagatggagcaggtatacagggtggaggttgtagaaaattaggagttcagttctaggcatgttaaatttgtctaagatacatccaagtggagacatcatgtaggcagttaagaatctgaagttcaggagagaagtctaagctaaaacataaattcgagagttgttaacatttagatgatatttaaagccataggacaggatgaaatcactaagggatattaactttttcctgtaatatacatagtataactatacccttcaagatttgccacttattcttgcttttgtttgaggtttcctttttaatgctgaaagttaaaacatttatgtagtaaaatagcttttttctctctcttactgccttcgggatctttcctcaaaaggcctttccattcataagcttttaaatttttgtttccactttctcctaatttatgttggtgttaaatgataggcaagaatctaaatttattttttcca

SEQ ID NO: 64733 - DNA, 1031 bp, Homo sapiens
accattgcacttcagcctaggcaacaaagcaagactctgtctcaaaaaaaaaaaaaaaatctgatgagattaactataatgaatatagtctatattgttgggcatttgggttgtttaataaattttcactattattgccaataatgttttagtaagcaaatatgtatatttatctttgtgctcatatctgactatccctacaataaattcttagaagtaaaatttctggctcaagataaatgcccattatgcaaaatttgaaatatatattgccaaataactctcctccttcaagtgatttaacccccatcaagcagtataaatgaaggagctttttttttttttttagcctcaccagcttttgatgttaaaatatttttaatttctacctttagtaaatcaattacaaacatgtatataagcacaaagaatactatgagtaccatgtgcccaacacctaactttaaaacttatcagctcatgtctagtcttgaaaacccatctgctttcctccaccccagctcttacactagattattttaaagtagatctcggagaacacatggacacaggaaggggaacatcatacactggggcctgttatggggtgggggaaaggggggagggatagcattaggaggtatacctaatgttaaatgacaagttaatgggtgcagcacaccaacatggcacatgtatacatatgtaactaacctgcacgttgtgcacatgtaccctaaaacttaaagtataattaaaaaataaataaataataaaattaaaaaaagattaggattcatttagttgtagcttgcaggccaaagctgattcactatctgttttttatgtcccatgtgccaagattttttttttcacatttgtatatgactggaaaaaattagaaaaatattttgtgacacctgataattataaaacattcaaatttcagtgttaataaataaagttttatttcaaaaaacaaaacaaaaaaaagtagatctcagacagcacatcatttcttccatttacat

SEQ ID NO: 64734 - DNA, 1347 bp, Homo sapiens
gcctaggctagagtgcagtggcacaatcatgcagtcatggctcactgcactgcagcctcaacctcccggactcaagtgatgctcccacatcagcccctccaccccaccaagtagctggaactacaggcacatgccacgaaaccagcctaaatttattttttaatttttgtgtggagacacggtctctctatgttgtccaggatggtcttgcacttctggcctcaagcagtcctcctgcctcagcctcccaaagtgctagaattactggcatgagccaccatcccagcctgcattgtagcattctgtcacaattctcatcctagcgctgtggtcagtttgatgggttacattttgttttgttttctcttcttgactatccaggtttttgtttctttgagacatttgttttgtttttgttactgtcttactgtgacagacagagactaggatattataattaaccagagaagccataaaaaagagtcaggaaccttagtgagaatgacggtggctatcaactatttttcccttatctatgactctagcctgaaatggaatctgcttctctctgactcttgtatttcccttgaggggaaggtaagtaaaattttatgaatatctaagatttggttatgacttcatgatagccacctttgcctgaccttaaatcatttataagctcatatcctctatccagatgaagataaccatatttttctattatatgcccaagtctcaatagtacatcttttgtcaaaattaagagatatttatctcccaaagagggggagttcttcgaccaaattcaaatctagtttctgctcttcttttttttgatttcctgcttccagaaccagctgcaaatgcttattttaacctttggggatccactgtttcaggtctacccatcctatctgataattattgactttagtgtctgtgggcaaataccccagagacgtcaagatgttctggcccattgttttcatgatagtgtgcaagacccttagggtaagaaatcaaagactaattttaatttcaatttgtgcctaggtaaaacaccaaaaatattttgaatactcattatggctcctgaaccaagctacaggcaagatcagatactgataagcactctgatataagctcttttttctgtgatttatatcagccaatttgaggccttataggcaaacacagaacaatagaacacattatttcttcacatcaaagacaagagcaatatatgcatctgctttgattttgagtaaggagatcatggaatgtatctgaccttgtatgaacttttcaaatgaaacatactgaagggactgtactttaacgccaaaa

SEQ ID NO: 64735 - DNA, 1077 bp, Homo sapiens
cttaatgggaaacatttcactctaatgtcagggtttaacatgcatattttagaatgtattcccaaacacttacttgccattttagagcaatgggtggtggtagtattctgatggaaaatgtcctctgagaaccatcacagaggatacatttgatggacattagaagtaaaaagtcataaatggactttttgaggtttcatttaggattttctgatattaaatattgctgccaccagacccacatgccctggtttctaagagtccctacgactgtaaatgctaaagcaaaataaagatgatttaattagctgcctgccttcagttaggtacaatattttcatcttcatttttcagacgaagtaactgaagacccactaaaatctgtttgcctaaatttttacatctgctgaatagcagagaaaagtcaataggtcacacctcccaccttctgttatagcagtggctctaaacttcaagtttcaggacccctttctgcttttaaaaattatttaggacttcaaagagcttttgtttatatgtattccctctaccaatatttctatattagaaattaaaacagatttataaaaatatatttatgcattgattcattttaaaataaataatattaaataatagcttaattgtaaataataaaaattatattaataaaatataataaatagcaataaattataaataattaaatgttaaataataattaaaataaaaattatgtgtggttacataaataattttattttctcaaaaatagtgaaaatagaagagtggcgttgttttacatgtttgcaaatttctttaatgcctggcttttcatatcagctctattctcataactgctgaattgttattctgttgtgatgttacacatcatttagcctctagaaaactactgtgcaactaactgtatgagcaaacaagaattttaaaagactaataacattttcctgatattataaaaatggttttgatagttttaaccttgtgaactctctgaaaggatctcaggaatccttaggggtccctgtaccatgcttgggtaacctttgcatgata

SEQ ID NO: 64736 - DNA, 1064 bp, Homo sapiens
acagataaaaggaagaatctgcagtattttctgtctatcagagctatttggaaaggtaattctcaaaaggaaatcataaaaagaaaacacaattgttcttttataaagagtaattataaaacttcacttatgactataccaagaaaattgtggagtttaatactcatgtattacctaaaaatattggtgcagatacttttaacttgaatgtttgcttagaactctttcagttttaaaacgatagctttttttggtgttgttaaggagctctctagaaacctttgataccaattcccttcctttcatcctaatcagtgaacaccaccacctaaaataagtctagatcacaaaattgacaaatattaactttgtccttgaataaaaagttatagaaaaactaagaaattatctctttaagtataacctaaagataacttatcaattcatttactggcattaccgttggtgtaatataatgcaatgaaatcacagtgtctgtacatatttcctatgaaatatttatcagtttgacaaaactgcagtaaagtcagtgttttgtggcttatattcattcccaatagagtttcattaagagctactgacgtaaattggcagtgtttttaccgctgatccttatgagtatatctaaaattctggccagtttagaacattttttttaaatgcatgtacttgattttactttattttaaagtcttcactgttatgaatgtttatactgttactgtagctcagagctgatctatgacttaaaaccatgaatatattttaaaaaattaaaatattactgtgaccagtgttctactgacccagaaggatacaggattgcaggttccatccagagttttcataaaatttaatcagcttgaagtctgtggccatttggaaatatgaatcaaactcctcatctttgatattctagacctacattgcccttaggaggaagcacactgcagcagcttttctaggtttaccacattataaacttggatgttttaagtcctggaagtgtcagttgattcttagccaggctgtagggggtacct

SEQ ID NO: 64737 - DNA, 1349 bp, Homo sapiens
gcctattatttcatctgtaaaataggtataaagcttattttttaaaaagtcttttctacataatttatagtccacattcatgatgttgatgtaccaatctctgtatttctccagaaatataataataataattggttacattagtatttttgccaaagatgtgttgtacttaaaaacatgtatatcaaaatatgtatgtttaaattataatatatcggggttgaaaaaacctagagttaagctgttgtgatgactcctcctcttctccctttcccctctgccactctccttaagtgtctgaagatgagcatgttattgtcatcttaagaaaaatgttcccaggctcattatataattaattgtaaaaggtcatactatatgggtgtacagaaaggtttgtaacacatgattttcatgtagcccttacactagccccttgaggaatgaattcttagctccactttacagatgagtaacccaaacatcaaacagttcgaattctaagtcaggttaagtgagaagtaggcaaggtctcaatatcaagtatttggatttatatgtttaatatcctctctactataccataaatgtcaaggggcccatactatgataaaaatgttaaaatatagtaagaactcagtgaaaaccaactgaattcctgaaagggtagcatgaaaaactatctctgcattacttagaagtcaaaggagtaagaaagtagggaattttattatattgcaattacatgcttataaataccttttctcaataaagtaatttctttataatttcatttacattattaatgtgctcagcagatcctcttgtcatagattttaaatgtgagcataattatcacaaattctgaattcatggaactcaatgaaaatgcaatgtcatgttattcatgtatttatctctgtgattattatctctctataaacaatcataatttctatctttcaacagttgaagagcaatgttcttaatgtcaataatcatataactcaatatgtaaagatctgtaatgagcagaaggcagaggtatgtctgtttatatttttatgctagtcttgcgcagttcttcatttatagaattttataatcttaattgtccaaaaatttaacatatttttctattaaaattaaaatctggttaattcagttattttttacagctaaatttggctgtggccatgtaaatgacttcttttgtattttaactagtgatttctctctactagattttattgttaaaagaaaaactaaaagcctatgaagaacagaaagccttcactaatgaaaatgaccaagcaaagttaatgatttcaaaccctcaggaaaaagaa

SEQ ID NO: 64738 - DNA, 1004 bp, Homo sapiens
atagtgctcttaaatatcaattagattataccttgttcagttgttttttaaaatgaaaataattttgattttgtgctctattaaagtatatatttcccttttaattttgttaaatcttatcctcatttttttctattttgtaatttcaaaaagatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaaggtaggcattatatgtttatttgttaaatagtttgaaatattgaaatagataagaaagatactatttaatatgattttgttttaaaggtctgatatatatcacatttcaagggtatatcagtaatgttaatatatagatcaaagacctcagaaaacctagtgtattaaactgatttttatttcttttttaatttccagttttataatgagaattggttaaatagaaagtaatgaataccagattgatagttaatattttatggtacattctcatcacttattttgaacttggtttttaaagtgatcactacacagcaaacatgttaattaaattggcatgaagacaaactaaccatatttttaaaaactaaattctgttgtttagtattttatatattataaaatagggttaagtattaaagagtgttgatttttttttaaggggggtttaagttataaaatgtcatgaaatcacctaataaggtaatgtttactagatgcttctgggcatatttaaatatagtttacatataccatatgccagaagtgcttacctagaacacagtgtatttcacaacatagatatttgtaaaaatgacatcctttcaaaaaaattataatatggcaatttaagttaaaccatactcgaaagct

SEQ ID NO: 64739 - DNA, 1027 bp, Homo sapiens
aaaaatatttcttcatattatcattttactacttttaagggtttattacattctaatgcctatcattcattgtagagaattgtaccagcaatgaattatcactatgagctacttattagaacacagaaggaaataacacaaaataattttttagagactaaattttgttattttttttcttaaatcttgtcagtaatagttgtaattgtcatttggttagcaagtaataaactttatacctttaataaattcataaaatcgggtcactagtactacatagaaatgtgtgttacttataaaaattactttttaaaaaatggccagagatataaactacagatatgtattcagtatgatgcagtagagtgaagctgtctaggctccagttcctactctgctaatacctttatgaccatggacaaatcatttaacctctcagagtcttagttccctcatcattcaaatgggtctccttttgaaatttattattagtaattatatgtcaaaattaatgtaattgaaggataaccgaaacaaataccacctgtccttggtatgggttttctgtaacatttaagctctaaaatttcaaaagtttggactacttggacattgtgaaataatagatatcttccacagtaagaaccatgccatctccatacaacctgcatttcccagagtttcccagtaccgtgtgttccatacatttcctgaaaataagaaaatgggccgggcgcggtggctcacgcctgtaatcccagcactttgggaggccgaggtgggcggatcacgaggtcagaagatcaagaccatcctggctaacatggtgaaaccctgtctccactaaaaatacaaaaaattagccaggcgtggtggcaggcgccagtagtcccagctactggggaggctgaggcagcagaatggtgagaacccgggaggcggagcttgcagtgagccgagattgcgccactgtactccagcctgggagacagcgagactccgtctcaaaaaaaaagaaaagaagaaa

SEQ ID NO: 64740 - DNA, 1746 bp, Homo sapiens
cttgcagccaagatcacttttactaaaaatagttcacaagctaaggctctccaatcataccttgatatggttctgggagatccttttctattcattcccatgacctaagctgaaatagtgctggagggcttgtgaaaatcaaatctgggttttaggatagcatatctgtgattatatatggttcagctatagtatttgagtttaagccaaatatcctactaatatttcaggtaaagagatttttatcgtagttgtgtgtacgtatgtgccatttaattgtttgttttagggtacttaagtgcatatgtgtgtatgtgtgcatatatttgtgtgtgtgtgttgtgtgtgcctacgtatgtatgtatttttcccccagtgtttacctagtgagtgaaacagaattattaacatcttttttgaatgaatactacatgccagttgttttgcatgaaagtaaaaactgatattaaaactttattttcttttttaatttcagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacaggtatttgtttcaatttgggatttaatttctctatccgatttcacttttgcattaggacggacatctacttgacccttctaaatataatcaaatttaaggagcttgtatgctaaaaattcttaagaaattcaatagacttgaactgtaaatatagactttgaaattttagttatcatatataacttatacatcatttgtaaacctttctcttccagggccttactgtggcccctatagacatctgtcctttcagttgcctatgttattaaaccacatgcttattgcaattaacatcagttttctcataacctgtatttataacttttcctacagcttacctatgtaattatctattcctggagagtagtcagacatttctgaacatttgacagtttcttttcagcagtttttcttcatggcacattgaaataaaaatgtttaagttggcgaaggataggaggagactgaggatcaaaaaactacctatggggtactacactccttacctgagtgatgaaaaaatctgtacactaaaccccgcagcatgcaatttacccatgtaacaaacctgcactgtacccccaaacctaaaataaaaattggaaagggggtaaaagtgttaagatcccatgttaattatctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatttttgtaattattagtatttatgatattttccccaagacagctcacaactat

SEQ ID NO: 64741 - DNA, 1053 bp, Homo sapiens
aataagtgttataagaaaggcatgctgttcaaattagagaagggaaaacacaagcagatgtatacatgtgagtactggatctttaaagaacagaatatttcaaatttcagttagaatacgttgagctgatggaaaggtctagcaactgactgagagagatgaaggtcactggatttgaggtgtacatattgtcaaagtatgagacattgtgtcagtctacatgcgcagatgttgcattcatggttattctgtttataagtacaaacacttaaacttgaccacttaaatatgacatatggcattgctaaatatgacttgattttctgaagtagagagctattcttggttaagtttcttttgatttatgcaatagttacatttctagaaaattcagtgtatattaattaaatccttataaaaagtactgtgtgatatgaaaaatgacattttgttttaggcttggataattgttgctgccccctctccttcatgaatagacactgtaagtcatggagaccttggatcagtttattttgtagcatgtgctgtgcatttgtgcattgcaggatatccaccattcctgtagctcacccattaagtgctagtggcatcctcccattttttttttttaaattacagtctaaacacattttcagaatgcccccattgagcatttctaggttagaggaaagaaggcacagagcaatatgtcgattagacccaaggagaaagcttctattttgcacagtgaccaatacgatagagatgtgaagcagagaatcacctggcaacagagtttcaagtacgttcctgaaataaaattgccatgaggcaaggtggtaaagttttcttaccatctcaacctcctgtccacatttagcttctttcctcgcaccatctctagcccaggtttacctggtagcctggttatgttaacaccggtggccccagtgagaattcttgactggttttggtaaagtgtgtaatttcagcatactttctaactaaattagcatttttcttcctttctactatacttccaagcattttttt

SEQ ID NO: 64742 - DNA, 1102 bp, Homo sapiens
tgactcgtgttaaaaaccttcaagacaatttcaggcttactgtggtcactttaggtcttggcatttgatcaattgaggaagattttgaaaaaaatatatttctcttaacacactatggtagccagtctacaagatgggttccattgattatcactgcctaataatcatgctcaaatgtagttccctgctgcattgaattaggttgaccagtgtaatccataagatactgcaaaaatgatagtgtgcaacttcaaaggggaagtcataaaataaattttggcttcttccatgctgtcttttggattgcttgctcaaggtgggacagctaccatatcattgtatgcttaagcagcccatggagaggcctatgtagagtggaattgaggctcctaccaacaatcagcacccagtggttgagcagtcttgggaatatatcctctagtcttaaccaagcccgcaaccttgtgaaagagaccccaagttagaatcacctggttaagctgctactgaattcctgatccatagaaaccatgagataatgaatatatatttggtttaagccactaaattttagggtaattttttatgcaggatacagaagtaatatacacagaaataaaggcaaagtttcaactatgttgactgctctaaaggaaaggtatgcattactatacgagtgaccaacagacttcttttttaatatggaggtttgggaaaagcttgtgagctcagattcaaagaacaggaaagatattcctaacggaacaacatgtgaactggccctgttgttgattcaagatttttttgctgcttagctcagcaaggtccatgttcttgtctcatgaccaggaagaaatagccacgtggacattgaagagcgagtaggtgtagtggattttgttaggtgaaaaggaaagctctcagcaaaaagaggggtcctgaaagcaggttgccggttgcccacttcacagttgaataaaagggctttttacatatataccaatggtctgggttccctatttgtataaagcgcaaattcctggtagctccaccccattcccccgtgcgtatgtgggctcttagttggcggtggacatattta

SEQ ID NO: 64743 - DNA, 1064 bp, Homo sapiens
gtgagttattatgaaaaaagtcttattcattccggatggcatgaaaatctcagagccctgcagtaacgactaatttatatgagaaaattgatgacctagccaaatataaaattagcctgtaacaatttctggatagaaatgtttaggaatttggagttagtaaaaaggaatgttcaacctaaagttagcagctttcttacttacaaaatttactgctgagagggttatttgtaaactttgaagcaaaactctagtcaaaatagcatgtttcttgtttagcaaaaggaggcaggaccaaaaaaggataattctcattcattcctttgcttgagaatataagatttggtagggtggaagaataatatgaaaagggagtaattttgccatctcttcaaatttgcttcaaatattcctctagttaatagaaataccagagatctgctctactgagaaacaaatgggaggttagaaagtcacagaaccttagaaaaacaagatatatttcaaaggtgattgaaggaaagctttgtttaaaaggatgaagaaaaatccagatctgatagtgttgatttaagaattatcctttcaccaaaatatctgcagaaatccctgaaattcttctcttacacccccagccacaaataatgcaaggaaaataggggaaaaaaagggctcaaattgacaaggtggttgacctgatatattttattagtgatgcagaaatagcaaagttttgaatgttactgacaagtcaaaggtcactgataacaagagagaagatgctttttctggcaggtaaaaaacagaattgaagatgattttctggacaaagagaaccaactaagagaaggttgatttggcttttgaatcaataattaattttgctgaatcagccatgcacactgcctctggactgttacataggctactctgtgctacttttctgagaaagaagcaaatgatgtaggaaaaacatcatttttttttttaaaaaaaggagagtaacttctaaaacatctacatgaacagacatttttcaaaagaagagatacatgtggccaaag

SEQ ID NO: 64744 - DNA, 1033 bp, Homo sapiens
gacagggatagcatcaggagaaatgcctaatgtagatgactggttgttgggtgcagcaaaccaccatggcacgtgtatacctatgtaacaaacctgcacattctgcacatgtatcccagaacttaaagtttattaataaaagaaaaaagaattactatatcaagcagttgctgaatcaggttcatcacagaggggagtgcaaacccatgccctgaatcaacctcttaaagctatctacaggaatactttgacttcatggtcttagaatttactttacctgagtttaattcttagctttaccactactagctgtgtgaccttgagcaactgttttactccatcattatcaaatatttattgagcacttattctataccctattactaagtaaactaatagaaaattctctaagccaacgtttctataatgataaaaatgtttacattatataatttataggattgtgatacaggtcaaaatatgatcatctctgttaaaatattctgtgaatcataaagtagtatactagtattatttgctgtgagctttatgagaatagggactatgtcttcctttgttaccttattatctaacatagtacctgacacatagaagtattcagaaaatgtctgcagcagactgattttcttaaagatctcaaaagcatccatttgtatttaggatattatttccgaagttaagcttaaaatacacataatttattcttttgattatgtaatggtattcatatatagtttgaattatgtggaacattcctaagggacttactgcaagaaaatgtgttactagataaaatcatttttatatgtgccctattatcagcaggccctattttctacaaggtaatgtagggtttgaattaaaagaaattgttaaaagtttattaaatctactatggccaacaactgttgctatttttgtgcacctagagctgtagttaatcttcagatttttgaataatttatttcaggtgtcacatatatatattgagtggctgaaaatatattttgta

SEQ ID NO: 64745 - DNA, 1064 bp, Homo sapiens
agttgcctttcaatagcaagattctgttatttctgtgtttccaatgctagtattagcattttaattttcccaataagaacagggcaatttgttgattattctgttagtggcacccatcagattattttgtaaactgtttatacatcttttcctctcagctcaaagtacagaaagtcatgctttattaatctttatgtacactccaaataacataatgcctgacccatagcaaatattcatttactttctccattggaattgtatttaaaaattactaatgagctgttgaagttcaccttaaacaacataccatgtaagtaaatatcattaacgtaaattatccaacactgttgaaatccaaactcactctacccacctttagacagagggaatgacatcttgagagcattgcccaattttctcttctcattcaccttccaaaatgcatgctagttgccttaaggcttctgaagaaccataaaggcagcatctcactttgtgtaggaagaagaattagtatagctgcaaggtgatcccaattcctgcctgtctgttggttctgaatgctccattcacttcagaatccctgctgagagataatacattgcttcagcaagaaggcatttattttagtcatagtttcattcctcaagtttatagctgcatagcaccctattctaatttataggaaaaacatggagaaagctaaaatgattggtttgaacatatttgacatcttttttatgatttatattatagtgttgtatttaaattggcttactcgttattcttttgatagaatgacatatgcttttttctctacccagagatttaagaaatttttaagaaaatatgaaagacctggtttgacataggaatttttctaacttatgaatatattgtatcccttcacaaagatatacaataaattgtgtttatcagcagtaataaaattacattaaaccagctctggtgtttgaaacccaagatgtatagtttccatatccatgtctttatacaacactaagcactcaataaatatatatcggttaaatcatgtaata

SEQ ID NO: 64746 - DNA, 1052 bp, Homo sapiens
tgtgtgcattaatcccccagactccctgagggattcatttgtacttgaaatccaggatagaatcttgcctatccttctctaatgtcagctttcttttgcttttgcatgcttctcccccaaaaaacctctcccccaaatacaatttttaaaaaaatatactgtagtttgctaatttgtataatagtagatttttattttacacaggataatttatcatttgtgtctaccaaggtgaaacatggaatgatgagcaaaaggatttcttgatccatcgcagtggttgataagcacctgtataagatctgacattacttctcttagtttcacatttctgcattttaatattttgggcaaaaggagaattgcattgcccaaatgctaaaataaaatacagtgactcatatatctgttctaaacaaccaactaacaaagggtatatgatgtataggttattccactttgtgaatgctaactaaatcagccttaggggcttattgaaacatttcatcttttctgctatttcgctattcaccaccataaacctcttgaacctaactctagctaggaggcgctttattatagcctctctgtttgaagccaaagttgtttcacagctgtgttccgtgatgaaagttttccaaggcaaaaatataactcttgcagttatttaacagaattccaatggtaaaattttcatcttgttgaaccatctgaaaccctgtatcatttttatttaccaaatgtattaagattttttttcagtggttcctattaaattacttaagtaaattttaagaagtttttaaaaaaggaatatttgtgtaacttataaatagaacctgatattggctgtctctttcttaatattatccatagtttaagaagtaaaacttaattataaattcatttagatcattactatttagagatcacatagcaattgttttatgatataattaaataagactatattctacttagttattataatgaaatataaagagctgactagcctttaattttttaagccacatatctcagggccctttgaa

SEQ ID NO: 64747 - DNA, 1030 bp, Homo sapiens
tttctccagaaccattcaagttcacagattttaattaacagtttgaaatttgtaatattacttgaatttcagatgggtgagaatttaacactatattaaaggagcccaggcaaaaggacatgggttgcgtcaccgagacttattaaatgtgatggaaattcaacagccgaatgctggcaaacaggtgcaagagctgaattaatatttaaaccctaccactcagggggaattgcagtgcatcacgttgacagccacagcacgatgctaatttcattcacaagcttaaaaatctcaatacatttaaacacgtgaatgtattaaattttaaaaagtgtaagtagcataagggtatcccagaactaaaaattgcaatttctctctgggacttcaaatcatttatctagccagaagcatggtgctttttatgaatgaagtatatcttactactttcacatacaaattgtgttctattattatatgtagtgcagactgttactaagcaagattttctcttactttatgtgaaattctttgtgagtcataagaaaaccaaggattcactgatagagtttccagcttctgatatcatacatgaaacagggttctcaatcaatgcttccagtgatgctaagtggtagaatatttctggaggtaaagaaaaacaaaactaaatacatacagaagtttttttggggtgatatcattagaagtggtaagttgtaagctaaaaactcagccaactcccaatttgcgtttaccagaaatttacctactgtgggtcacttgttcatttaagaatttgatggaagcagcagagcatctccgcataaaattgcatgtacatgcaaaatcctatgaagatttcagggagttcatgaatttccacattccaaatattgtttatgatacgtcttgatctttatctgggactggaagggtatcccttattgagaggacttttttctttgccacctgctgtgtaccaggccttaaaatggattggggaagtaaaggaaagtaagaaaagatc

SEQ ID NO: 64748 - DNA, 1013 bp, Homo sapiens
ataagtgctatactaggggtaagcacacctcttctcatgtatattggtactaggttaacaaagtccattgatggactataacacacaaaaaggagattttctctcatcaaacctaatgacacaaattgtgattttccatcttacctactctattccttaatcaaatgaattagccatattagactctgtggtgaaactcaggagatgaaaaagcagaacaataagtttctatttctgataacagtatatgggagatgagaaggaggtgaagaagaattgcaaaacagtgagctcctcaagggcggggaccatttttctgtcttattaatatttttctccctgtggcctcattcagagtccagcataagagtaggcattgaatctgttagttttttttttttatcttgtgttcttgattaaatcaggagccagctgttcttacctagtttgtgcattcctaagataactctgttccttgttctctgatcagtgactttcaggagaaaaccatttttccttcctcagaggcacagaacttttattgtctttaagcttaataattcatagaaccttgctaatcctttgtggttggattattttttcttatccatgtgtcccattgccagtcgatgttttgttcttactactttaatttccattatcgcgtgccattttattttaatttttatatattttgagacagagtctcactctgtcgcccaggctggagtgcagtggtgcaatcatggctcactgcagtctcaacctccccagactcagatgatcctcctgcctcagcctctggagtagctgggactacaggcatgcaccaccgtgcctggctaaattgtaggatttttttgtttttgtttttgtttttgttttttggtttttgtttttttgtagagacagggtttcaccatgttgcccaggttggtcttgaactcctgggctcaagccacttgcctgccttagcctcccaaagtgctcccaaatccttccctcctaaagga

SEQ ID NO: 64749 - DNA, 1349 bp, Homo sapiens
acagatgagaaggcaggaatcctggagcaacacacctaagtcagtgtttcaacattaacgtccacttttaaaaactctttactttgaaatcatttctaatgtatagaaaacttgtaagaatagtgcaaagaacttccgtagactctttttcagattaaccagttttaaacattttgtcatatttgtctcatctctgtgtgtgtatgtgtgtgtgtttactacttaatgccttagtttcttttttaagaagaaagattttctcctatataaacatggtatagttatgaaattcaggaaactggacattgatacaacactttaatctatagtccacattttaattttattaattgtttcaataatgccttctataccattttgtaatccagtcttggattgtgcagggtatttagtgttcatgtccctttagtctcctttaaacaggaatatgtcttgtccttacttggttttacatgatattggcatttttgaagattataaaccagttattatatttcattatttttttgagacagggtctcgctctgtcacccaggctggagtgcagtggcatgatcgcgactcactgcagcctcaacctcctgggctcaagcagtcctcccacttaagcctctcaagtagctggaactactgacatgtgccaccatacctggctaattttttatattttttgtagagatgaggttttgccatgttgcccaggcggtctcaaactcctgggctcaagcaatcttcctgcctaggctcccaaagtcctgggattataggcttgaacccccgtgcctggcctggcctgttattttatattgtgtccctgaatttggattttgtagagctcatgttttaaatctgcttttgaataacatgtctcttgcaagagattgcaattagactctctgtccagattgagctgggctcaagaattctcgatatagcaggatatgtggagcatctgtaaccactggacataaagcagctagtgaatgcagggggtgaaggccgtagggtggggtggagacccttgtacctgagccggggtgtaagctcccatcaatggactgacagggaccttgaagggtcaccaaggccatctgcttggacttcagcagaaatgcacatttctactcttctagatgtgccagtctatttttaaagccctccagggaaagtaattctgtgtgtagcttccacactggtgctctcgcctttgctgtgtgaagttttctctgttgatcactaacttcctcaaggagcagatcttacaagtttttctcatcctggtttccggaagggctgtctgtgaggcgtgagcccttcattctgtacag

SEQ ID NO: 64750 - DNA, 1061 bp, Homo sapiens
aacagcaagaacaagaatttatattctcacaattctgaaggctaggaagtccaaaatcaaggcaccagcatgtggtctagtaggcacctttccgctgcatcctcatgtggcaggaagtagatgttcatgtgagcacaggtttgcagaatgctgcccaaagcctctttcaaaggacattaatcccattaacaaaaagcatccctcatggcctagtcatctcttaaaggcccacctcttaatattatcacattggcagcacttgaattttagaggggattaggtttcaacatgaattttggagggaacaaaacatttaaaccatagcagaaagtgtgtcaaaaatggcaaattatgtagaataaatttagtgaactttaaatgtcagtacttctgatttgggtttaatatccatttagactgacaattagcactggggttttaatgcagacctctaactttcatttttgaaatgatattttttttctaaatgttggctttgttttcagaacaacttttcagtttaggtctttactacatggctttacatttttttttcttatcccccacctgccaaatatggcaattttctttgggcttgaatgtgtctaatatagattttgtatttcctaaaatacttagtggactacttggcacatagtagatattcaatgatatggtttgactttgtgtccccactcaagtgtcatcttgaattgtaatccccatgtgttgagggagggacctggtgggagttgattggatcacggtggcggtttcccctgtgctgttctcatgatagtgagggagttctcatgaaagctaatggttttataaggggatcgatctctctctctctccatctctctctctctctctctctctctgtctctctccatctctctctctctctccgtctctctctgtctctctttctttctctgtctctctctctctctctccatctctctctccctccacctctatctctccctctctctcttgctctctctctctccctctctctctctctccctctctctctatccctctctctccctctc

SEQ ID NO: 64751 - DNA, 1050 bp, Homo sapiens
tcttaaatataatctgtaattgcagatgttttcgtgaagttctgactttacagggaacgcttctgtttgattattaaatgtctattataagacttcgataaataccttttttattccttattttcttttagataggtgttgaattttatcaaatgctttttcagtttcctagataaacttgcagcacaaatttgattctctttaatattttctctagggtgatcagcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatgtatgtgtaatagtcatttttttctacattgtgaattctaccatgtaggattttgcttaactataagaaaatcatatttacattattactaaatttgttagcatacagtgaattaaaaggaggggtgaaagtggatgatgtttctaaatattattcacatatactgaaggtcaagattgggggataaagaaagtaggcctgggaaagtaataataaaatatgcctaagactccaagctacaacttttagtgcgaagactttaggagtgggttttagaatattctggccaagccaggatttagtttcttttctgataccaaagtaactacacgggacatggcaac

SEQ ID NO: 64752 - DNA, 1028 bp, Homo sapiens
ctttcctccccaaataacaaacataaacccttaaacaccgaaattttgtttcaccaaaacttttcaaaaagattataatactattctagaacttgaaatcatattctctgctcttaaaaatatataaaatacaataataaggacccaggattgttaggaaatcagttatgtgccactggattatatagcagtttttgtgccttctctcctgtgttggcagcagccattgcagttttcacaatgccttcctcctctgctcctaatataccagagactaaaataaaataatggaaatgttactaatacattaaccaatatgctttgaatatggtctagggccatgtaaattttcttgcacttaggctctaaaaccttgttttcttttttgtgtgttccagactgtcttccatgttagggaatcgtctggtttaacattaaataaaatgttaatctgttgtctgttgtcaagatttgagttgataatttgtttacctttcttcagggaagaactgctaaagctttgaggtcattacaatttacgaatccaggaaggcaaactgaatttgctccagaaactggtaaaagagaaaaaagaaggcttacaaaaaatgcaaccgctggttcagacaggtaggctaagtgttactgaagacatgttaacttgctgcttcacatctgcattgttcccctatttttctcttaaattttgaattttctgggttcatattttaaattggataatgtagaattagtaaaaacctatgaaggcctttgtttttattcatataaaattaaggtatccctttcaactacaaaaatttgtttctaagaaggtagcagtgaactgaagaaataattttggcatgagagttaaaataattacaattaaagtaattcacttatttgaaaagcattgttattatatatatacggacatacctcattttattggtgcttcactttattctttacaaggtgctatttatttttacaaattgaaaatttgtggcaactcggtggtaagcaag

SEQ ID NO: 64753 - DNA, 2237 bp, Homo sapiens
gaaatgcagttctgtatagtcaacataatgaatgggagaactaaattgtttagaatatgactctaaaacaaatgttaatataatcattcagaattttttttctaagttcagtcaacatttctatatatgccatgtattccatctgttaaaatttaccattgagtcatttaaatatttttaggccaaatttactagagtccattaaagaacaagaaacattaattgtagtataaaaatctatagaggtggtatactataataaaaataaaactgtgttgataaaacagtgaagaggttggtagctaataaagtgaaccactattaacctgtcattcttttttgtttgtttaaagtaaagggaaaattatgcacttcaagaagcgtattcagaatttttagatttgtctcaacactctatagagttaggtctcctcttctcacatggagttcatttactgctgacgatagaataagccttgagcctgataaattatagatgattttggcatgacctcatctaaaaatattttatctccttttttttttttactgtattttcaattaaatcaaaaataacatatttatgaggtataattcattgtgttttattttacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcatgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctctt

SEQ ID NO: 64754 - DNA, 1068 bp, Homo sapiens
taactgttcactcacctgttaccagaagtacatacagttagcttgtcagttccttgatctgtatgatttacctgaacactggcaaaagaatatttcagctttattcacttaagtcagatgctagattactttctctaaagtaaggaaatacttcattattgaggacataaacactccagttttatctgaacattaggatcattagatcttaattgtttctaccatcttttagtttttctaagtatgacagtgcttaggcttttcgtagggacaaattaaaatcaggttttttacttaaaataggaatatttttgatggaatgaatgactttaaaattgccatattgcagcattttttagaacagacctgtaatttttcaaagactaatacgtttttcaaaggaaaatattcttgagcaattttgctaatatttgttcatcatgcccatttagggaagcaaacttttaatgagcatacaaaatgtttacagagaaaggtgtatctgatttacagtaagctgtaataaagctatgttttggaaaaattaaataatgagcccacttactattttgtaatataaaattacagaaatatggaatataatgaaatcatctagagcctctttatattgtgcataaatattccaggtgactataaattattttagaattaatctaaaaagcaaagttttataaacaatttctgttgtgtgtagatcctagtagagaagttaggtcacaaatgttggtctcacacaatgttggtcacaaatattaaggtagaaatgcatgtatatatttgaataaaatgtcatctcgtgatcttttccttttttttaaaatatggaaatagctatttaccttgtaacatcatatataggattcttctctttttaaagtattatgtttagttctatataacaggctgttatacaacctgacagtctactctaaaactgcctccctggcgtgatttcaagcaagtaatttttagcaagtgaattttgaaatatccatatatatatatacagtgattcattattaaaaacataattttagtgagttctat

SEQ ID NO: 64755 - DNA, 1021 bp, Homo sapiens
ggctctgtctagccatctagaaatgcttgcctatgcattggggactttcaaaagtctggagcaggagggtctatgatttgatggaccatggcttgggaaattctaggaagaaaaaaataatgtgagcaattctctctgtgtatgtatatatgtacacacacatacatgtatgtgttaatatatatcatatgtaaattaaaagctgtacattaaccctctgtgccaaaaattttacaaaagttcattcactttatccacataggcaaacattctgtttttatttgtaaaaactgaagtccagagaagccaataattggccagtctggaacttgaacttgggtctgtttgactccataatccatgctcttaaccgttgccttcaaaataagaatggctaacttttaaagagcctgcaggtgctcgttacgctaactggcacagccaacctgccagctcctaaagtctgggtgctatgtgatctttgcactttccccttcacagcttctgtgccaaatccgagcacagctgccccaaggcttccaagctgtaatccctgcagaaggtgcccagaagactatagtaataagaacccaagtctttttgatgcagccagctcaggacctgtctgtgcattgaaaatttgtggacgttgatttgtaacaccagggctgtgaccctgagtagcccacctgaggataacaggcaccaacttcctgtttccaaatcctgctttcctaggacgcacccagcccccactgaagtttgtgggggagtaaattgctattcacctgtccaagcctccctggatttatggcttggcacctcccttctgcctgcaccaccgtactgtgtactgcaaacacagatgaccttttcagcgatttcgtcctaacttgcttccataaagaaaacctgttttgtattgacattgtttggagtaagttctgcctatgttaactcccttagcccctgcccctggaatttcagcccagggaggccaagtgcttacaatttcaagagc

SEQ ID NO: 64756 - DNA, 1153 bp, Homo sapiens
cattttgttaacaagtcgggattctttggtgaggtcagatttcttctatctgcctcccttttactgctcttgattttccagggttaataattcaagatgatagctgaaccataggactaaatttcaaagcacagagtctagaggtgttttaaatgaagagggaaggttgtgcaaaagtcaactgggtagaggaaggctggcgactagatttaggctagtattcagataagtgtggatccagaagagccccagctcagagtcatgcctaggtgacaagccaggtttttattctcctaacaggaaaggacttacttagaaacagagagtagccccttccaagtcttctttgccattctagggttgaaatttgatggggaaaatagaagctttcaggtctcacttaagagtcaatgacaacacaaggaaatctgtctcccagtccctttttcagcttctagttcagttaacatacttttacgtatttgcaaagatgtgtaagctgtttaatagaatcatagaaaaacctaaatgaacagggaatgggatgtattaaaacaaacacaagggagttaaaagaaaattcattctgagttgtgggtaggtaacttagtgtttaggtcccagttttttattgcatcctaatgcttgagcccagcgatgctgaggtaggcctggtgatgacaatattcattaaagttaatttcctgatagaggccacttaaatctgattgttgttttaatttgtttcactgctaatttccttcgcttaaatagaggaagctctctgcccctcccacagccagcccaggcagtttcagggaggtgacagccatcacggcattcaccaaccagagaatgccatcatgtcacactctttaggcaggagatgatgtctttatttatctctagaacctagaagttgcctgatttggaaaatataggtgctcactttcaaagtctaaaagtatattgctttattgaatatgaaatctcctccattactcagctagacctaaatccatctaggacttaatgggaaaaatgtgagtcccagcagtgtccaggatttttgaattatacatactcattttgttgtttgaagaacaaatataaatacagcacaggctaaaacatcaaagcaggagagaaaact

SEQ ID NO: 64757 - DNA, 1042 bp, Homo sapiens
gcaaagcacccgtttttaagcccagacatattacgattccacagaacacactttgggaaacatggtagtaatggtatttcttagcgtcctctgcatgcatcattgtggtaactctgagctgataggacttagaagcagtcatgcctcatgcagaagtcaaaggagaggcctcagccagatttagtggcagctccgattgtttattgagtgaaatgaacgtgtcagcagtagactgcagtggaaaaaacactgggcttggagtcagatggtcagaacctattcttggcctggcactaccagttttgctgccttgagtaaagaggttaacctcattgagcttctcttttctctgtaaaatggctattacctgccctacagctgccctaataaccatcattcattcagtgctccagagtccagaacaggggtcagcaaatgttttctgtaaaggactagaaggtgtaataaatatcttagactttacggcccatatggtctctgtcatggctactcacctctgccattgcggtgtggaagcagttgtagatgatatgcaaatgaataggtatagctgtgtcccagtaaaactttttttttttttttggagacggagtctcacgctgtcacccaggctggagtgcagtggcgcgacctcggctcactgcaacctccgcctcccggattcaagcaattctcctgcccgagcctcctgagtagctgggattacaggcatctgccaccacgcccggctagtttttgtatttttagtagagacggggtttcaccatgttggccaggctggtcttgaactcctgacctcaggtaatccccccgcctcagcctcccaaagtgctggaattataggtgtgagccaccatacccagccccagtaaaagtttatttataaaaacaacaagagagatttggcccacgggccatagcttgctaattcctgatctaacgtatgtcaaggtctttacctatattactgctaattctgcctgtaggattaacagaacacctagatttataccagagaaaa

SEQ ID NO: 64758 - DNA, 1064 bp, Homo sapiens
taaggtagtgcaggggctggttccatattaaacatggtgatggggatttaagataataatgctaccatcagtacatctaaaattgtttaatgttttactgcaaatattttttagctagaagaaattaaacaagtggggaagattctcagaaaccaacacagcccaaaatgtgcagataaagaaccaaaaaataacgtagaaaggagcaagattataataaatatttttaatgagttaatttatttcctctttttaagtcttaacttgtaacattatttgaaatcacagtaaatgtacattttatttcttgtttcagccctgaggtgagtttatttggaatgtttgttttaaatggatttagccatcatggaattaggtcatcttggaaaaatgtgttttttctaaaaaaaaaaaaaaaaaatagaatgatgttctgtgtgtttgagagtaatttagaaaccactgttaatttccagtcctgttatggactccttcttcaggaaggtaagtgcttttgatgtgtttgaagcattttgtgagacaagcaaaacaatttggagcaattgaaagtgacaaccctgccccgagcacatggcttcattttcattacgttataacgcaggtggaatgcagatcatgccgggtcagttctctctctcagtatcatttattctacctttctgtgccttaagagcaaacttttcacttaacacaaggatgctatccatttggcttcttttttgcttttccagtgaatagccatttgcttatcgacttgtttttgaacttactataataagctttagtcaattttcttttaaaataattttttggctttaactcttgtgagatagcaataacacaaaaaagacatttattttgctttgaaactagtgctttttccagaaggtcttgtatcccttaacaatttgcattcatccattcatcaaatgtggattgagggcaatgtactgttccaagcctcggattactatggagaagcataaggtgggttcatctctgcttaagatgagtttgttgtttcgttatgcagtcattcgtat

SEQ ID NO: 64759 - DNA, 1009 bp, Homo sapiens
atataaaataacagtttagacataatcccatatcagttaggatttttatgttccatgcaattttatgttaagaaaagtcaacccaaacaatcttgtacaaatgcaatctattgtctccatattttaaaacttcaaaggtagatatggctttagagattttgatgtggccttaacatgtaacccagatactgtttcttcctttacacttctgagctccatttctcacaggttggctccatcctcaggcatgctgtctccttaggctttcaaaatgatggccagccacttcgcagaactaagctgggaggaaagagcaaaatccagagactgagcctgctggctgatttggctcctatgctcatgcctgcaccaacctccagggctaaaggggtggaatgcacaaatggccttagcctgggtcacaagtgccatcttgctgggcctgaagtgcagccacttcactgtggatccccaaatggaagttggggctgttggggagaggaaatggaggaatgagtataggaaaccaactaacaaatgtccactacgagctgtttactgggggtaggaaataaacagcttgtctttgaagctcattttctttacacaattacaatcatttggtgtttattttcttcagttgttatcaggattacattgcaattgatatttcaaaattgccctgagtggatagccgagaaaaccttcgtagtgagataaatctgtacaaagacaaggtggtagagatttctcacttcttatacccctgttgtaagtttaccatttgaataaaaatggacagattcaattgcaaagtcattgaactattgctgactcttgtttccttttaggaaaaccacaggttctttaggaaagtcaacttttctccctccaatagttaatgctgttttcccaactgttccccttctgtatgacccttttctttccagatttaaaatctcttcatatgtgccttttaaaacatcttgttaaactttccattcatcaa

SEQ ID NO: 64760 - DNA, 1123 bp, Homo sapiens
tcactgcagcctcaagcttccaggttcaagcaatcctcccacctcagacccccaagtagttgagaccacaagcatgcaccacaacctctggctggttttttagttttttgtagagatgggatcttatgttgcccaggctggtctcaaattgttagactgaaactgtcctccagccttgcccccgcaaagtgctgggattgcaggcaggagccactgcgcctagccttaccgcttaatttgagagacatattctgtagatatacccaaatgttgtgcacaaatggcgtgcactgtagctgggattgacaagaatcacgctttgactttagcaaccctgaaaaatgttttttttttgtcatttggttgcatgtggtttatagagattattctgagtctgggcattaaattgattagttgtccttcaaaaatccatgggttatggttctaagagaaaaagatagcaaatcaggacacatgtgcacccctgcatcaatggtagaaacttattcctgtgtcttctcaagtttcatttgttcattaacttaactaccatttatcgaacgcctgctcactgtaatgtcaggcacagtcctaggtgctgggaatatgggaatggacaaattaaaatactgtccccagaaaaccttattagcctcttagtaaaagagagagagaagtagatcatttaacagactgtcacaagtgctacagcaattttgtaagatgacttgggagacagacatgatgagcacccaattcagcttgggtaaggacaagcttcaggaagactgagacgaatctggaagaggatatttaaggcagaaagggcagcatgcccaatgagtagaagcaagttagaatgcaggacatgtgtggtaagatgagaaggtcataagggcctcatgtgccgggtgagagagtttggatggtatcctgtggttttggtgaaccatggaaaggttttaagcaggacaattatttggctatatttatcttttggaaagaactctagcagcaatgtggactaagatgaagggaatgggaaggaagtgagaccaggaatgttataattgtccaggaacaagatgttgaggatcttactttgaagcatcatcacgtgagg

SEQ ID NO: 64761 - DNA, 1037 bp, Homo sapiens
acacagaaggatttgagaggaggtcaccatgctacccttcacatagattcagctgctctgaacattccatcagccttaggtaactcatttccctctcattttgtactggaagcagtcataaaatatcttgcttagattagggtttctcaaacctccctacacatcagaattaccgtctctgtagaaatatagattttgaagcccttcctccagagactctgattgtccttcctgagatgaagcccagcagtttgtattttttaaagttacctgggcaagactgatgcacaggtggtttgaaagttactggttgagagctggcactagaattctcagaactaagctctggaaaacttgaaacaggtacatgtatccttggaggccagacaagaagcgtgtcaatcttgattgtatcagttgacagttgtcaggttttaaaggagttacttcacagtgtctgagcctcagttttcacatctctaagatggtgaagatgatacctattttagagggttatgataaggataaaataggtaaagtttgcagtggactgaagagaatatcggatagtttgcttagggtatgaattataatttttctggccttgggctctcccactaagtatttatgtgaacttaggcaagtcatttaggccctagagccagtttttttttttatctttaaaatgagaatgttagactaaatgattgtcaatatcagcaggttctaggactttttttttttttgagggtgtatatagagcaaaactaacctgtgtgtgtgtatgtagagcagaagaactcacctttactcacttaatacagaaaagtaccccagtccttcactaggagttgtggataggactggaaaaagacaagcagactgaattcagattggtcactttactcaacagtttggcttgtcctctgtaagttaaaaggttgagatattttctttttttttttttttttgagacggagtctcgttctgtcgcccaggcgggagtgctgtggcgcgatctccgctcactgcaagct

SEQ ID NO: 64762 - DNA, 1067 bp, Homo sapiens
cgtgtgtgtgtttaggtcacaaaaagttgtgttggaataaggccatggttgaggcaagaatgcttacaaataaggagttgctgagcagcaataaaatctctgggcagttttcgtggtctaaaaattgtggatattaatggcctgcttccccatcatttgcacttgtcagttgttacctgccatcagtgcaatgcagtagtgactactgtaagggatggggagtggacttttgtcttctttgtgtggactaaggtttatcacatctcctggtgccttgggattctctttatggaggaggctgaagcggaggagggagcatttccgctgtggtgtcttacactggtgctcattcctgcagtggaccaccgggctttcactccgcatcccctgccttctcctgggtttctggctcagccctgacattattgtaatatagttttctgtgtttaatatttcttagacctggtttcccattgcaagcatggaagaaaccctaatgcatgagtttcagaggagaaggtagcagtctgaacctgctgtgtggctccatcagcaagtgtgagtattaacgttagagctgtcaggacttgtgaaaattaatggagcctgacgggggacagactgaggtcagagacagagcttgccctgactgaatgtttctggtggttttgtagctgagtcaagtgagtgcaaactgtggagccaagggggatttctggagtatgcagtgggtaccaactaagtgctaagcattcttctaggtgccaggggtacagcagcaaaaagttggctctgcctcctcatagcttatagaaccccctccccacctccaggctggactcaggccttctctgctatcagcccccagtaattgccaaggaaggaatttagatgaaatgtctccttagcccatcctgagcctcatagttcttccatgctcctagcagttggtattacttttttcctttcatcttcctgcagaattttctgcttggccagttttcaagcccaggttattcttattcattcctcagtgaaatagagaggcttcaaaagttttaacattt

SEQ ID NO: 64763 - DNA, 1048 bp, Homo sapiens
ggggagatatatggggagtatggggggatagcagcttaagaaatggggagggagaagtgctgcaaattttagtataatgcataatgttgaaagaaattctatcccatcataaagattagcaggctgtgtaattcaatttaaaattggttggcgtgtcctgactattataaagcctttcctttttttgttgttgttttatcgccattccattatttgatgtcatataccaatacagaatggagcatacagccaacccatccatacagggtctctttccacatttgcatccattggagaaattgttggggaatgtaagagtttatcttaaaatgaattaagaaaatgcttgctcaattgaatgcctccttgttttctttctttcttctttcttttttttaacacaaaatgaatttcttctgggcaagcaaccattgagagtgaaattcttttaaaagcatttgctggacacaggacttggttctcaaaattccagcattagcacttatctacagtatcatgggcattacagtgccattgaaaatcaagatgcagtagcttatgttaatgcaagactgacagacccacatctgatggcaattacccatactggggggttaataaatgttcttagaattactgtctttattttctttattgcaagaaaaatgggcagcttcctaagccgtgcctcctgcttcttgctaccagccttggtgacttgataattaactgttttcattccagtgcttcatgggctcttctgagtttaatattcatgttagggaaatgctacgtcctttagccaaagtagtaaaaatattaaattaaattcagcaaacatttatccaagtaccctttaagaacaagaaatgaagacgtatagaaataataataataataacgagacttggatgcatcagaagagtgtctggaaaatgaatgcacactgttttttccttctagaagggagcgagcttaatttttattccttttctgaaggggtttcagcacaggtgtggcagagagaattcatcacacttgccagctc

SEQ ID NO: 64764 - DNA, 2046 bp, Homo sapiens
tgtgcccataaccccagctactctggaagctgcggtgggaggattgcttgagcctgggaggtcgaggctatagtaggctatgattgtaccactgcactccagcctgggtgatagagcgagatcctgtctcaaacaaacaaacaacaaaagaaaaaacaaccaacaaaccaaacaaacacaaaacattatgtcgtctagagggaagggatagaggagattcagatgtcatgtaaaacattgaacgagatgccccataaggtttagtcctgctttgggattttatgctgctatgtttttttctcatcttcccatgtcaccttgttgtcccccaggtgtactcaaacatatgtgcaaatatcactctaatatttgaatctggctctggggtttagattgccttggtaagatactcacttgctaggatatttgacacgatgccttaggggaaatgttaggtcatttgagaactcagcagcataaacagtaagtggtaaagttgtaaactaaggatgaaaatatagtgtgagggccttcacacaatatgaacagataggatcttccagtagcagttggagtctcccttagatgtacttttatagtgaaaatgtttggctgtcttgacttttccaggtgtttatcaaatgcccaatttgggaggagtagtttcctgagggtggtctcagttttaattatctccactggaatttgcccactctgctagaggtcttattttcaactctatgcctgtgggtggaaatgtcttcttcctatgagctccaggtgatatttgttgtaccatctcacagagtggctttggcatgttgcactgccttgtcttctgaaaccatctcttgctttgtacttattcctatggatagcaaagattctcagtgcctctgggtcaggatatctatataaagtctgcatctgtatacgcctcacttcccccatcccctgccttgaatcgatcttctgtgcattctccctagtgtctacacattatttctctttgatggcatcatggtggtggtgtagatgtgcgagccttctttgcttgtcttgctgtctactttggactcaaagctgagaagaaacacttactatttcagctcaaagctgagaagaaacacttttcccatttttactgtcccctctactcagctgttccttggactttgatatttaaatgtttctctgaaggaggtgggaggtggagaaagaggttgaagtgattcagaaattgcctagtgttccccataatgtcagaaaatttattgcctagtatgaagtcaagatgaggaaccaattatgtaccatgtgatgattggctactttaaagtgggtagattcatagaacagggaactatttacaacaagaggtttacatctgtgctactttcagtctaattcaaaataatgacaatgatgtctgtctgataagctgagatgacctcccaaaggattttgatgcagtagctgggtctgtagcttagctgagttacagaaaaggagaaatggggctgtgtctgtatgttagtattagaatgaaagctagaaaacaaacactagaataggtagatattacatttattcatatatttagagatgtagtggctgatttattaaattttcattcaaatgttggtgcattaagtataaatgcaaacagtcctattctagtgagcatttaactattggtatagggatattgcttatcacttttagagagtgacacagtcagccccagcagggaacagtcattcattctctgggaaaactacttttcaaagacaggaaatgttgctaagattgtaagcaccgagactgagtgtaaccaagtctcagtgatggaaaggaagacatcaaacatttttacatctaaaaaagcaacatcggctataatgaggagggtttccaggttactaatgagatcacagtggattagtgaattttctacgtggtaacagcatattaatttctaacctttctaacagaaaaaatccattaattttttgcggaagttaaactttctttttgggcttccaa

SEQ ID NO: 64765 - DNA, 1037 bp, Homo sapiens
caatactgtattcatttgttattggaaaaacaataataaatatggccggaagaggaatcagaatggaagccataatattatcatattttttgtgagtaaaaaaaccctaatatgtcaagactgaataaacaagaatggtttatttgtttgaatatgcagtgagatatgtaagcatttgatgatcaagcttcaagaacaagatttgaggcttggcacaaaacttggaaagttcattggaaaatggtttaagatgatagctcaggccttctctagaaaaatctgccaatttgttcagcagtgccacctccccatggcctgggctagcatctgtctttgatgaacagctcattggttcatgaattcacacagaccatgaattctgacactacaaagggagggattctccccagtgaaattgtatctgggaggaaatagccttctgaggacattagacatcttatcacacaaggaaaaatggaagaaactgtagctactccactagagtggagatgatttccggggattataatagattgttttcaaatagttgaagaactgtccaatggaaaagggactgggttcttattttcttgttatttcagagtgcagaactaggattaagaaggagggacaggcaggaaataaatatattaaagaccatggattccgctcccagtatatgctgggtgttgtgtatgtgatttcttttaattctcacaaagtccctgagtgagtggtagatgttattatctccctacaacagaaaaagagatggaggtcatagaagttaaatgatactactactaatagtagtaaaaatactattagttactagtaaaaaaaaaatactaacatttattgggtatctacttcatgtcagacactgttctaaatgctttgagtacattatcattttttattctcataacaatcttaggagataggtactatatttatatctgttttactgatgagggaaccaaggcacaagggttaagccccttgcttggtgttgcatgttaataagttgtggagtg

SEQ ID NO: 64766 - DNA, 1052 bp, Homo sapiens
agatggtgcttggcattgtaggtaccatgtttaacactcaaagaaccctttgaagtggctgcttatccctcccgcatgtggcttgaatcagaattcaggcccagctcttatcctgacaaagcccattgttttccattaagccatcctgactttcaacttgaagcagtttctttcctgtttctcaatcttattttaacaggaacggtgaagattttcaaaattccagctactgtgcctagaagtgcaaaaatgctcttttgtatttgcttaacctttaactgcttaaaacaaaaattcgtgtttgttgtttgtttgtttgaaccataagaaatgcaaatgcaacttagaagttgttctgtaagaccacacaaccatttttaaattcaaagacttagctttgaatcttggatttttagatgatggtcatacatgtgcatgagggtgttaaaagagccttggtaattgtgatttctgatttcagtgttacagtctatgactattgcaagttctacattgttttttctacctaatgcttgcccttctgccttcttttttaaaaaagaaaatataatgaacgtggtctgttatttaaaaagtgtgttttatggtgcagttcatggcaaatggtgttgagtggtgatggaacagtgatttttggaaataaactgagtagggcaagaggagaaaagaaggaattcacatctgcacccttggtttgcattggaacacaggcagcagaggtgggtgggaggtgtttgtgctcttccctgtgctcaccgtgggtggccgggcctgtcgagaacattattttatttatcctagaggagttgctgtaattgttgaccagaactactggcatttggggttcacacatcactggactcagggtctgttggcatttgaagagtaggactcatggtgattcttacctatcgtgaaaagtgatgtacctagttcccaaaatggcttggtttatgaccacaggcaggccccatccttagggctgtgtgtctagaaatcttgtctgggcctgacagcttaaaagcctttgg

SEQ ID NO: 64767 - DNA, 2053 bp, Homo sapiens
ccttctctttcttcttacattttctggcctatagggtcatatggcttaagttagaacaaggagaccagtcaaaaagagccaaggcagacaaggcaaaatctacagaaatgataataatagtaatgataataaataatatggctaccatttattgaatgcttattgtgtaccaagccaagtgttaattgttgtaatatattatatcataaccctaggaagtgagtggtgttattcccattttgcagataagaaaaccaaggctaaaagaggctgccaagggtgacctgggttttacagcttgtcaatgacacacaactttgcctgaatctataggccatgctaatctgtcaaggaagcagtgacagacttgtggattaaaggtttggatttgactattttattttcttttccaaacaatgttcatgataaaaccatgtggaattgaagtcatgaagaagcatgaggtaaatgcaatccagacccacaaacatatttttgggatagttccactgattgagattctatagagaagcatgacctaggatgacatcttcactcagaaacaaatatggaggaattcattgtttggaggttggggaatggcatggagaagagcatattgggttaagagtcaaatggtgtaggcctccattccttagtctgtaaaatgagactaatactggttagagaagatggtctccaaggatccttacatttcaagcattctaagcttttaggctgaagttacttaaaattctttgtattattagttcccggactttccactgaaaggctacagggattgatgataatgcaggagagagtggcaaatggaaacctcactctcgtaagtcatggaattacagaaggaacactcaaggctattaactttcagctgaacatctaaaactgagtggaaaaatttaagaaggaaaagattttctctaccttgaggaatctttggcctgtggaagaaagagatttcctaaaagaacatgtcagtatgggagtattaaaaaaatatgtggagactgggctggaatgaagaatttgagattccaggggaatgtgcagaggatttgtttttttcattggttcatagacatactcattgtattagtccattttcatactgctatgaagaaatacctgagactgcgtaatttatcaagaaaaagaggtttaatggactcacagttccacacagctgggaaggcctcacaatcatgacagaaggtgaagaaggagcaaagtcatgtcttacatggtggcaggaaagagagcatgtgcagggggtctgccctttataaaaccatcagatcttgtgagacttattcactatcatgagaagggcacgggaaaaacctgcccccatgattcagttacctcccactgggtccatcccatgacacatggggattatgggagctacgattaaagatgagatttgggtggggagacagccaaaccatgtcactcatctaagaaccatgtgaacagtagcctgaagtactctaggtctgaaaattcctagtttcagccttgccactgactcacactttgatattaatatctgggtctcattttcttatctgtaagatataaagtaagtttctaaaactgctttctggtgccacaaatctgtgatttggggtatcttgatatcactatagcaagagagtcacagtgttgaggtggtgtttggggtgcctggactgtcaagtggactgagtcctggctgagtgaccagttcagaggacatggactaaaatagtttccatgaggaggaagaaaaaaagtccaacattaggaaaataatttgtagttgagtgagaatagtttgtcctgtggggtgaattaagtagatgatggtaattctgctttcatataccatggcatctgggaaatggtggaggagacagaatagtctaaaccagcacagctgtggaatctgggagactatctgcatttggggctggtgtgaattgtgggtttggagaggacaagaaatcacaatgagcagtgtacttagagaactgatgtcagagaagcc

SEQ ID NO: 64768 - DNA, 1022 bp, Homo sapiens
tacaaagtacatataagtaaggcagttcttacctgggaatagctgaactatagcttttgaggaaagagaaagatataggatgatcccagaatttcagcatgagaacgactattgggtttgaagtgtgactataaaccactcagccagacttttctttctttttaataaatttaccagaataggtaaaataataataataaaatacatacaaaatatatacgtgtgtgtgtgtatatgtgtgtgtgcatgttctattggttgaccaattcctgcaataccaatatcactgaaaacaattgtgaaaccactttttgaggattgtccttggagccaggtcatgggcacataaagaaagagttcttcatattttccagccacagacattatctttactcgtatttatttatatcttcctagcaaggcccttaggttccagttcaacacgcccaaggaataaaattcattagtgagttctcacatttgactttctccctctgaccatgaggctcttcttaccaggctaatgtttctttgattggatccctcatggtcattgccatgaagagttctcacatacatattactatagcaacttttcacttatcttcaaatatgttggactgactgtcagaatgttgacccagcagttgatccagatcattctatataaatgggaatatgggagacggaaataattgcacattccattgttaacagcaccaaggtagctggttagagatgtttattgattggttatttagccagtagcctttccttaaaagaaaacaaaaggaaactaacaatcataatggatggacatgtgctaaatctcataactagaaagaatatttgtaaataaacatgaattatagctctgtttattatacaatagtgagagctaataatttgccttgacataatagctgctttcgagctatcatgagtcatgaataaatgaaaatacctataaatttccaaagtatatttgaattcttatattttgcattataggaaatgataca

SEQ ID NO: 64769 - DNA, 1048 bp, Homo sapiens
ggaatttgcttgggtgaaaatgttctcaagtttataggggttcatgataatagtgttggccctgaaataaagcaccatttctaaatattccactttcactatccttgtatgtcttctttctcagtgtttttcaaagagaacaggataagtgcttgggcactactttagaacacagattataatcagactttgggattaagacgtgtagccaatgtattaaattagtcacttagtaactgtttgagtatgagaataagaaactggagggaggagattgggagctggaaaaaaagcaccccctgattgctctcggggaggctgggaaaaaggatttaacactttggattttttaggagacattaaaactctgatgggatcaaattacttgactgcacatctgaaacatgaaactcttgccctaaaccgtgcaattgagttaagctcaaaattctaggcctgcccctaagactggcctctgggtaagcctcattgttgatcgcaaaatgatttcctttgagaggaacaagactacagtgaggtttttatggccaatttggtctgtgcattggtgccagccagacttttggcaagagttagtgccaactttggtgatctgtccaccgaatttttcccaaggtcttcaaaaccgtctggatttactgctgacattgaaggaaagatgcattataagtccagctttctaggcacacctcctgtattttttgttttttcaagtagagagatactgagaggtgccagagaacaacaggctgatccgtggccgtaaactttgagtcacaaaagaatgttgacagtcttcttcactaaacactattttctctctctagctttgtcccctttttagggagcccctgtccttctctctggattaggtgtccccttatacatactcccagaacctgtgagtgatactgtcctttggctgcacttatcttaaatatattcttgaattgttggtgaaatgtgtgtcttccactaggatataagctctatgagggcagtgaccttatctttttcgttttattta

SEQ ID NO: 64770 - DNA, 1540 bp, Homo sapiens
tccctagacttcagtcaacagggagatgagacaaaattgcaacttggctttctagggtacacgtgccgactcaatataccaatgaatctagcatatgaaaggatcaggatagcaacttttgatactttgacctatgttgatctctgagaaggaatgatttttgggataattcaaaacttttaggcttgtatttcaatattttttaaaaaatcatttgacaaatagtgaactctgaactgactttcgagagatgtaagactatctgaagttgtgatttcccaaggttcgccatctgttagtatctgggagacttaccatatgttgtgctcaaattctgacttttacaggttaacttgttttcactttattcttcacccatacattttgggtacagccggtagcattgaaacctttcttgactcaataaacttagagagaagaatggtgaggaaagaacaaacaggctaggaggtgttgactcctaaaggatattaattcttaattcttccataatgcaattcaaaaagtctaatgctttcttcatgtaaaatacatgtaaaggcttgggtatcctgtttggtacagtggtgtgagtcctgttctaacccctcttgcaactgatcctcctgagaattcggaagggaaataataatcccgtgggagtctgtttgctccacgttgtgcccctcggtggtggtggatggctcccctgttttgcatctctccatctcgaccccaccacgatgttaatggctgtcggcacgctccactgtttatcttggaatttgatcccatcatcttggcaaccaaactgggacctttactgctcagattgtttgtcatttgttgttaattatctgttactataaattttgcactttgagaaaaaagggaatgttttgaaatatttcctccaacatgtaagtggagcttcattttctgtggacaaaagagaacaaaaaaaaatgagcccttttgggagctggttttagggaaatcaagtgccctggtttttcagatgggctcagtgagatcccactagtgcagccaggatttgcactgaaagaacctttgcaattcagcagtggtctaagacagaccattagtgacaggtaccccccattggagggaaaaaataatttaactttaaataaggggttttgctttttatcccaatctctttatgccataattgcgttttttgtatgctagggcctgttcccttcagccactttttaaagattattaatacaaagcagtccagagtgagaagtagcttctgcctgcctgtctttatgaggggtttattttgtcaagtgtagaattaaaatgagctgtctagtcattagtggattttagttctggtctcacactctgcaggaagggtcgtgccatgttataaacagatagcactgttttgcagggtgctgtaccacaggctgcaggaaccatggttgagcttaacatcttcataaaacggtaaacaaaagaacatgaaagagagagagagggaaagaatgaaggtttgtattttagaggg

SEQ ID NO: 64771 - DNA, 1027 bp, Homo sapiens
cacacacccccccaccctggaatttacaaacgctaaccaaacaaaagggtctttccattgactgcctggatattagtgtaaatactaggatgttgctttgcaagtatattctggagagcgagtcagttacctatgatgagatttctgcaaagcagccgttttaaagcagcatgcttgagtgaccaaaaaaaaaaaaaaaaggaaaagacaatccttgtaagtggttactgctaaactatttgaaagaactttatacgttctttaaatgagaatatattcatgattatgaaggatcgctaacatgattttaaggaaaaatggataaagtttttctttgttaaaatagcttttctgaacaataaatatctgtttaattcaaatattctttttattctactgtttctatttacttgtttttcttcaaatatgttacaatatttgtgtaagccatactttagaatagcttcagttctgttttgctggtgttatgtttttgtattaaagaactacaaggaactttgtagatgctgtttccattcaagcaaaacaaagtgtgttttgcccagattccttggaaaatgactgctggggaacctcagcttagttctcaagtctgcagacatctgctcacttgttcttggcctcaagattccactggcgaactgtgaatgcacagagatattttaaaaatcatgtaactttaaagttgatctgcttttatctagccataacaaatttgaaggatcaaattatacctcttttgaaaaaaatggcttgaaaatggggcaacctagacagctgtgtagtgctttcaccagactcctgatcttggaatagaggattcttctacaggctagttccagtgtaccttttcacttttattgccaataagggcttcccatctgaaccctctgcttcagccacacagtttggctccctgtcatctgaacacatcttagcaccttccatcttggtgccattgccatcactgtttcttacagagcgtaacacatttacgctctgctca

SEQ ID NO: 64772 - DNA, 1048 bp, Homo sapiens
cagctttgtgctccggctgcgccccgcggccgcccccggggccgcccgcgcgcgccgctctcgctcggggctctttctcaccccgtccccgcgccccaacctcactctccgccgctgcctgggtctccgcgctcgcagcctgcggagcgacccggcgacccaagctggggtcgaggctaggcgacgggggacgagtaccgaggaaaagtaaccgttgccgccggatttcttctctacagaggcaggagtttctttgctatttacgtataacaaggttatctttgtaaagcctttgaattccggggttttgcggcctaggaggtgaagggggcatttttctagaggctcaggagccggttggaatccgtcagcaagaaaataaattaaggatgccccagtgaagttgatttataatagtacatcaccacccccctctcacacacacaccccaaattaagtgcaaatgcgggtcatgaaaaatgtataattgatttgagatgctgcaaacaaacacaaacaggtcgggggggtgggacaaacaaaagtttaagtgaaaaaagatgtcagaagagggggagatcccgtggcctccacacccccttccaacgctcgctggctccctcccttcctttctccgccgttccagggaaggaacctggcagcgcccaggcgtagagcagggaggaggcggcggccccgggctcgggctcagcgctgtgggttcggggatgccaacgcgcccgggaggctgaggtcggggacgtggggctgtgatgcccgaccgaggatggcgtggtgtcagagccattggccgccggtggtcatcaatcaatccagagctagggaagagggagagaaaaaagataggcgtccagcggagcccggggccgccagcgctagcgccagcagtgccagcaggagcggcggccgaggaggtgacggaggtggcaacgggggactgagcgagtaaggcgctggtgtttcaggaaggaaggggaagttgtagccgggaagagccagccgtgagcctagaagggcagggcgagtg

SEQ ID NO: 64773 - DNA, 1048 bp, Homo sapiens
ttaagaggcaaatgaacacaaaacacaggtgaatcttgcttggttctgagacagtgaaggaatttccccagtatttaaatatattcacataaccagttacatacatctaaatataaaaccaatcaccagtaagttttaagatggcattcaccatctttgtgaaaaggtgaaaattattaatgaagtctaatcatagctttagaaggggtaaacagtgatagcatttactgaattcgaattactattaaaattcaaaaactgaacatattcatttaaccagaagctagtcttagttttaaatcaggactgcccaacaaaatattctgtcagtcattcatgacctgaattctggtgtatgaaatctattaaagtatggtatacataaaaaagtcatgagacatttctgttttgtaataaataaggcagtggcaaattattactcatttagtagcttttttaagacaagctaacaagtctgccctttctgccttcttcttaatgccggcaaagatcatttttattctagggatgtacttcttgggactctccaaatactccatcagtgtatcctctccccaggtgatgcctttgttcttattggcatctgtgtaagtgaatacaatggcctgacctgtcttctgcccgaagagaccatggagattaggcccagtcttgtgcttgcctcccttttccacggtgtggcactgggcacacttttgaacaaaaactcttcttgcctttctcaacatcacccatatttaattccctttttcgtcacaacgaaggttcccgctctgaagctagacgtcccattctccttaaatttcactttctaattgtcactagcatatagaatttcactgaccttgtatcctgcaaacttgctgaatgtattccttagttctactagcttttatgtaggttctttaaggtatttgatgttcttatcacattgtctataaataaaatagtttttatttcttcctttcaaatttataccctttttactacttttttcttgccttatcacagggtagggcccccaata

SEQ ID NO: 64774 - DNA, 1049 bp, Homo sapiens
tcccactttcaaaggattctcctgtctcagcctcccaagtagctgggattaaggcgcatgccaccacgcctggctaatttttatatttttagtagagacagggtttcatcatattggtcaggctggtctcgaacacctgacctcaagtgatcctcccgcctcagcctcccaaagtcctggtattacaggcatgagccactgcacccggccgactcttttttttttaaatgaattgtagtatttgtaaatatatctctgaatttttatattcattttttcaatctgtattgtgatgcttcttaagccaatgtctgtaattctataccgacgtccggttaactcagtttataaagagtaaagaaccattatttatatagaatttgttgtctctttagtttataccagttacatcagtgttgttttgccaaaactattaatgttcattgtgagagactaactgtttcatcatcaggattgtactaatattcttactttaggtagtatgttggactaaatgaccttaaggtaccttttgccccagaagttttaaagtttctgtcagcagaatcaagtagactttattgaaaaatatcctaatattaaaccatccttgtacctcactcagttaattgggaaatgaacctggaaaagtagactggatcattctggttcttgtaggccatgctggcctttaattggccactgagaagcagtctgcacataatatgtagtatctgtcaaacagcaaagtaggtaaatcatttcacatatgcgctaacaatgtatcagagaattctggttgctctacagctttgccaatatttgatgttattggtctctttcattttggctattggagtttttgcaattttgccaccattgacattttgggcaggataattctttgttatttcggctgtcctgtgctttgtaagatgtgtggcaggatcctagatgccagtaacaaccaaaaatgccgcctgcatgtcaaaattgccacatcccatgagaatcactggactactctacagtgtctggtcataccccat

SEQ ID NO: 64775 - DNA, 1044 bp, Homo sapiens
gttttattaatagggactttacttattagtaaatcaattgtgaattgatttttaaaattttttttagttttctattaaaaacaatttgaatagtaatccattgctttgaaatggtctagggtccagaatgattagttatgttattcctgtattttttgcagttatgcatgtgaaaattgctatttacttaagagaaagcttcatctcaaaagctttgtcaaattgagaactgggggtcttttcccactgatcctgataatattacaggatacttctcagttggaaaagagttattgtgttggaaaattatatgcttctgttataatatgttctataatcttgaagaaaatccatgtaatttgagtcaggagtgtgcaggatggtcttgttgttaatgttggaagggtgtaaaataccacttaatacttacgtgggcattcagagggtctcatttgattagaaatggttatatatagattagctttaagctagttatgtcatccactttaatgtcttgaaaaagaaagtagaaaggggacctgtactatagtcagaagaaaattaccacgttggaaaagaagggagtgaagaacaattctttaaataagtcttttgagtacattacaaagcaaaagagatcttgattacaggaaaggtacttaggcattaagagaaattttgtgaaaaaaaatctaggagtgttgtaagtaaaaatctggaagatataacttgtcttgtagttcacattataatttctgttaccatagttaactatttagctgtcatctaggtattattaatatatagaatgcatgatacgtaacaataaatagttatgtcatagggagactctatcataaacaattctttttcgtgataaaagtggtaggaatagcattttaaatgaataactttagctaacatgtagcactgcgtatcagatactcttgtaatcacttcatgtgaattattcaactctgcaaagtgcaatatcattattatttctaatatatagatgggtaaaccaaggctcagagattaagt

SEQ ID NO: 64776 - DNA, 1048 bp, Homo sapiens
aaaagatactcttcactctagagactccaagggttttaggagctgtttgccaggaactaggggcagagaccaaatacatgtatttctcatattataatattataggttatattcatgaaacttcagatactgtacttcatggacaatttaaagattttcaagagtagttttgattacatgtaattttcacattgtctttggatctggacacctatgaaaactgttcttactttgtaagtgttcagttgcatgttgggaagttagtgctattaccagttacaggaattggaaagcaaggttgcacagaaagttttgcttgtagtttatggaaaagaaatgccccccggattgctgtattgtgaggaaaaaagggcaagggccagcatatgccataagtgtgggaaccacacctgatgcagcctttcgtcctaatgtaacagaatgtatctcctctgcacagctaggtgtgggactccgtttcagcttttttgttttctgttctaataatctgtccttcttcagtcagtccctctataatgtatgtaattatcttaagccaaatagggctatcagaacaaaagttcatttccagaataatttccagaataggcaaaatactctcagggcaaaaacaccttcagttctttgtctttgattgtttttccttcagttttggccttactatcttgtcaactctttgatgcttttacagtgttttataatgtatttcatcttcattttgtagttctcaatgaaaagaatagactagcgctacccccattgtaaataagaagccctcttctcatttcttcctattcagtggaggaagtctacctcccattaaggcacaactcaaagaacttcttgaactaatcattgtagttactcagaaagtctccccacttcttagatgttccattgatacatcataactctgttattccactgtccatatcctatctttactctaattgcttatgcctgtggctccctctcagctagaagtgaagttcttggaggcagggatcctgtcttagttatttttgta

SEQ ID NO: 64777 - DNA, 1085 bp, Homo sapiens
aacaacaaaacacagccaaagtcagtcaatgtgcatctcttgcctgtctaaactatattcagattcattagagaattacaactgcacggtcttaacagcatttcctcaccaactgtttaacagctgcttcaaaataacagtgatttgcaataatgaaaatcaaaaattatctcagaggatatgtgtttcttttttttttttattttcccccgagatggagtcttgctctgttgcccaggctggtgcgatctcagctcactgcaacctctgcctcctgggttcaagtgattctcctgcctcagcctcccgagtagttgagattacaggagcgtgccaccatgcccagctaatttttgtattctcagtagagatgggatttcatcatgttggccaggctggtctcgaactcttgacctcatgatcctcctgcctcggcctcccaaagtgctaggattataggcgtgagccaccacgcctggcccaatatgtatttcttggtatcctaagaagcctacttaggcctttatttcaaaaatagtgtattaagttcattgactttaactacagttattaaatgctttatttttcttcttttactcttttttttttccctgtcagtattaaggtcacctatcttgtttattgagcttcatttagttgactttctctcatcattaggtatttagaattaaggattgttaccacctctccagccttatgcatgtaatcccatcattaattttgaacacctatatatgagaatgttacatacctgtatacctatatatgttagtatatttcatttcacttgttgtttcctgtagcttataaagttaaatcagttgaagttttatttaaagaatatttgtacattttaggtccacaggaacatttctgcaaataaaagaaatagataacttttataggaaacagttttagcattgattcaaataagaggtagataaagataatctgtgacattttctttctcatatcttgtttactgtttttttcccatctcaggggtaaagcacccaagggaattcaaagccactgaactagtatcattaatatggcagaatgat

SEQ ID NO: 64778 - DNA, 1080 bp, Homo sapiens
gacagtatagataaaactttctgtgcaggttccctcgccccaacttacttgttgcaagatgactactcacattacttgctacttttacttgaatgcaaataactgtgcaatgaaaatgtattttaggatcatttctcattggttttgagtaaaaatttggctaccttcaaataatgctatagagacctataggcaagattacagttataattctgggacacttgaacagacttggtagttctgatttaatagtggagcagtctaagattttaggaagttttttttttccaactttaaccactctcccaactttccacttggttacttgacccaattgaaatcagtgggtccaaaatcaagactgaccgagtcagctttcttattttttcctcaaccttggtttcatattacactctgcttacttctactttgctccatttacagtcaatgaatcagaaatgccagttgacatttgttcttttttaatgttgtttcccctgtgtgagcttttattctcacaactaccacagtagtccatccccagattataaaacatacccagattatttccatagccactaattggccttccattctctattgctgccttctctcacagtactttacattttgattgatctagcagctttctttattctcatgcctctatttaagaacatttataactctataccctcccaaaataacacctacccattcacctggaatttaaatgggacagaagcttttaagcttgtccctgctactttttccgacttattacctatttcaaacctaatgtgaattttatcccctggcccatttagaggctcccagacacacgtctgtttatactgcttgttattaatcagaaccatcctcctgttctgattcttattctttgttcaaggttcaacttaggtccttccatctcccctactcccaacttcccaccacccaccagagccttctggtattctaatccatctaatttgtgctctctgaactaaagacacagaattgtaggtccgttttattgggacctacaatagcagagtacttcagacttcagcacttata

SEQ ID NO: 64779 - DNA, 1045 bp, Homo sapiens
gactgcaggcgcacaccaccacacctggctaatttttgtatttttagtagagatggggtttcaccatattggtcaggctggtctcgaactcctgacctcaggtgatccacccgcctcggcctcccagagtgctgggattacaggcataagccacagtgcctgacctggaaagcctcttatgacttcttccagttaccactaactcctcatttcccccaccatcatagggtagttttgccagttaacattttgtgtaacgggtaatcatacagtgtgttatatttttttgtcagatactggttttttgaaaccagaatccctacaggaacctggactgtttgtgcccatggtactgaataatcaggtcaacatacagatgtttagacagccacagaatatgaaaatgttttaatataatccttgtaactctgaccttgggcaaggtactaaccatttttgtgtattctcttttcatatttaccatgagatatggtctaactaagctaatttttcaaccaagaaataggtggctactctaaagttcctctgcatagggatgaagaaaagatagtaataaaactgaaaaagccacttttttgagtaagtagaataatagaaagggttgcacatgaaatagtaactatgtgagaagaacaatagcttcccagtagattggcagttgtatttgcaagtcagttctaatttattatttttaaataaaaaatggcatcatggatatatatgaatgggttgtctttttgtacaattagtatattacaggtgttcaagatagattagattaagaaagctgattcatcttgtcattatttctcttgtctgatttgctttgattgatttcaaaatttcttaaaatgtctataagataccctggaatacaggtgactttgttagaaatttattacacctgtttttaccctaaataggatttgttaaatgccaattattacccccattcctcacatctgaaacagtgtttaatctcccaattctagcaaacaaccctggtccttctgagtaagaaatt

SEQ ID NO: 64780 - DNA, 1056 bp, Homo sapiens
tggggtggggagtggattttagtagagtttttttttgtttttttcttttttcttcttttttttattctagaagaacaatacaagcatacaggaaatataacctgccttttaaaacaaagacaaatgcttcccatctttgattgccatctttgacccaaagaacacttgttttaagcaagagagtagatgctcctgttacaaagcttaggtggaattccaggcttccttggaccttccatctgcagcaaaaactttggaccaggaaacagcaatggaacatcaacacaatacatttgtgttgtggggttattgaaatactgaaataagtattcttttaagttacttaatctcttgcaaacaatcaaatgtaaaatgattaataggcttttacatttggatagagcattattttttaaagcacttttagtctgatctcatttgatatggagaacagctttctattagtctgcctcagctgccataacaaaataccatagactaggtggcataaacaaaatgtatttcttacagttctggaggctaacaagtccaagatcaaggtgctggttgactcggtttctgatgagggctcttttcctggcttgcagacagcctccttcttgctgtgccttcatatgctccttcctttatgtgtgggtgcgtgtggaaagagatcactctctaatcccttccctttaaggccaccagtcctattggattagaaccccacttttatgactccatttaacgttaattacctcctaaaagccctatgtccaagaacagtcaaattatgggttagggcttcaacatattaatttgagggggacacaattcggtcaacagcaaccctcctgaagcagataagaagagataactgctgttttagagatgaacaaaccaatacacctaatgttagaaagttagtaaaatattataactaaggttcagatagttatttttatctaagtccacactgctttcttagctagtttatctgacaaaagacaaacaaacaaacaaaaaacatttccctactgcttacaaaatagaagt

SEQ ID NO: 64781 - DNA, 1048 bp, Homo sapiens
acccccataggatttaaaaaaacaacaacaacatggtgttgtgtttatagacttaagtcaagattcttgaaatagtgtgacactagaagagaaagtatccagatgttgcatttgataaatagtctggctttctctaaaggatagacttcaggcaaaagcatcatcctccctaacagtgagacaggtagggctgtttttcttttccttcactgtaatattttagacaaatacattgttgaaaagaatgtaaaatttatatgaattttaagaaaacataaaacttcaaataagtttcatgggttacttctgagcatgccctctcctcccaaaatccttggacttttaattcatagcttcaacccatctcctctacagagaaagattctttggtagataatttttagaaacactgcccctttcaagaaatccagttctcctttaaatacattttatctttactgagcttctttgttttgttttacaattcctatggaataaactctgcaccttttaagggtattagtgaggtagttacttacaagtctttgaaagattattttgttttcttttgcaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatat

SEQ ID NO: 64782 - DNA, 1163 bp, Homo sapiens
tataaaatcatcagttgtaaaattaatgatggtgaccttctcctaaatgaaaagactatctcctataatgttctatgtataaactggtaaataacaagatttttactcagtgacaatcataagcatatttagaacagaatacattgttttttttaagccacctgcaatatgagacatttgcctatttctgttcaatgtaaactaaaaaacttactttccagcaacaatctttaaaattgctttttaaaagtttttattttacagttttgttatctaagacagttgaattattgaccagaccaaaatgatctatgtatggggaaggaatttattttcactattcttttgactggttttacttgtaaaccttttatgaagaaaaatacactactgggtttaataagagataatgcaacttttttttttaatcacaaattactttcttgaaaagtaaatgtatacaagaatgtaaaatttgaatttcacttacgtaagcgattttaagattctggaaagtcttatgtacaaatatttgccaaaaatctccaaattaactctgcgtttagatacatttaaacattaaatctatttgtagaaaaaggacataagtttactgaaagaatatcagaaactgtatgatcattcacttttattactggaactagtttgtccaagggccaatagcaaggccacttccttgctatctaataaaatagacatatgtgcagtgaagtgtaagactgctctagtaggaaagtgtgtacatcacagtcatcaaaaaaggaacaaaataatgaatttggaaaagccatatgtaattaacattctgaagtgttatttgataaagctataaggtgaacatctttcgtgtctaaatttccatagtttcttcctaaaatgtgttttttcctgagttctaaaaacaggtaatatatatgaataaataaaaccatgtagttatggacaccagtaaaagtaaaattaaaacattatgcaaactaataaggcaactatcaacaatctagggatatctttgtctgaccatcccattgaaccaggatcagtggtttctacattccatctcttcatgaagctttccctaaacttgcctgcccttaccaacctgattgtttccaatacttaacacacaaagtcagccttgc

SEQ ID NO: 64783 - DNA, 1047 bp, Homo sapiens
aaaggtatcattttttgccatatatattggcaaaaatctattagattggtgcaaaagtaattgtggtttttgccattaaatgtattttgcggcaaaaaccgcagttatttttgcaccaaactaaaatgcaataaaagtcaaatcatggcattactgcctgttggtttattctggtataaaatagtaaaaactgacagaaaagccaagcaggttaaaaataatattaaaggttataatgtagggccccaagcaaggctgactttgtgtgttaagtattggaaacaatcaggttggtaagggcaggcaagtttagggaaagcttcatgaagagatggaatgtagaaaccactgatcctggttcaatgggatggtcagacaaagatatccctagattgttgatagttgccttattagtttgcataatgttttaattttacttttactggtgtccataactacatggttttatttattcatatatattacctgtttttagaactcaggaaaaaacacattttaggaagaaactatggaaatttagacacgaaagatgttcaccttatagctttatcaaataacacttcagaatgttaattacatatggcttttccaaattcattattttgttccttttttgatgactgtgatgtacacactttcctactagagcagtcttacacttcactgcacatatgtctattttattagatagcaaggaagtggccttgctattggcccttggacaaactagttccagtaataaaagtgaatgatcatacagtttctgatattctttcagtaaacttatgtcctttttctacaaatagatttaatgtttaaatgtatctaaacgcagagttaatttggagatttttggcaaatatttgtacataagactttccagaatcttaaaatcgcttacgtaagtgaaattcaaattttacattcttgtatacatttacttttcaagaaagtaatttgtgattaaaaaaaaaagttgcattatctcttattaaacccagtagtgtatttttcttcataaaaggt

SEQ ID NO: 64784 - DNA, 1058 bp, Homo sapiens
tttgattacagtttagtaaatgtgttatttgatattgtggactgtttcatcagatttcacttgaatcaagaaaggtaacacctgtgtattgcctccacaaaagcctcttttgttaaatggacacccgcaggccatgaggcaattacatttgttgtttgtgctaaaaaggaggcacttaactagacctcagtaaatatagctgagaactagaggcttgattcttttgtccagccctgagattaggttttatcatagctcaggaagtaaacctagctcaggaagtaaacctctgtcgtagaaaggaaaaacaagaatgatttaaaggtccctttaatgccttaaaatttagctgtaaagttagctatatctgaggcacatggagaattcaggtttgggcaaaattaaaacagtttatggcattcatgaaaacatatattcatatattcagtcttatgcattcattcaaaatggcatagcatatttacaagagtacaaaattaatccaacttaaaagttttgattatgagacgtaatgaacaaagagatagaattaggcatttccattttgggccatttgtaaaacatttactataaatgtgtttattagagtggttttcagccttagttgtaaagttatcatagcttttaaaaaaacacattttattatctgtctctgtgagcacaaaaaaaggaaagaaaaatacatgttaatctaccattttatcctcttcatattttattattataatattgctatagaattcttttttctattatctggtttgaattttcaacttactgacaactagtaggttaatctaacagacaataactgtgtttaaagttagaaagaaaatgttctgttccttgcctcattccatatcaggaaagtcaggtgttgtgtttcagacccaaaccaaaaaatgtgttttactgtatgtttgtttaaatgtgttcttggctagagtaatattttagtcatctgtaggtttgatgacagtactgtgaaataaatgacaagtcatttacttgtactgtacaaagaagcatatcctact

SEQ ID NO: 64785 - DNA, 1049 bp, Homo sapiens
ttagattaggaagccacatcacacttggaatatattctccttactaccaacagagtttggagtctggttcagatgctttcactgaatacctgtgttacaattttgttctttaatttttgcaaatgacttttaagcaactttaaagtacagaagtcccagataacttgcagataaaaatacatataatattttcattttactcaactgtatcctgcctctctagattcataccaatagcactaactttataacttttgagtggttaaaatatttccaggtgagcaacacatacaaatttcaggacaacctgctactctttcaacagagatgctgatcttcatatatacatcttttcaaacatatacatataaaatatactactacaaaataagattattataaactccatattactgttaaactaagctcaaattattctgaaaatattcagagaacacatcagaaaacactttaagtctaggagcctcaaagattattctttagtgttgacatctgaacaaaaacacttcagacttgtaaacaatgagtgaaatttatcttcagaattgtgttagctatagaatgaaaaagtcacgtcacctccgcagtgaacttcactttagcaaaagagtaaacatatttcctccatatcagctgcaatcaaggcattagcagtatgccatgattgattatcctaggagccgttgctgagaaatggatgtgtagcacaggtttttatcactatagtctgcaaaaaacaagtcgcttgtttagatactctagttgtaataagtgacattattaggcagttcttctatttaaatgacataaggatttagtatatcagcagcttataatacacaagccctttcaatctgatgattcctctctctacagagaagtacttttttctgtttataatacaagtggtaatagaagaccagatggttgacttttagctaagggaaatgacatttaaacaaacagaaagacagcatttagaatattcagggtttcaaactataacctaaatacacagtacacattaa

SEQ ID NO: 64786 - DNA, 1676 bp, Homo sapiens
aataagagtttctgcatttctgtagtcatacatgtgccttttggacatattgaactactatacagataatttgttcttttggtccttttattggtttattggcttaacgatgggtaaagttgttacctgaagtttataaatttctccttctaggattttctgtggtttattgtaaaatgaagaatcattttttaagtctttcaattaaaaccttatttattgaattttcatgtcttaaccatagtagctaccctgtattgagaatagacatattaatagaatatgattatgaaaatttcagtgtattctgtggttagtgtggttagtggatagcagtcttttgctattgttacaggaaacaaatctgtacttattagaaaaatcatgtttttacttttatctgagggctaccaaagatatctggctatttaatttaaaggtttttggttgtctttggtaccatagatgtcagcattatacacaaaaggtgaaacattgttcaccaaatagtaatccattaccacagcagagtgatgggaggtgaataagtaatgtagttatttcttatgtttttctttgtgaattgtagagtatgttaataacatcatcattattactggcagaaatgtaagaagtagagacaattttacatttcagaaaggactgattaagtgttatcaggatgtactggtggtatagtgtattaaaatggaaatgtaacaatatggcaataataaagctgttttaccgtgtattagaaaatatttaaataaaactgatggacaacctaagaaacaatcttactaattagcattacaaaatggtcactttatatagttaacactaatagtcctttaatgtgtactgtgtatttaggttatagtttgaaaccctgaatattctaaatgctgtctttctgtttgtttaaatgtcatttcccttagctaaaagtcaaccatctggtcttctattaccacttgtattataaacagaaaaaagtacttctctgtagagagaggaatcatcagattgaaagggcttgtgtattataagctgctgatatactaaatccttatgtcatttaaatagaagaactgcctaataatgtcacttattacaactagagtatctaaacaagcgacttgttttttgcagactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgacgtgactttttcattctatagctaacacaattctgaagataaatttcactcattgtttacaagtctgaagtgtttttgttcagatgtcaacactaaagaataatctttgaggctcctagacttaaagtgttttctgatgtgttctctgaatattttcagaataatttgagcttagtttaacagtaatatggagtttataataatcttattttgtagtagtatattttatatgtatatgtttgaaaagatgtatatatgaagatcagcatctctgttgaaagagtagcaggttgtcctgaaatttgtatgtgttgctcacctggaaatattttaaccactcaaaagttataaagttagtgctattggtat

SEQ ID NO: 64787 - DNA, 1036 bp, Homo sapiens
agattgaggttgtaacttttttttcctgcaagtgcccttcttggtgcttcaatccagaggctaccttatgttgatatgtagtgttatgatgatgaagataactcagttaaagtggtgcctgacaggtttcacctctaaggttttttccctttgtaataaatattttgggagagataagttcagattatgtaaaattctatttctcctcaaactttgtccaataattttagcatccactggtaaattttgcctgtaacaattattactaagatgtttatgcagggttttaaaagtaactaaaatacatgaaatataacggctgaattgttcttgatataaacatttaaattctactggatgcccttttttcttacattcaaaatatgaataaacattattttcttttgtcagcactcagttaatgttaatcaattatgacaccaaaaataacataattgaaatgttacttacataactatggcttttaaagaaatctgatggactagtggtgaggattttgtctccttccaaaccaattactcttttacaaatatttgattttggatcacttgggctttttgcaatcacaatgtcacctctgagggggaaaagtcaaagaaatgtctgtattatttattaagcaaaaacacatgcatggcactgctttaatacttttataagacaacttaaacaaagccataacctttatcctctcatatacttactcttccacacatttactggctttgagaacctttgtgactgaatactttaggtgagaatccaacaataagagtgataaaaaggctatctaaaatttctgataatttcagaagattctaaactttcagataattctacaagaattatcttttgcattgtatccagtatgctttactcctgtgtccaaattcttagaaccaaaattgtggaaaaacaattctacataggccgggtacagtggctcacaactataatctcagcactttgggaggctacggcaagaggattgcttgaagccaggagttcacggttg

SEQ ID NO: 64788 - DNA, 1015 bp, Homo sapiens
aaccaatgtgaaacttgaatctccatattcctattctagtgatttctccattatttcctattacatggcaagaagtaatatatagcaaggaacttttattagtcctttgaaagagttactatcttttttaagcatctgccttaatagaagaaacaaccaagacatggaaggggacagactagtttataatctactaattatataattcatatgtagacccagtgacatttgaatataaactttggtaaatcaaaatatttagtggctacaatttgccatttaaaatatcattagaactgataacaaactcttggtttcctgcaccaaattgtattaggcacttagtacattttgggtgattgtaaaatattttacaatagttatttcttaagtgtttttaaatagtattgatcatgaaactttttgaaatttaccatcaggccaatggtggcagagtctacatagaactatgcttcgtggtgttctggggaaaacctttcgacttgttggctatactattcaatatggctgtatagctcattgtgcttttgaatacgttggtggtgttgtcatggtaagtttttatgttcaagaatattcatcttaaatatatactttctttcaaatggaaggaaagtgtgtttttccttttgaaaacctagttgaagttatttaatgactaaactgtgaaagttaaaacataaaatctttctaaatattggaataataagagagtgtgtttgaattggcactgatagaaggtataaggaccattacttaaatattttctgtattctgtttctaatgggcacaaagggtccttttgaatagtataacaataatagtcattaccatttattgaatcctatttactgtgtttcaggatatgtttgatgttttacacttactaactcatttaatcttttacacttctttgagatacttactagtaatccattatacacatgaggaaatgaactgagaaagcttaagtaatttacttgttccaggtccc

SEQ ID NO: 64789 - DNA, 1028 bp, Homo sapiens
tgaatcacgactgacattctcagggagtttgctgccggctaaaacagcagctgcatgtggatttgacttctttcaggtgaagcgacttccagtcatttggaaaggatgggatgaaaaggaaccttggtgataattttgatgtctgcaagatttagtaccagtgtaatgggattatcggtaacaccttcactgcagaaaaagccacctggcgctataactggcagcaactgagaactaatcctttcccatctcttggatgtcattcatgaagctcaaagctatttctgccctgctaactgtgattaattttataaacaacaacaacaaaaaatcaggtcatcaaggcaaagaatatgctctttattatttataatatgtaaccttatgttaagctatatgacttaaaattatgcaagacatatacaaactaagctatatgattcaaaatttattaagctattgaaatagaaaagttgatcaatgatgtcttggtttttttaattgaatggcaaattatttactattggtaacaattcatatttcagatcaaatattaatttaaatacttttatattcttttggctatagagccactatgaaattaatcaaaatgtctagctgtaaggaattgaaataatatgtttcgtcatatgttttacctgtttttgactgcttcagttgctactgatgaaatgtttttggtgaataaaacataatttgaaatatatagacacctatattttttgtaatgaaggtaatgctagctgaaactgctgatgaaagggcttttggtgaaatatatgattttaatatataaaagtatagagtaaataggaatactgaatgacttatttttaaaaatcagtgattcttagtaacttttcctttagatggaggtttagttgtgtgcttaaaaatcagtgagttagttaattgattttgttagcttttatttcaactaaaaactttatcaagtactttggctggaggtgttaattattttaatatttttttctaacacgatccaa

SEQ ID NO: 64790 - DNA, 1112 bp, Homo sapiens
ccccccatctttttcatttttccaattctggtgggtacaaagtagtgtaccgtaatgattttactttatatttccccaattaatgaagttgagtactttttcatatgtatattggctgtttggttattttcttctgtgaagttccggttcacttctttggcccacttttctgttagcctgtcatttcctttgatttgtgggagttctttatatattcaaaatatgagttcttcattgatgatgggtattgcaactatttcttcttctatgaggtttgtctttttactctcttaatagtgcttttaatgaacagaagtttaagtctttaaagtagtctagttcatcatttatgtttagtgctttttaattcttgtttaagaaatatttatctacttcaagaatgttttatcttcttagtttttcttcaaaagcatttttgctttacctttagatttaaaatttcagtctgtatttacatattatggagttttgcagtgcttttggactcagtttgtatctggagacagaaaaaatgaggtggacttaggccgatgaccgtaattatgtactttctataaaatactcccttaagaaaacagtgtgtttattcatgttcaccttatgtgcagttttaatgtactactttagttgtttgttagtttgcctttaaggagagtctactagagtattaagggaggaatttggggatgaagagataaatgttatgatttttaatattttaagcaatagtattcataaataagtttattcatgaaatacacaattttgtattcacagacacaatccctgttacttcattgggcatcatctttaaagcttaggattttaaatatacctttttttttaaattgagggaaaaattaggttttaacttttgtcaccaaatcaaaataaaatgctagctatttgaaaattatttttataaacttcttttaaattttaagtaagatttcttgtgcaagttatgaacatttatgaggtcttcagttattctttttattgttcaaaaatgcattcactatatgttctgattatgggctatgatgttgtagaaaagtgttttttcatgccctgatattttagtttttatc

SEQ ID NO: 64791 - DNA, 1033 bp, Homo sapiens
cagcatctaaaagttggaataactgtacacactgaaggatgcttctaggtggtgaacctttgaggattttgtaaattgtgtagggtttttttgtaatgtaagttagtttactgttaaatgttctgtaataatttccattccctgtacttttgtttttccaaagaaaatatctaaaactgccccagtataatttacattagacattgtataactatgctataatccagctatcatgttttctagtactcacagtgtggatttcatctgtagtgtctgtgacttgcctatcatggaccttcatgttgtatgcatagacaagtgctcccaaaattattttaaaatgtgtgaaagtcagaagtgtgtttcttcctaccttagggctaagctattgtattttttgaaatgcagcatgcctcaaattattacctgaatatcatttggaattaatgagcatgcattttcttgaaaagaagactgacagacagaaacaacatggagctgctaagccaagatctagcaggataactgatcttatattatttaaaggctgaaatctacttttaattaggattgtggagaattaggcatagtaacttatttcttccttattaaaatattgcattaaaaattagaaatgtagatcaaggaaattgttgatagcagaaaggaatccttcctttttataaaaatatattagtattattttagaaagtatataattataactttttgttgtaaaatatagtgatacaggaacataaatatataatacaatgaataattataaattaaatatttagcatacatctttgtaaccttagagtattactggcatcccagaaactcttgatatgctttcttttctttagaggtaaccagtatcatgactttaatggtaattatttatacaatttttaatataactttgtcactttacgtgtattcctaagcagtatgtttacttttttcgcctcattttaatctttatgaatcgtgtattctttcttcctttgctcagcattatgttttgaag

SEQ ID NO: 64792 - DNA, 1053 bp, Homo sapiens
ggggcccaggtgagaaaggcccacctgtgtcctggttgagggtctccagggttctttggggcccgaggtaggtaatatcacgtaacgttcttctccttttgagtgccttcattcacattgagttaaagaaaaggttggtgaaacaataaacccttagggcttatcaagcaattgctagcacctttctccgctgtgtgtgaggatagacttttttcctgctcatttatcttctgatttctgatagaaaattcactccgccttccccacgatgtctttttcttaattttgtgttatatggaaaggatgggatctcttaccttaatgagttggttgctgagcgtctgggcttagttcgttagtgcctagtggtaggtggtttggaattaaaccttagagcgaaaactcttgaactttgaggctatctggttttcctgtgtctgacaaactatagctctctgacaagttccgataagaagcttttgttaattttaattagtgtttctggaagtcttggatgtctttcctaagcggtgtaaatgacaagtgttactctgacaaccttgttcacacatttaattgtcgtttgctgttaaagcagctgcaaataacagaaaatacttagggtttctttcccccaaaaaactgctaggaagaattagaagtatacctactttattttatgaaccctgaatcgagagtttattactaaaataccaattttatgtgtggaaaaaacatgtattttgagttgtatttttgtatttaatttttttttcaaaactgagcagggacagtgggtaactgatgtttaaaggcaatcatgattgacaaatgtctaaattgaaaaggactcccaaatcattaccgcactactgagttattgactttgacagtgatctgtgataccttttaattagagccaaacctcattgaaattcttgccatcgaattgttttaaatctcactgacctgttgaaatttttgggctgattctgtttgataaattgaaattagtattgctaaatagtgactggagtttttcatttggggagg

SEQ ID NO: 64793 - DNA, 1096 bp, Homo sapiens
cagctcccttcaccatcactgtttttgaagatgctttagtttgtgtaagtccccaaactgaatatattatcatcaggttggttgactactgtggaatagaacaggacaagcatctttctgaacctagaaattagactgttaattcagaccaaaattacatttgctttttggcagttctgtcacatcattatcatttttacttgcccagtgttatggggattcactaaatagattaattaaatgcttattgtacaacctcaaaatttgtttcacaaaattggtaattttcagcttgatgagtttagtgtttttgctaatccctaagtaggtgatctccctattagtttttcctgcctcatatgattctttgaaaaaacagaagtgataactattatagaatatatgtgtatatgtgtataaaatggtgtgttttcaaactatagtagatgtggatgatttataagacaagatcgatttttgtttgttgttttttcctctaattaattctacaaatattaagtatatgtatactatgtgccgggcactagagatacaataataggatgcattctctgccataataatcttttagcttcatggaggaatttcaggaatgtttattaaatactactaggggttaagagggtgctccagagcacactgatatcttacccagccttgagtaaagcttcttaataatggtgccacctaatcttggtctggaaggaggtgagcaaattagttagccagagttgtgaaggaatttatacaagggtcctgaggcaaggagcaatatgggtggtgctaacaagtagtttgctatccctggaatttatgaaatatggaagggggaatgtattgggaaagaaggcaatacaacatttaaagaggcttatatggcttgctttttgggtgtttttcgactgagagcaatgaaaagccatttaagtttttgaaacgggagtgacaagattagatttgctctttagaaaaatatactcttgagtaatgtggagaatagattggagggaggagtaaggttagagatacagggaccaattgggaggctgatagtgagaggtaaggatgaattgaa

SEQ ID NO: 64794 - DNA, 1085 bp, Homo sapiens
ttgtttaacttttttggaaactgccaaactgtttttgttttgttttgttctgatttgtttgagacggcgtcttgctctgtcacccaggctggagtgcagtggcgtaatctcggctcactgcaacctccacttcccaggttcaagcaattctcctgcctcagcctcctgagtagctgggattatacgcatgtgcaagcattcccaggtaatttttgtgtttttagtaaaggcgggatttcgctatgttggccaggctagtctccaactcctgacctcaagcaatccacttgcctcggcctctcaaagcatggggattacagacatgagccaccgcatctggtctgccaaactgttttctaatgtagttatagtgttttgcattgcaactaacaatgttggagcattttatttgctccacatacttgtcagttgaacatcttttaatatgttttttggccattcatgtatctttttttgtaaagcatgtgttcacatcttttgctcatttttatgttgcccagtttgtgttcttactgcattatgaaagttgctaaaatatattctggataccagtcctctactatgtatatgtattgcaaatatcttctatctgtagtttgcctgttttaaatcttcctattagctgtcttttcaaaggtaaattgtaaacatttttatgaagtttaatttattcatttttttctccagttcatgctttcatgtcctaagaaacatttgcctactccaaggttgcaaagaaggcattttcttctaatagttttaattatttcagcttttttgtttaactctgtgatccatttcaagctaatatttagtactagtacaagaggtaagatggaggtttttgctgttttttgattgagtgtactatgaggcaagattgaagtttttatcgctttttgttgtttaaatatggatattcagttattgcaggaccatttgttacaaaaaaaattatttctccacctttgtcaaaaaccgattgtatggatttatttctggactctattcttttccactgatatatatttctgtccttttgctaattccacattaccttgatt

SEQ ID NO: 64795 - DNA, 1046 bp, Homo sapiens
tcaagttgaagatgtaatattactggatttggttttacagtatttaaaaccaaattatattaattatatctaatataaatgtatattctattaccatatttggttttatgatatttaaagaattattttcatatattttcacgaggcatagtctgtagctttctgtttctgttgtatcttgttctattttggtattggggtaacactggcctcataaaatgagtttagaagtgtttcatcctttcctcttttctgaaaagagtacatgtgggattggtattatgacctcctaaaatttgataatgatgtgtagttttgtaaaactctttgattttgatgttagagtaatgatgggcctataaagtgggaattgtttccttttcctttttgctgagtttaagtattggtattattttttccttcaaatatttaaatttactagtgaagttccctatacctgaagtgtgtatgtatgtgcagggggtaattttgtggatatcaaagtgatgtagtagttggagaatgatgtctggaaccagaaagtctattaaaagtacctagttctggccgggcgcggtggcttacgcctgtaatcccagcactttgagaggccaaggcgggcagatcacgaggtcaggagatcgagaccatcctggctaacacagtgaaaccctgtgtctactaaaaatacagaaaaattagccgggcctggtggcaggcgcctgctactcgggaggctgaggcaggagaatggcgtgaacccaggcagagcttgcagtgagccgagattgcgccactgcacctccagcctgggcgacagaacgagactccgtctcaaaaaaaaagtgcctagttctcattgactctctttacaagtctcttagcctatctatctatgcctcaggaatacgcagtttttgttccacctcatatacttgttttaaggaaaaaaaatataaaaacatatgagtgtgcttgctgtttgatagccatttgattcttttcttgctatatgtttctaactgcaacttttcctttttacagag

SEQ ID NO: 64796 - DNA, 1059 bp, Homo sapiens
tctgccaaaaaatgggacagttataagaatgaagttaaagtaataacccttaattgaccaaatataccattgaacatttttactttattaaactccaaagttgtaatcatatacagattcagaacaaaagccatacagtgtatcatgttataaacaattaaaaattactttctgaccgttggtatcagtcttctttgcaagatttagtatacttaataccttataaataatttttttccacacatttttacttttcctagactatataatggtatttattatatttccttaaaactattttagcactatatatcttttgttcatcatataaatacaactattaggagagtcctttgaaggcagagctataatcagaatattttcccttttttgtcaatattttatttgttcagaaagttatcaggctatctatacacttttcagtgcttactactctgaagtgttagttgagccggaaatttgctgtttgaccccagggtttcactctttttttttttcttcctggctactgtgagagcttatttaaaattctaagttctcccttggcagtcacagttagagcttctttggcaaagtaaaaagactaaaaaaaaacatgcaaaggctcagtactgcttccagtgacctacatttctagccagcttttaaagatggcatgtgcctgattttctagtaaggaaatgaaggataagataaaaattaaaatgtacaggagaataaaccgactctccaactctctatcactagctagtgagaaccattgctgctatattaatataaacacatttagcattgatgtttattcatcaatcaacaaaaggaattttgcatgcagaaaagttgtctaagtcatacagcaaaaatgctatgccctgtgataggacgtttattctcaagaaagtaaaacttatttggaatccaagcttagattttaatttctatgttaccacttaactagctgcaagaccctgcctaagtcacttagccttttatattaagagaggagtgatacttaccctgcctaccttattccggagt

SEQ ID NO: 64797 - DNA, 1008 bp, Homo sapiens
ttaattattaagtgatagaaccaggcttaatctgtcagatttatctttcttttttgcttcactgcttcagaagattttggtgtctttcacctttactttcctgtgtcatggagtaatgagcactgataaaagaatttttaaaatctggattcttatattgagttcatcctacccttaaccttgggcaaatcacctaaaatcagtgaaaatcaatatcttcatgtgaaaaattggaggtagggagaagaggaaataccacctgccttactagctcactaaatttttgttaagtttgagtgattatattgatttttatgtttcccagtttttgccacagatagagtcaaacatgcatttacatagaagcttgcgaaataggtcagggtaattttcccataatttttcaaataatagtaaagagtggaacccaggttcaaagtaaattctccctgattcaagtatctgtattagcaataatgccatactgtctccattaacagagtgcttaggaaaataaatgtaaaatgtatattatgtttgatgtatttaaatgaaaaataatatggtgttacttttgtgatttaaaaaaatgtattttaaggacaatacttttttttacaccagcaagtacagtgttattcttcatttactcaacagctgaggtaaggaggggattagcatgtgtcaaatatattttccaagtcaggtactctcccagacgtttgaatatgggataactcattaaattttgccaacaaccctccaagagaatgttaaccccattttgtaagcaatttcaggttagagttgctaagtaactctcctactgttgcaggctgtcagtgactgagctaacacccaaactcaagtttctaaaacctctgctctttttttttttgtaccgtgctacctccatttactgaggcagtaaatgtacacccaccaacgtaggtgccagaaaaattactccttaatcagccttgaggatataatcctatagtctttaaa

SEQ ID NO: 64798 - DNA, 1076 bp, Homo sapiens
actgataatgaagatggaggaagagatattggaggtttcaacaaaaaaagaaaaagagaaagtatgacattgtcatctaggagagtgaggatatgtatagtgggaatagccttaagggcttattgaggtttgtggtcatgaagttaaagtcataccagtctgtttctctggccatttttagctacattgaggcaagtgtggaatagacagagagttgtgtttaacaagaatagcagtaagtgtgacaaagcaagagaagagcaaggaagtgaggataaggattgaccatggattgagatggttaattaattgaaagagcttatcaaagcaggtgagtgaaaggtgtggtagacaatgatatagagatctcagcagggtcaaatgattgcctatgggtactaggtggaaagaaagtagtggttatgtagaggggtgtgcatgaaattgagattatagaggtatggcagttattgataattacatggtctaaaaaacaaccatggggatgatcaacttaaatagaatggagataagattgttggaagagagatcaaaatactgaaaggccagagtgttagaaaggtgagtcatgacccagagttgggtagatgacagcaacagtgaagggtagtaggagacatagtctaaaaccttgtttacatcagtaattaaaggaagtcagagtgatgtcaagctgagttatttttcatgaaggatcataacccctcttaatagtatccctgtcagaacctgcattgcttagaccatacatgtaatttgtgcatcctcatagttcttagtattttcctagctgtggctcagaggtttctgctggtcattgttcttcttggtgcccttaatacattcctacactttatatgttcttagttgaacatccatggtgaagataatcaaactcagtattcttagctgaaaatcatcagaggagaaaaatcagtaaatgacagccttcagggtaacagtaatgaaatttttaacttgaaaattacttgtgaataaacttcacggtctctatagtcacatgcaaattatatgctaatataactttaactcag

SEQ ID NO: 64799 - DNA, 1014 bp, Homo sapiens
ccaatatcccatatctgttgtacattttaagctgctattcaagctcggatctggctaactctaaaatttaaactctttaccctctgtcacactatatcctatgtgtcctgaattattaactacctttgatgacactaagtttctattaggaaaaaaaagttactggctaacattgtaattattccatatttattaagagaaaattattattgtaaaatatttgataaattagtacatataaaagattaaacaaaaagttccattctagacaagagagaaaaaagatgaaaatatgcttccttttgcataattgcaaagcaaagaaaaacaatcatgaaaaaaatatatgtacatatgtaactttaaattttattccaaaggggcctctgtgagaaaacagaaagaaagaaaagggaaacacttttttaaagccattttgttggtgagcatctttattacttaaggaagagattcccattgcggatttctgtgacagtgaatcctgtaccctctgtttaagggaacagcagattctatcagatgacctccaatcagcctatctagataactgattaaataatgagtgaatgatgtagtgatctggatgtctgaacctgaaacaatattttaactttgatactttacaggtatatttcagcccctgtataactggaagagagattaaatttatgcttcttaacatagcagtaaagagacttctttgaaatagacatagcaaaatatagggtcagattttggtaatgagtataaagttatatagtgtgacaaagaattaagacatattcctcaaaacagagaatgtctttttttaaaaaactgcacaaccttctaaaatttttccaattttcaatctctcattcctagacgattttgcaaagttatcatatagtagtcttctggccctaataccaattgagttataaaaaacaagtaaattttcccttgctctttgaacataatgtctgaccatatatttgtttttatatgaaaatg

SEQ ID NO: 64800 - DNA, 1047 bp, Homo sapiens
ttagtcttttatttatagataaaaggaaatctgaccttttgattaagaaatattgtcagtagcctttataaatgcttgttcatctgagggtccatgacaggagtactcttcccagttgagtttatcctaaaaatgaaatgataagagcctgctggttattatccatgattcttcttaatgggggagccacatggttattcttcatctcccacttgttctcaccctttactaccaacccagccacaccccacccccaccccaacattgttcagtactcagcacaatgaatcattttcaagttgactcattgtgaactgtatcccagctgttggaatgtctggcagacatttttgtttgggtgaagaataactggctgaaacccaacctggatgagtttgatataatggtctttggctaaagaaatattgagaggaacatgtttatggcctctgaagcccctgttattcctggagtaggaccatcccctgtggcacagaactgaaagtaaggaatcaatctggattattttctcaccattgaatgaaaaattgccttagaaaaaataggcatttccaaactatgtttttctatacttagtgtgcccacgtgattgaacatattaaagacaattaagaataattatttttactgattctttttaacaacactgatccaaaggctgaaacattccttgtataatgctgaaacattctttatataacacacattccaacttatgaaggagtttcaaatactgctctaggtgtgagttaaccagtcatttcaacagaatgtttggtgacacaggctactatgtgtttcataataccaagtcaggtaacattgaccagccctctttaatttttcattcttaggccatctttataaagggacttaagaaacaagaatattagtaagctcagttgtaatcatgttcccagaaaatgaaaatcttttattatatttgacctctttctaacaggggatatagcaggctgataaattttcttgactgttttatatttcccattctcttcttcaaagatt

SEQ ID NO: 64801 - DNA, 1109 bp, Homo sapiens
ctccagttttaaaaggggaggatgcttgtgtgtaaatttacaggattctgctataagactgtttaatttatgcatctgatgacaatgttttaaattttttttcttttaatttcttttccacaaggattgattcatatacggcagattcctcggcttaataacttgatctgtgatgaatcagatgtcaaagacttagcttttaaattaaaaaggaagctattcaccattgaggtaagagaatttttatgttttagtttacaatcttgagataaacttatttttaacttatttttactttattttattttcattttcacttatttttactttaatgaaattcttaggacatgttttatgctaagtatttttaagttcttctaatataacaataattttttagactattgttttatttttacaatatatcaagtatggcaaagatgattttcttttgaatatctattaaaagtaagctccaaacttacatgataaatatgatatgcatatttccatggctttgaaaagcatatttaattaagtgttaatgagctgcgcttacttgggtgtggaatgtgaatgctacccactattgtctgtggctaagaggattcttatctacattttaaaagcatttttctttactgttagtgaaattacctttcctcgtgtggaactaaacaaattataatttacactagtgtctttaagtacattttctaagacactacaactttttttgtgacccttacgtaagcaatggtgacagaaagtagtaggacaaaatatttatttcaacttaatcttcctaaagagcaaatgaacagagaactattaaggaattagaattgatgtatttattaatgaagtaaatgctcagagagagatggcttttgggtgatgtgatagttatcagtatagtcggtgcaatttttttttaacaaagacataaaacagccaagcagccttgacaaaccattttgtttaatctcttttcaaatgaaaagctcctaagcaggccacttgtcttaactgcttgaaaccataaaaagagagaattgccaccaataaattagcatatttttaacttcatcaccaaatgatggtcaatg

SEQ ID NO: 64802 - DNA, 1641 bp, Homo sapiens
aattggtcaaaaaaatagtgtcaaagtaaatcatgtttactcaaggttgtcttatcatactttgtccctaattcagaataggacctcagtacctctccagtcaccaagaactttttctcacaaaataattgaccaaccagtttttattaagtagctattattttttatgtactcatgtaatagatttattctcaagtattaagactagaatagaatcaatataagttagatttataattatattgccatataacttggtactattcagtaggattattcaataagattattatttacatattggaaaagcataaactcttaccaattacaggacaggggtgctagtagctatgataatgtgtaataatttggagtatttcatgatatgtttggtcctaggtttactttatttcttatgcttattttcagcagcctttctagtttttaaatgagaagtagaatgttgaatatgtttactgtatctagagatgggagcaggatggttaacttgcttgtcaactcacaattatgttactaaaataaaataatggaaatataaatgtctggcttgggagccttcttaagttgtagcatcatggcctgtagtccaatatactacaaatattgtttgctgtttcaactagcttttattcctagataacactgcagctagcagaaagaaaagaaaatcaaagttgaacataggcatctattcatttagattaaatcagttgtcaaaaataaacccaaattaacattttttaacaatggaaatctaattttttacatgtgtacattttgatatattcattatattatcattctcatgtttatgcttttattctcaagtgatatcagcatataatagcattacataggtttcaaagaatcatcagaagttggtttaatacttactacactttatatatttcacatgccatagttaacctatcaaaagtgcataccaccttaaggagaacacagttttgagaatctgtctaatcctatttcttcccactttggaatcttaattagaagagataagaaaaaaaaaaacatcatttaactaaattattgtcttgaatctgtagcaaaaggtataatccgcaattgggccaattagtgaaccccatagttagctatgctgcagcaaacaatttgattagatctgacaccatcctagttcccactgttgttttgccaggtatgatggtcagacttcaaagagcttgaggcatcagcagggcaaggtttggaggccagcttaggtccggttgttaatctctctgctaaaaccacagcagctctcacacaaaacaagcttacacgacacaatcatgcggtattaaagttagggttgagtcatgccaatttccctttgattttttgatgattgaccaaagatggctacatgactagacacatgctaaaagtatcctgattaggtaagttcccaaaatatttgaagtattttttaacttcctatataaatgttgtgaaagcttattccctttgatcaaaccttccaaagtaatagtactgtactggggaaaaatgagcatttcttaccggcaacctgaatatcaaacttttcacttacctctttatataaatttgtctttatattaataattccttaag

SEQ ID NO: 64803 - DNA, 1050 bp, Homo sapiens
tcaagaccttttcatgtcatttggattgtaaattaactacctcaacctcctccttagagaagtctgactggcctgtctgaagtgttcactgagttactcaccctcatgtactgttcgaattctcagtgtaatgtattttataattgtccattagtttatttgtttattttcccaacctcaccactaaaatgtaagctccacaagagtaaggacatagtatgtcttatttgcagctaaatcctgagtatgtgtaataggtgctccataaatatttgttaaattgtgaaactacagtttttaaagtaactcatgcctactgtaagtttctttaaaaacatatatttggtatctactttgttctaggtattgtgttgggtgctttcatatacattattatatttaattttaatcctcacaggaacccttgcatacatactatttcacatatttaataaaaagaaatatacaggagttatataaccttccttcccaaagtcatacatctgtggttacagccaggattaaattcagatcttctgaagtcatatgcagaataacactggaaagctaacatgttcacaaactctgttaattattattaattttaaaaaaaataagttttattacatgtttaacagaggcctaggactactgcaagtgcttaaaggcattatttcatagaccttacaactacccatataacattattatcttcattttacaaatgaggaaacttacagtttggagagatcaagcaacttaacttatccggagtcacaaaactgataactggcagaaatgacacttaaattgaagcctgttttattctaaagcctgtgctcttaaccaccaactatctgccatgccctaagctgtactgctatctcgtcttcattacataagccagaaagcctgtgtcctgaaggattcttcaataaaaaatgtttttttaaatctcagaaaatgtgttaatgtgatatatatatatgtaacattcatattaaaaattcttctgttccccagcatgcatttctactttttgtaaaatac

SEQ ID NO: 64804 - DNA, 1551 bp, Homo sapiens
tcaatgtagtgttttcagcctaataaaaatgttgtaaaaatacttgtaagcttggaaatcacactagctattcttgtttcaaattctgtttaatatattgttctgtatgattttataataaacagattactccttgaacaggaattaagaataaagctgccaggaaggggttttgttgtcagagtagttcccgcctcatgttttgtaagagatttcatggtcccattgtaaagagtagatgatttaaaacgtgttcccaagataaactttcccattgtcattaatgaggatggataatactgagtgacaagtgcattaggaatgacacagaaagagctgttagatttgtcagagcgtatcacttcaggcattgacacttgaggacattctttttgtggatatttggttggggggggagtctgatttaaagataccaaagtttgtgtttgctaatagaataatgtattttacaatttataaatatatatttttcagtgtttagaaaatatttggaaagttatttagattaggttcttccacattttaaattcatgcttttattataacctgatttcttcctgagaaagtcatcaaactgtaagacatttgaatattaaaatagtcccataaaactaaattcttcttctaaaaagtcttatttctggaaatatgcagctgaaggaaagatactaaaaattaaacaaatttttaaaaaacattttgctatcttactcctgtatctaaaagggtactccttactatgcatcaccttgagaataaaggttttgaaataagaaaatacatgtaattttattgtctctttgaaaatacattacagaaacatgttttaaatattaatcaatgcgcaattaataatgtgtgacttttctggtatttaaagtatttccaagctgtagtatgcatctcaatttcgattttgaacatgcaattggtcacttttttgctttgattcatcttttatgctgccaaccaaattttgcctctgtatacctttttgacactaataatgactgagtctctgttcatttgagttcaagatttcccaagcggcagtttggagctgggataaactatctatcatgattgcataccactaatctgtctcaaccaaaccaccctatgactgaaattatacttgacagtttacctcttcttgatgagcctgaggtgaacatagctacagaccatccctgggaggacatggcaactactccatatgctagggaggatccttttatttgtgacacaagacttaaactatgcctgtagcaaaagggaagtctctctccctctcgctctctctctctagtatttttaattttcagtagtattccttttgtactatgaagcttttttaacacaaatatgtttggtaaaactttctaccattacaagtacttcctataggttagcttcaccgtgtgtttaaaaactataaagtcatttttcaaagtatttatgctttctaaaatattatattattgatataccataatcatcaaatatcaaagattcctattagtatttgac

SEQ ID NO: 64805 - DNA, 1062 bp, Homo sapiens
cctccccagcctcacctcttgtctcaaacttcgacttgcagctttactctcacttgcagtctcctcaatggcccattcttctgtcacttccatgtcttttatttatttttattttattttatttttatttttattttattttgggatggagtctcgctctgtcaccaggctggagtgcagtggcgcgatctcggctcactgcaacctctgcctcccaggttcaagggattctcctgcctcagcctcccgagtagctgggactaccatgcccagctaattttttgtatttttagtagagacaggtttcaccatgttggccagaatggtctcaatctcctaacctcgtccgcctgcctcggcctcccaaactgctgggattacaggcatgagccaccgcgcctggcccacgtcttttataaatgcgaaaaatgctctccccttttctgcaatagatcaatcttgctcttcatgtagtcctccacttagatgtcacttcctttaaaatgatttttctgattcttcaagactaggttagatagcctacctctgtgctcccagagtaactcataagttattgtagcatctacaacattattttaatttcctgtttctttgatgtctgtcttcaccataccataaactagtggcagaaactgtctttttcttcctcagtcattcacccacagcaccttacacaggatttagcacacaatagatacgtattaaacatatgtggaatgagtggaaaactaatgtttaactctgctaaatacctgactgcatgtttaattattcccgctctctatatgggtctaggttgtctgtttcatggagaagggtattagtaatcagtcctccaaacccaaactaaactgtttagattttccctaattaccaaactatatattgtccttaaggatttatactttctgcttgggatatgcctccatatcaacctagaattgtttttcaaaataccttaacatctaactcagtctttccttcttagtgaagatcttgctagctccttcttcacacaactcatccttccctgccaatata

SEQ ID NO: 64806 - DNA, 1043 bp, Homo sapiens
ttttaattaattaaaatctgctcaataaataacttacagaaagataaggtgtttatttaaaacaggcttatatgactaaaatttatcagtttaatacaaatatgtgtttaaagtttcaactttgagtatactatgcatattttataccagattagactaacacgccacccccgctacagctgggaaggttaaacaacagtatgcaaatctgaattggatataacagctgttcaaatgccagggcgtactttacttaaaaatgtgaccatttagttctgttaaatataaactgctgttctagctatgtgtattattttccttaaaaaatccttttaaaaaaaaagcattttctgatatgtagtagaagcactactaaagttcaatgggtttttttttaactttttctttctcaactttctgaaaaaatgaatgagacaattctcttcttcatctcttacatcctattcatctcatcagctgcttttgttaatataaaaatattataaataatcattggaagagtggtatttcttttgatgagaccctgattgcatttcaagtcctcattttagacagaaacaagtttagacatttttaatagtggacaataattccaccctgactacgtggtatacatgttaaattatgagttgtgtaagtaccactctcaaggataaaatcaagaaataaagtcctgaagtttccaagaatgactacaaatactttatttacagaatgtcatcatcattaaaagtctgtaagattatttgtaaatgaaggaggtggcccgtttttcaatttcttgggacctagaattttagtaagatgattttaaacaaattgcttttgagagaagcctgcttaatctggtatcaaaaaaaacccaagaaacaaaaaagaggctttcctcttccattataatacagaaactgaaatgaaagccctgatgtagagaaaacccaattataatacaagaaatgtaaaagctaggtactagagctattattatcctactggaaatggaaacgaagacttagagataa

SEQ ID NO: 64807 - DNA, 1020 bp, Homo sapiens
tgtcaactgccccagtatcgtcaggacattcattctcctcccatattctcagtctctccaggtctttcatgttcttgacatttttccaaagatacagaaccttcattctgtaggctaatcataaacttagatctatctactatttcctcatgatcatgctttttgggcagggaaaccactaacatgatactctgctcttttcaaggctacacatcaaggtgatgtgccatacatgaagttgacccacttgtgatgtcaaccttgatcatctggtcatattgttcagaaaatttctccactgtcatgtcatcccttagtaactaactagtagtgcataagggagatattctgagattatgtcaatatcgttttcctcattaaacctcatcaaacccacaagccaggcctcagtctccattgaaaacttccatctgaattgaactatgggtgatgaactatgactgtcaaatggtgattttctatttttatcattccttcgaggtttaatagttggtattctatggcagggaagagatttcttttcctacctaactatgcatccatctatctcagtatgggctcatgaatttccattttatttaatgttttccattattaatttcgatgctcaaatttcccagactggctagtaggaacctctttgaattaaatcctgggccatgttttttcatgctcctactgttctttgagtatctccttactttctggcacaaattttagtctcattttataccttctgtgcctcaatcctagaattagctatcttgccaagaggcttccctcctcttcacttcttttttattttttgtggaggaagagactcagaaaccaatatttgggtacttggagtattccctagggttgtcattgcttctaggctcttcagaagagaaggttaagaaatacacacatatatagtacataaactcacatacagatacatctatttctacatgtatattgttgtgtgtgcttgagtgtgcatggtgtataatcatg

SEQ ID NO: 64808 - DNA, 1015 bp, Homo sapiens
accagtggcatagtcagcaagcttgctaagcaaggggaacagtgaaaagaagacagggggtgcagcatgccagtgtttctgtggaacaacctttattgcccagctatccccagatattctaaaacagttatgacaccttttcagatttagatcacctctttatttatatatactgtgactctgctagttttaagcaattataattgatcaaaaacattagccagtgtttttcaaagtatgagtaaaatatgaatatttttaacataatctatatactttgcttcatttatgagagaatttgaagcagttacctaatttgctcttattgtcaccattttattgaaatggaaagtaactagacaaaaagaaaccttaaaagattgtcgcctaaatctcttctcttcaaggtacaagttacccttaaactcttctctccaggtaccttacaccttagttgtgattatccagctgtcctagagcaagcctgtgatttctctattggtgatcttgtggcagtatttcacattattatatgtttttaaggaaatcaaagtgtttcctgattgaaaaataagaattagtgcaattgttttatcttctagttaatatgccttctcctaaagtaattctcaaattgtttgaaactgaaggccaagaatatggcagaaaatagaaatcatttgaaactggtaaacatttcaacttgaatatatatgtccaaaaaattaaaattcaaaaatgttatatgcactcacatattcagcactctaacttaagctacagcacacttctgagatctgatagtaacaatattgtaaagcttaattatatttttatggcccatgccatctgggcatttgttctgcttacaatagtaatagaatttaaaaaaaaaaaatttagtttgcagtgcaattgtcttaccacaaatgcatcaaggcaaattatctcttattatttcagatcctgttcttgtagtttggatttgtatctgtttgaaaatagaaaaacttct

SEQ ID NO: 64809 - DNA, 1025 bp, Homo sapiens
catttttgagttgagattgaaggaagaatgatgtgttcatagatatgaaataagggccgggcatggtggctcacgcctgtaatcccaacactttgggaggccaaggcaggcagatcacttgaggccaggagttcaagaccagcctggtcaacatggtgaaaccctgtctccactaaaaatacaaaaatcagccaggcattgtggcacatgcctgtagtcccagctattctggaggctgagacaggagaattgcttgaaccttggaggcagaggttgcagtgagtccagatcgtgccactgcactctggcctaggtgacagacagagaccccatctgaaaaaaaaaaaaaaagatatgaaataactaaaacacaataagtagacatgaagagtaagaatcattgaatttcagaagaaaagagttcattggcataaatggactttggatacctcttcagcatacggatgagaagaataagacacagagagcgacataatcagtattacaatccatatcttttcatgtaactatccaagcatttaaatactatatcatgtaagtaatagagcttacaatataataggggagactagaacccgtgactttaggctgttggttccatgaagtaagaaatagatggggaggtaactatgagcacggagtctaattaggaaacaattgtgacagtccaaatcaaaaatgattagggaaacaagatataaagcaagaggaatcttgtattatagttcactatgctcttttagattggatatgaatatttatggttacagtaaatatgagactctgttacactctaactgaaagtcttttatattacgcttggatgatacataaatgtaaaaaacaaagtgtactttatttttagagattctttatgaaaatgcaaacaggttccataaaacctagaggtaatcaaaaacttatctgggacacttttgaaaatgaagacactgtgtgtaccatgtggtagtgttaagtgcccttataacaaatcattcacagaa

SEQ ID NO: 64810 - DNA, 1024 bp, Homo sapiens
tgcataagttctagagatctgtgtacaacattgtagctgtagttcacaatactatgctgcacacctaaaaagtcattaagagtgtagatctcatgttatgtgttttttaccccaatttttttaaaagagaaatctagctattttgatctcatacaccaatattctcatgacaaatggggaatgttaggatgagacagatttgtattgaaaaagacaaaaccaataaaagtgtagtgacacaattaaaattctctgagactaaacatttctggaaagtatacatgactataattaattgaaatgcagcttttactaagtctgcttatatgttcattttcaaagtgtgagactgatatttattatggatgtcagaggaattgttttcttcactgtggatctatgttgtatagcactttttatttgtgatttgttctgtcttagggctatttcaagtatgattttcccatggtagacacgctatggaatttgtttccttgacatgtacaataatttcagaatacttcttccagtgttttttgttggtgtgtaaggttattaatagtgaaaaactttaaagtacaatctagtactctttatagttaggatttttattttggtaataatgattaatttacagaatctcatgttaagattcatgctatattgccattattttaaaagtgtgaaatgcatgagttttaaaagaccaagtttaaaataccaataagtagtgatattcatataccatatgtttacctacaaatatcttaggttatgtttattacacactaaacctcctctcaagcacaaagcaagcacacaattgtcagaccacaaggaagtccataatttccattactggcatcaacctttccatttatttcttatgtacagaacatatttacctatttatcagaatatttactcatagagtccccatttgcttaagcattactgccatcactccaattctgaagatgataatcaagaaatttttttctctctaaattcatagacatgcttt

SEQ ID NO: 64811 - DNA, 1091 bp, Homo sapiens
ttggggttattcaatatccctcttcaatgctcattttctgaagttgaaaacacttatgcatgtgctcacatgcacactaaactttgtcagagatgaagtacttccaaatggtacttgaatgtgattaagagaaccctgggcctgataggactcattacacaacacgccagatgtaacagtttgctcaaattttggttctaagaaaaggaaacatcttggtaaaaaatggctcatagaagtggaggtaatagtttattgtatttctatataaatgtgtgctcaatacatcattttaaaagaaatgtaacagactttcttcttacaaaatatacttaacattggaatagtgtctgtcatttctttggcattagacaaagaaatcaaagtctgtttgacttactgccatgagtttctggtctagagttatctatttttcctccctgatcattataattttctaaaacaattcaggactatattaaacaattttatacttaatgtcattggtgaattttatgtttattttcaagtcaaacaatgattaataatgttattttacaatgtggttctacagatctttcaacacagcttaaagttactgaattcagttttcaacttctaatttcagagcgtattaacaaccatcccatggttgaatttcctaccactaggtaaattcctcgaggattttttatattatctcagcctttaatttgtgggtcacactcatgttcgttctttatcattccagaaatggaatctgtttgagttgtatagcaatatagtgaagaaattagaaattaatggttgttgaaatcaaatagatagacttataggaacttgattgttaagcccaaggttttatagatgataattgccctgtgtttcaactggactagactattatgaccatggacgttgtcaacctagaaaattctctgcttttgcattttttgcccaacccaagttttgtcagatagtatatgtcacaatatattgtacaagacctcacctcacactaaaacattttatatgaaataaattctgttgttaatgatatgttgacaaagagggtggaacttttttttttt

SEQ ID NO: 64812 - DNA, 1048 bp, Homo sapiens
acatcgtttgtgccaaactagctgtgtgtgcttgaagacaacctttgaaagtctctgccgaccagtataatctaatgatttcacttacacctcccttatttaacactgtcatggaaagtaaggaataggccattcataatttacatgtcatttgctgcttcatattgtgtgaaatttaattacacagcttaaatcgtagccagtgctcatttgtctcagggagcactcacaataaggcattgatgtgagtccagcattcacccagagtccgccttttatcaaatcaccttctggtgcggccatcaaggccgcacagttgttcttttcactcttttgtaaggaaaatgagagaatttgacccccattttcatttaaaaatccagggcatcatataaaagatgctgcttgaaaagattttattcagtgctttaccacaatggaatatacagataaattttctgaaggtgattacagagcctggttgggtcctcccagagctgtaatagttttgtagaacttccattgaatcaagagaaaaatgaaatactaaaactccccacaggtgtcggttttattattttttcaacaaacacttctggtagaggggaacccctgatccacagctacaaattactaatcatgtgtattattcaacgttttagtccatttctgaaacttttcctttaaatcaaaaggaccgctctttagtaattgcaggctgcttggcctcctgatgggagactcatataaccgtaatccccctgacgactgctactggcacccatcccactcctcagcaaaacactaagactgaattaagaggatgaagaggataattattagattcaggaacagtttcccagcaaaatctgttttttattcatcaccatgaaaaactgtttatggttttggaaatactctgttatggtaatgggtatgaagctgttagaagaagtgaccttattctaaaatttaactgttaaaagttttttaacaaaaaaaaattgtatacagtacaaccaaaagcatacactttggtgctgcattg

SEQ ID NO: 64813 - DNA, 1749 bp, Homo sapiens
actgttgaaatatacaagacaggtaatagatttaggatgcaaacacctatagatactagtgttacctgaaaataaatatataatgaaaataaatatataattgaagatgcctgttataatttttcatttagaaacagaactactaagtgtttgtaatatactctgtaatttacaaatatttgattgggtaaatgtttgatgtatttgcttaaactgattttagagcaactaatatccctttagcacataagctatcttaatgaaaaacagaagaaaaaatgccactacttgatatatttctaaaggaaaaactcattttttcatcatttattaaatagcaaaacttgtcagtattgtactttagaaatcatttgatgaaaaaaatcatgctttcttttgctctgagtatctcaagaaattcttatatgtggttttaatactaaaggcctctaaaggaaattcaaaaatatgtatgtttcatttaacttagatctaaaaagcttagaaaataaccctgcataacaattacaaaatcaattccctccactatttcattttggagcactaattttgcaaatgccaaaaggaacattcccattgcatacctgcagaccctggatgaaatgacggcaaacttcagggtttctacttgaccagagtggctcttctggctacagtgaaaatgtgagacaggatttagccgattcggtgtatgaagtcattggctcttctctattttgaggatctttcagacctccttgtaaaaaaaaaaaaaaaattagctcaagggtagttaggtggtggggggaaatcccccacatataaaagcaaattactttttaaagaatagaaaataatcggtatgagaaattacttctgaattatccaagtggaaattaaacttagctcctgttaacatttctttagaaacatgcattttgattaagccaaacaaacaaccaaaaaaaaagaccctaagagcagcgtagtcatttatctatatactcacaaatacttttcttttttctgatcatcagtatttttttcttgctttatttgcatcatttcctttaactttatttcccattattcatagaaaagctttctatctaaggctgagttgaattactgcttacttccctctgtgaagtcacttcagcaaagagttactctttggagttaggtcctcatctctaatctgtatccctcagctgaagcacttggtctttggctgccctatcaccaccctaaggcacgtagaaagagggctctcgctttgcccagtctgttcaccaagatccttttcaaattggtgaggagggaggtttgtggaagggggaactagatgtatcaagcaactctgtgaagccagtgtaatttgtaaatttgccataaacttttaagtgagagttggagtgggggttttgagggttagcatgttttcagaaatcaaaaggaaaatgggagttttcatttcagagggctctgatacttaagatttttttttctaaattttaccaaagctattaattagcaattagtcaacataattaaaagatattaaagtattcatgacaatattgttatgctatatacttacacttaaatatataaataggcaaaacacacacaacagcatttatcaaataatactaattaatatcacctaggtgttaatttaaatttgaagcaagtgaaatacacactgcctaggagagtgcacctctatctgtccatgaagagtgagaa

SEQ ID NO: 64814 - DNA, 1062 bp, Homo sapiens
ggtgggaagagaaaggaggcatgctgtaggccaattctccgtgtgtttcatgttctggagtggagccctgatcctaagtttaaacttggcttttcagggaggtatatgtgtgaaggaagatagaacatatttaatagtttgttggcttaataacttaaagtatttaggcatataataattatgtggtcctttatttgcattcttgctctaggctctttgaatgttagggatgaatctaacttccctcttcccacttgctgaaatgtggacttcagggtaggtgctaacacagtcatcctggaccagaaaatggaagctatttgctgaggagggcatagcaaaaagacagaatgggtacaggctctctcgacaccatctggccaccagaagagtactaggtcatctaactgggctttatgtgagagatacatgaacttctacattacttaagccaccgtgtttttggatctctgcaataacagcctaatctatattctgtttatatagtttggtacctgacaagtgaggcactgaagttctaccacctacctaaaggtatgttggcttagtggcttgaagataggcagtgaggtcaagtattgcaaagtagaaagctggtgagccttgttatgcttgtgatagcttggagggcaaatttcctccctcctaatcagaggctctatgtggaacattagagaaattcagaatactagtgtgttggtagcttcttgccactttaagcaaattcatttataaaagacagatgaactcatgctagagttatagaatctgcaagaagagatggaagggactacctgcagcccacaagctaaactgactaacaatttggcaattggggccccatggggttgaaaatacccaactgtttctacacctgcactccaagacagacaacctttgcagatgtctgtgcccctaagccttcgttaaataccttcgttaagtggctggtcagaaaatgggagccacctcagagaaaaaagattaagggtattgccttcccactcaagtctattattttagatggcttcaaggcagcta

SEQ ID NO: 64815 - DNA, 1027 bp, Homo sapiens
ttaaaccttttaaaaatttctgacatttcctgaaaagtcacaatttgtattgctcaggatcacagaaataagcattaacatttcagaatactcctaatagattttttcatttttctttaaaacattgccaatttaaatgaaaacttgccaggcacggggtagctcacacctgtaatccccacactctgggaggccgaagtgggagcctgggagttcaagaccagcctggacaataaaatacagtgagacctcatctctacaaaaaaacctttaaaactttagtaactgtctcaaaaaacaaacaaacaaaaacaaaaaacaacaacttataaataccttagaacacacaggttctacattggtcccttaacagaggtggccaggacttgtgggcactggacacagaggcagagagtgacagtttgatacctgcctctgtcattcactctccacgtaacctcagaaaagtcaattcagctggttaagcctcagtgtcctcatctatcatgggggaatgattcttccctcataagactctcgtcagaataaaatgagatgtgtaagtgttttgtgaactatcaagttctacactaatttatttatctcttcttgcttcaaaaatggatctgaggtggttcataaaagtacatatggtataacaagacaaaaacaagtgagtttattaggtcaaggaaatcaatctacaaatataacgaacaaatataaacaatagcaacagcacatcagacttagccaccaggtctcagtctgcctggaatctgagtatttagtataattactctctactgcggctccttacagacatataaagcaaagtgcaactgcagtccctgcttctgaggttttaaaagtctaaatactttccctcatactgagtaaggtaggagtgaaagtggggtatgtaagatgcctggcttctgggccagtgtatacatgcatggctgtattaaggaggcaatttagggtgcattttatttttaaaacctgtattttgcacatgtcttca

SEQ ID NO: 64816 - DNA, 1060 bp, Homo sapiens
aaatgctacattgtaaagctagttgtatattcatgccctttgaaaatgcccaaggatggctcttggaaatatgtgaatctatgtgtgattttgcctgcttttgttgattattacttgaatgagcttactatgcaatctaaattctcaagcagtgggttttgttttctttctttctgagcctccccctgtgcgccatgtcagtgcgatgtgaaacagcgaggaagaacgagagatcaggttccaggcatgccaggtgtgtcagggatttttcctttgaggcttccaaagcatttacacacttgacatgtaaatgttcagatgctgctgtatcccagatctgtcttctgaaaaaaaatgctgcaagatactctgcatagcatggtgacctcctttagacttaaaactacagggctgtagggtatataaacttttagacattgaggtttcactgagtaatggtttaaagaaaaatcagaccacaaaaaaatcatattattctcaaccttgaaaaccaaatcaaggtattcatatttctcattttatacctggggttctgaagcaagggccaaaaccaaaaccatatcttacttcttgagctgaaatttttccacttgattttcttttctcagattctgggaggaagagactgtgtgatgcaggagatggatagctggctggctggctggctgcctactttttccattaatgccttgtctaaaacaatgatttctgtgtaggcaaacggatctgggaaaggtgtgacaacttccacggttcctgcacaggccagggtgatttgctgtaatcccactggatcaacgctgcaaggagggaaacagtgaggctagcaaaacactctggcagattatggagactcctgccaaaaggcacccttaggcccatgggaagcccagggtcataataaggcagcagcagcagaagtgatttgctctgaggctccaagaggtaccgaggagagctggactttgagattctttcccctctacttgcctctccgtctctttgttgggcttagccactgtctatattttgttccttc

SEQ ID NO: 64817 - DNA, 1048 bp, Homo sapiens
ttcttctttcttctttttttcttctcctgaaatcttctgccatagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccat

SEQ ID NO: 64818 - DNA, 1028 bp, Homo sapiens
atttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaagagatacgaggtcatcagatatgtaaattgcttgtcaaaatacttaataggtcattgatatacttccctggctaccatgtctataaaattaacagccaattactagttaatatatgctttgcaaatagataactactataaaaattgaatatgcatatttgaacccttattttaaatataaaagaaacttttcaaactcagtaaaagtgcattttgaataataagtgtacctgggctttccaaaaatcatatccaagtg

SEQ ID NO: 64819 - DNA, 1041 bp, Homo sapiens
tttttttaattatcagcttgactcaaagatataaatacttaagaacaatgccaaacgtaatatctgaaatgatatcttttaagtgtttctagtatatgaacttcaaaaccctatatggtactcatttcttacactagatttgcctttctttaacatgagataaatattttgactactgcagtttgctcaggtgctcgggttctaagactttttgaatttccttttagtagccaccatacaatatctacttttctcttccatttattccttatgtccacctccaggatctttaaatactaacagtagacaaaataaaactactttagaaggaagcgacactctgcaatcaattccctgtccatcttttaacaaatcagacacacataggcatacaaaaggagagtggggggacccccctattcatttgtttaagcccattattaatgtcatttctaagacagcatgttactgctttccaaagatagtcaccgtcaacattattgaaataagcagtactaaccctaagtacttacactttgaactttaaaaccgagcagttgagtcattcagtaccaagccaaaacacagaaaaacaaaaaagcagatgaggtttattcttgagaaatgaaaaagagaagaatatatatttcgccttggtgagccaaacatacagagaagaaaaggctttttaaaatcttactagtatgagaggcccagagtaaaaagaaataagcaaaagaatatagacacaatcctaagatgacattcacagaacaaagctgaatcttcaaataatactgtatgagtgaatcttaggaaacctagtgatgatagtaagaagaaatggcagtgagctgtagcaagaaaccagttgttcaccatttaagggttaggaggcatagctttgggggaaaaatattctagaaattcattgcagtaaaatgcatttttttacttagagcagtttgaacgtttattacttaaaacattcagctcttattctattcacctggttttcccaagtcagtcaagtttggagaa

SEQ ID NO: 64820 - DNA, 1051 bp, Homo sapiens
tcccaggcactgctaccacacagagcctgccatgctgtccccaagagagtgcctggagctctgtttggaaggacagctcatgtccctagggtgtgggcagaaggcaaggcagccgttcccatcctgccggaccagagggcttctgcagctgagcagccgcttcttcagactataccagactgtgctactttgccctggcaatcctgaccttcagagcacacatatacgtgcccaagtgcacacatacagaccctccgctcccacgtcactccttttctcccattcccacctcttgcacctggcgtgcgacatccgggtctccaaagtctctgctgtctacacaacagaaccgtgggccggaactggctgcctgaccgtggtggaaattacagccagcgagaaggaagaagtaagccagccagcagctgtggcatgcactcccacatagcccttctctgacagttccctcagcacacagccctcagggaatgtaggctgcaaaatgtcaggaggtagaaatgtctgcaccggcaattgtaccaacagtgcgtatgtgtgctcactcccctgcagaaatgtgctgctgtgcagtgcaggctgacactgaacaaaactacatgcacacatacaaaaactgcaacttaggaaggtgtctccaaatgtgcagcaactctggtggaataaaattattagtatatttcatgccggagcaatgaatctcaattatctgttcacaagtaattccttaactaaaaaacagtagatattgaacgagaaggtcatgtttaaatccttccattaatttctacatttctgatcatttgcttttggggatttttttaaagcagagtataattcagtggaagtgtgtctttgtccccagaggtttctgcatgtgcaagcattttaatctagactgccagaacccccaggctttttagtgaagtttgcagaggaagacttatctgtattgacttatatgttgcacagaacaaatgaaagtctcagacagtccttttttacccaacaaaggcttatttttttccatcct

SEQ ID NO: 64821 - DNA, 1008 bp, Homo sapiens
gcctgcggacctcattggctgtgtctgcacccttgagagcttttcgcactacagtgattggcttgaccagtcaagtcggagacagtcaatcccatcacttttaagtgattgactcattaattcatgccctaaaaaaatgagtaataaaaatctgtccagttttgtcaggttgatctgccttttattatactgttaccttgataatgttgggtggtggtggggcatgttttgggtaccagggagccttgcaccagaaagtggaaataatgctggcacattatcagatagcagattagtagtttaaaatttgggtttatattaatgtgtttgtatgctaaatatagaatctgtgcacgcatttggggcattactttgggtatatgtgataaactagtgagaaagaaaaaaggatcagaaatgggattcatatttacatggtgagatatacataatataatgagaatgctagttttctgtctgtatctacaataagaaaaggcatagcaggtatttgctggaaatttagtgtgtctttgctgtgaatggtgtgacgagtttgtggccctcctagctgcctgggaagcttgatgctattcacttggtatgacagcctgcctctcctcttagttctgtcccaaatatctattagcccctacatttagaggtcctgcactaggttcaccctttatgatgtaagttggataaggcagatggtttgtactagacctttgttgctggatggattcttgataggaaaaatgtctgtcttctggtaggcctttcccagtggttttcctagaactcctgtttgtgcaacaattagagatattagatggtacgatattggccagcatgagcctctgctggaaacagttctggggctacactgattgtttattctccattgaacattttttgctggatttcaaatccaaataacagcaaaataaatgtttcacagtcttcagactaatataggagcagctagataagcaacttcagaggaat

SEQ ID NO: 64822 - DNA, 1034 bp, Homo sapiens
cgctttctcacggattaggctggaaggtgaacggcacccactgaaggcccctgctttgcgcggctccgagggggcgccttttgaagaagatatcttaattgtccaccacttaggtttatcgtgggggtgggggagtcgagatccaacttctagttttattttgttaaaagctttaagagtggaaggcaaatccactaaagtggggggaaatgtacccattttatgtaagagcagccgctaggtcaccgcctggctgcaaacagttgccacttctaaagtaatgaactgtctccgtgccgctctccccgcggggtagagaagggatcctgcagcgacaggtttctttttgctgtggaattccaatccccgcttcccatcttttttttttttttttttttttccagatttaaaattgagctctactgtccctgctgacttttctctcttaagtgtcagttctggaggcagcacagggcctggcggcgatcgcgtgctgcctgtgtaaacccgtgtgtatgtttgtgtgagacagaacatggataagaatgtgaatctccatgttttaaaattaagaaaatgtcaaagaggcaaatgagagcagagcatgctatcggcggggttcttcggaggcagattcgggcaactttgtttaattggcgagatcgaatgtgccagaaaagggaccgagatggggcccctaggaaggcatgggcatgagtggccatggggagatgggcattgtgttctcctcagtgtcccccaccccataccagatgtgcacagatttttgtctgttttccaaaagcaataaccctccggcctttctagttggccaaaaggagctatttccagtcttccttcttcaccaaacccgaaaataaagcgaggggtgggggtggtcgcttcatttcttcccttgaaaaacgctttgaaaagtccccggaaacttggggcagtaaattagcacagacgcttgtgcccgcacacgtgagcggagcgcgtctccctcagctaagtagccctcctcgaccccc

SEQ ID NO: 64823 - DNA, 1013 bp, Homo sapiens
ttagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctatctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttctttt

SEQ ID NO: 64824 - DNA, 1048 bp, Homo sapiens
gcaaaatatgtaaaacacattcagattccgccagaaagagtcactaattatgatatgtatttgcatatgtttaatcacatatatatcttatttcattttgccatttctgcagggcccctcgcttcagggagggggtccttggcgctggttcagcctgcactcagcaaagttctctcaagtgagcattctgctcccacgctgttagttttttgcgttatcttttccaatgaaatttgaaatttacaatttttaaatgacgtgtgtgaaattatatgactctattatgtcataatattatacatcccaaaatattggtaaagggttctcccccttcatcaccaccctccccaccagagatcagagcattactgagaaaataatgattaacctttaaaatcagattggcatttcttttttctccaaatctagaattaatacacattttttaatcattagtgtaatgttcaggatgatacttttgttcttttgcctgttgaactgttacggctgctagtaacccttcaaattgtttgcttcattcaagcattctttcctgaataattcattaggcattattatccaagcgtggaacccctcatttagcactgctgatcttttccttatgtgtagctgacaggcaatcaaagtttttatcagtgcagaaaatttgcaattcagaaatgtagttgcagcaattagtagctatcaggtagcattggaaggacagcttcataaaaagacagagttgaatgagctccactgatgttagcacaaaagtaatgggtaaaactaaccagctgtttctaaatttaccaaatggaacattcccttcttctcagagtggaggctttaattaacttggagttctgtgtggcttcccagagggggaagggagtgggtgaggacccttccttcacaccgggctggtgccgctctccttccactgggcaccgatgggagggagctctgagcttccctctaagccagtcctcatggcagagagggcaggtgagggacacttttgccagaggactccagacggggaatg

SEQ ID NO: 64825 - DNA, 1051 bp, Homo sapiens
agatgacccttcagaatagcccttgccatttatccttcattcacttattaatatttgatagatacttattgtctactaagtaccaggcactgctccactgaacaccaggatacagtggtgaataagacacataaggcccctattttcacaatttatattcttttgggggctagagagaaaataaacaaataagaaaatatgacatatagcactatgggctatgcaaagaattataataaagtgaagtgatatggtgctggggaggctgttttataaagtatgtagtgtgtggtggtcttaaagcaagtcttcaggtacttcgatactgttctactagtaggtagagtctatgtcccttccccttgcacctgaggggcttctgtacctacctggaagaataggacacaaaggaagtggctatcagtttgaaaaggccatgcagcttctgctgatttttcttggaacattcactctaggtgccttcagctgaatgtaagaagtccagctatcatgaagtctccatgtggacagacaattcagaggaatgagagagagagagacctgagcagctagcagtgccagcacctagatgtttgaatcttcccagcccagatacatgatggaaaaaacttcaagatgcccattggacagcaaccacatgaaagacctggagtgagaactcctaagctgagatctcactctttcagactccagagccaaataaataattattaatgtttaagccactgttttggtgtggcaacaataaaggcctggaacagggtgatacgggaaggtttctttgaggatatgatgcttatgctgaagacctcagtatcatgaaggagccaggggagaaagaacattctgggcaaaggaaatggtgggaagatcctaagtcagaagtggatttagcaagttcaaggaaggaaagcaggccagtgaggctgaaatgcaacccagtaagagtggtaggagatgagtgaaggcgtgtagtagaacttcagtttgtggggagggtgtgcactcactcaagtaatatcctacagta

SEQ ID NO: 64826 - DNA, 1050 bp, Homo sapiens
aggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggtgaggccgcggccagggccccgtggggggcggcgcaggtgtccgagggccgcctgggcgagagccacgcgggataccaccgccaaagcgaaagcgaaatcgcgcgcgcggcctcgaggatggggccctgcccaactcggcgctggggctcaggctaacttgctggagggccccgggaccccagcttggagatcgccgccgccgcgccccggccggggtggtttctcgcggggaggcgagaacgtggcagcggccgcgggagccaggacggcgagggcccgccccctcccccaggttgcatcagaagggaggggagagtgcacaaaagaagagtttgtccacagtggcctgttagtgccatgagttcctccccactctctcgcagtttctctctgatcccccactcccggggagaagggcttgagacactcgctaagaaaatctcagggatgaacataaatggataaaagatgaaggggcaggcgagcgac

SEQ ID NO: 64827 - DNA, 1939 bp, Homo sapiens
tccagccggggctagagtgagactccatctcaaaaataataaaaataaaaataaaataaaatctagtgtagggatacaaaaatccggttgaaaagggacacgcagtttccgattggaaacacgagggagcaggaatggaaacggttcgcctgaaacgtttctgttggcagcagatgtctgcagaagcactcagttctttggcaactgatttgtttggggggcaaaaagctggagggttctcttggtggtggaggattttgacttgggctgttaaaggcagttgagtcaggaaccaaacccgggaaacaaaacttcggcgcattttagtacaccctccccgggtcccctgaggaaacacttgggcactgtgcggaggtatctggtggtccttgcacagaggacccagcaggcagcctggtcccagatggaggcagggctggggaagaaaccagcagtcctgcctattgggcaccaggtctcagatctccctgaacctgattcctgggggtggaggatcttcatgttctgccacatgaaagagaacacagccatccctgtgctcctgggggcctccaaaggccaaagtgtttcattggaatatgaggataaattatacctattgtgtaggtgcaccatttgcctgctctgataaaaagacctttgaacttcaaagtcacctccaaacaattaccttttatcttgcagagtactttctcttctcagttaggacttaacaataggggccattgatgagttcagtctattgtattgctttgaggcacttggagactgatttatcctggagccctgagtggcagccacattgtcactggagaggaggcagggagaggttttgggatttggaaaactttataaggtgtggtcatgcagcttccagttaatgccttcattgtgacagttcagcctagtagtgagaaaaagtgacggtgaagttggtctggatttgatccttgtatcaacaccttgacttcattcatttattcatgcaacaaacatttgaatggctactgtgtaccaggccccagtttagataactggcaggtacaaagatgaaaccttatgctctgggcgtcgaagtgcttgtaagcaaatgtggaggagagaagcacagacaaactagccattatgcacaattgctgcaatgatggcctataaaacctactgtgagcacattcaggagaaggagccgccaaggctgcaggttagagagaggggattggggctgtcacctgatcagagtttgtaggatgacttggaggttgccaggtgtacagcaggggaaggccttcctgaagagaaaacagcccatttctaaagggtttgaaaagcgttctggggcatgaggggtggtgagtctgcaaaggggcagggaagggaagtgagaggtgagaatggaggggaaaccaagggcagagcaggaaggaccttggtgagatggacatgagatgttatcctgtacattgtcaaaatgtcataatccccaaaactcattgggaaagtcaggctggcaggagggcagtacacagagaacataatcaaggcacagactagaccagtggcagggagaggaggtgaatgccaaaggggcttggtctctccggattccaggaggggatgaatctagacaccagtgggaggcagaactggcagctcttgctcttgactcaatgagggggagaagagagaggtaggaatcaaggggacatccgggtctctggccttagccaccagatgggtgatggatgcaccattcacttgtaggttaaatgtggggtagaggcggggtaggaggtgctggaaattatgggtcctgtttgggatggggctgagtgtgagaagctgcccctctgtccaaagcttctgtttcagtggtcccctccaagattgggctgaggaggaatgagtgtggctggatcta

SEQ ID NO: 64828 - DNA, 2076 bp, Homo sapiens
cccacctcagcctcctgaagcactgggatcacagatccagcctatcttttaggattgagacctgttaaacttgcaaatgaaggggtactttcaagctgttggtgatgtttacaccttcctgagaaagaggagcttgggttcttgggttcaggtaggaggtggagacattgattattcactcctccccttctcgtgtacaccctcccccacctaaaaaaaagttataggagattttctctgtcaaactatcaaactgatgaatttgtttcccattttttattaattaaagattaattgccactcagaatgtctgttgacaagaaagttttaccactgaagctgttagaattccagcccaaaacaaagaaagaaatctagagttagcctgtatgacctcctcccagataaatggactacaagggtgaaacttttttaaacactggggatagcttggaggtgtttttgaagttccccactgggatgctgtcctggtttgggaccatctggtctagagatgacaaaagtgggttcccagcctgaagtttgctctgggctagcatttagggtacctcagtggagttcagtgggaaatttgtgaaacctaggccagctgtggagctggtataggagtctttaccctaagagcagagggtttaaggttcctagagcggatcagctggtcaagttttgtgaatagattctatgatgtcaaggctccttcagccctgacatttgtgctgtgtccaccatctggtgtcttcttgctttacgtttcaagtctttgtatccatggtggtgggatttaaaaaaaaaaatcacttatcttttgatttacatacagtttccactttttgccttggacctaagccagaagacatgagttctcaccccagttttaccaaatactggctgtgtaatcttagaagttattccatttctctgggcctcagtttccgttactccaaaatgagggtgctggactacagcagggaagattaataggtttcatcttacagatcagctctgatccgttgataatggccatcaccagagcacagtgctgagaattctgagagcacctctaggtttatcaggacagaggggcacgatccattagcagtgtctgccatcagcactggttgggggaaagcacatcaaccttggaaggataaacttgaagattccttccagcctccttggatcattgattctgttgtagttgtatgtgcattttggattgtgcaggtgtttgatcttttgctggaccagcatcacacaagccttgataatataacagccttgtgcctgtgtgtgggtttctttttttttttttttgtactgcaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggtaagaggtgctgcaggagcgatgacacagtgggggcccagatcacaagctttttgtagactctctcttctcttatcatatccactcccttcagggagatgtcacagcctcctaagtagaacctgcttgtataacaccctcctctgtaaactcagaatgtactgagttgcttacactgaatgaagttacaggtgggagggaagggctgtgagggctaataaaaaaaatcccttagattgagaccccatctcaacttcgtctcagatgcacacacggagaagaaagcagaaaggaagtgtgtctgtggtatattttcaaaatgctgcctaattctggatagcaaggattgagtgggccggagcagtcagggaaggcttcctggtgtgggtggtttggaaactggagccttggagaatggatttatatttggagaaggtgggtcaactggaggggcaaagatgcagcaatgcatgcagtaatgggaagggtttagatccaagacaaacaagatcgggagaaggaaggagaaatgagatta

SEQ ID NO: 64829 - DNA, 1022 bp, Homo sapiens
tcggggagatcttgaaagccaggcacggcgttgagacaagatgttttgggtaccaaagagcctctgtatgttccagatctaagaatgagatgatgaaagtagagttctgcaaagagaagtatggcagtaatatagtctaaagcctgcgctcttaaccacttgcagtaattcccctaatatgccatgaggcctagattatggggtggcttgaagggactgatattagaggcattctgacatagaatgttttaaagaactcagtaggtcgggaccttttttccctatatgtaccatttgagcatgcaggatgagtgatctggcaggaaacgcctttcttgaccgcacggtttaaaaacatttctgcatacatacatcctgcaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggtaagataagtgaagagtctgggctgggaagagaccagggagaaaactgcctccaaatcttgtctcttccaaagagagaagatttttcagcctgaagggaattggagaaggactctgaagtagagtttgttggaatccccgtctacccagaaaattagtcaggtcaggctggctgctgtaacagatagcccccagttgtagccatttaacactagcaaagcttgttccagccagatggacctcctgggctgttctctgagcacagttgggtacccagttctcctctaagcactcctgcttgtgctctgccatcttgtagcttcaaagtcatcctggcaacacccagctggctgacaaaggaaaagagagggaatgagaagatacagtctttgtttactcttccggccagggaatgacacatccccttcacgtatgttccactggtccctcctagatatgaag

SEQ ID NO: 64830 - DNA, 1968 bp, Homo sapiens
aggagtttgaaaccagcctggccaatatgttgaaatgctgtctctactaaagatacaaaaaaaattagccaggcatggtggcatgtgcctgtaatcccagctacttgggaggctgaggcaggagaatcgcttaaacccaggaggcggaggttgcagtgagccgagatcgtgccattgcactccagcctgggcgacagggtgagactccttctcaaaaaaaaaaaaaagaaagagcaaatggcttaagtgagcaactagctagtctctgccccatttttcaattttaagggacttggaaaaagactcagaaatggaatgaattggattgttaaaactgtatggaaatgtaaagtaaaaattatggctggaagagatgctacccttagcgggtgggtctttggagggtgggtggatcaggccctaggctttgaggaatgactatgcttgtaaggcctcagaatgtagttgctttccgtagtgtcttgttgggtcccaaatgtcttcattttccatgacaattaaataaatgccatcacctgttttcctgggcagatgcaccaacccagttccaactgtttcaatcctgggaaacagatggctagagcttttgtttacacgagctgtggatggttttagttatccaggtggtggaagggtccactcatgcttcatcctcctgactgccatgactgtaaggactgggcagtggctccaagaatcatttctctttaccactcaacattcatgtagtgttagctaatgtggcagaggacagtgcaggtggtgaatgatcccgagtagactacgagcctttgggagtggctctctgctctcaggttggctctttggtttgacccaggatgcctctgagttgctgtgccaatgaacagtaaactcatttaattattgacccaatcaaaaaatactgaataagaggtcaagtatactaaatacagagcacaatacatcaaaaagtcagatatacttttattttttagttgcccactgtttcacatttctcttgacaccaactcagtattcatagtcctgttagcactagagtctattcttgtggtcatctaatccagtggttctcacactgggtttctcgcatgttccccagtgggtgttttggctggatggtggagttagttggcctggcagggcctcctgatatcgtcagagcacctctggggttacaggtacatcttgcttgctttgaagaaagcattctgctctggaaactggggtgggggattaggaacagaaactattgcctgttttttacagataaaaaactagttcccagggaagtaaggcgatgagccagaagtcaccaagcattcagccgtaaaagctggacaaatgaggacaatagaattctcagacttcttagagcacatggccatcttgcattctgttttaccttttgcttcctaggaaaccctggaggacatcgacaagaacggggatgggtttgtggatcaggatgagtatattggtgagtactgacctagagtcttgctcagctgtcctgactgggccacatgaccccacccacacgtctggctactttccccagacgtctcttttagcaacagctgcaagtctatacgtcactcctgggagcttccagcctgcttgtcccatcagccctagtgatgtagtatcagggaagtattattaggcctcattcagtggagaagagatgaaaaggctggccctacacaaggctggccaacagttggccccatgactctgagaggtgcccttcatcacactgcctagttttacctttgcaaaaggacattggagatcccatagatttacagtgaagatagaggagacagtgtcagggcaaagcctctaaaactggactgggtcaatggagcctagaaactctgagtagatgcagctgtgattaacagaactgtttatgtgtctgagcactttgcagaaaggcattct

SEQ ID NO: 64831 - DNA, 3469 bp, Homo sapiens
cctcattgttttcatctgtaaaatgggaattataacagcactcactttgtaaggctgttatgtgaaaatcaaatgaaaactgtgtgtagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggtatttcccattcttctggaatcactgattgaagggagacagtttacataagatcggttttgtttgctttttcggcgatagcattgacccatgtggccatgtctttattgacttttccttcttgtcctacagtggagacctgtaaacttgagctaataccgtgataacccacagtaaaattattaggccccaactttcctggaaagtcagctgtgagccacagacttacattaagtcacatttcctaagattgcagaactttgtgggcaggacacgatttaagaagtataccccgtgttgccctaggatcagcttatttatccattcattgtcaccaaatacttatcaaacatctgtgaggtgtcaggaacaaggaagcccatcccattaaagcccagacatcctcaggcaagctcaggtttctggctttaatgcctagtacttcggtatctattgataaacatccaaataaacaaatcaatacatttagaaaaatgtcctgcctattccccactttgctgattgcccccaaattctcaggttatgccaacagtcagtttaggcagcgaggctgtaagaggaaagtggcattcttgagggcctattttgggaagaccaacactgcttgtgggcacaaatggattctagcttctgaattactcggggacttccctgacacgttagcacggtttttatagcaagaggctgttccgatttggagttttgcaatgcagtcatggtagatgaaggaggtgcccagtagcttctggattactaaatatagtattttaaatgttgtacatcagtgaaatgacatgaacatcatacagaactagtacagttaccagagcttccatgacagtgctctttgatctcttctataggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatcttcctgaaaaaggttgcacctggaaaatctggacttcttccctgggcctatgaggcgctgtaggaggaggcctatgggatctggcccctaccagcagtagcatcatctccttaccactgtccctttcataccgcctatagtctggccccagagactttctagtcctcagacacaccaaggtcattcccaggttgggccctttgcacttgctgccccctcacattcagaatacccatctctcacgccctcgggtaacacatggtacttcctcaggggggctttccagaccccactatttaaagtaatcccaactcgaatctcggtttcacatccccattttattttcttcttggcatgcattactatttgtattcatttccatgccttctgtccaaattgccacaaagtgggggatttacagtgacagaaacttacacggttctggaggccagggtctgaagtcaag

SEQ ID NO: 64832 - DNA, 1045 bp, Homo sapiens
ctggaaaagtcctgggccatcatcccctgggtaagggaggggtctgaatatcactttacatggagaggtaattagagataatgggagcatcttcgagctccactaactggaagcctctagacctgtactgtccaatacagtagccagaagccaccagtggtgatgtgctgtaagtgtaaaatctaccagggatatgtaagactttgtacaaaacaaaagagtaaaattttcatttacacattgaagtgaaaatatgtggatatattgggttaaataaaatatattattcacattaatttcacctgattttttttacttttattaatgtggctactaatgtagaaaatataacattgcgtacatgactcacgctctattggatagtgctcctctagaaaattgagatcacatattatttgctttgcatgctaatggcccagagacagttttccatgttgttttttgagtgtatgaatcatgactgacagctgccgttgagagcaccagtcagcaagtacccacagcctgtgcctctgctgtgtgtgaggggcctttctgtagatgttgtatcctgatgtggtgagtctaaggaaggccacacccttgagaataaaagacaatgtttcccctgtacagagtgacactcctagagttgaagtccaggaaataggtgccctcagacaagaaagagggccttggaagggaggccttggtaggttggagaggggagtcccacccatctgtccctggacttcaaccctttggatctggacaaagagggttctagagatggctgaagacacttctggagtgggtatagggaatgtggtttctgctacagaggcaggctggaagcagatagggaaaagatcttaggcatgagacaccactgagcctcacagtctggatttgcctccgtgcgtgttactctgtgttaatgtccttaagcaaagtctgatctacccggtacgacctggctttggttgggtgaggacttctagtccaggctgggttgagccaaggtggtcacagcagcagagcttag

SEQ ID NO: 64833 - DNA, 1048 bp, Homo sapiens
ttcttcagcaggtaggaaactgagtcacagggtacctaagctggccaggaatcagccctgcaaatctgagggcccagcccacagagtctcccatggctttctggggaaacgattgacgttatgggagtgaaatgggaacaactgtggcccatcagccccgtgtgtttagggacagcccctctgggcagcctcctttccagaatctcccacggatcctttgaccacaaagccgtgcacacggtcatttcattcactattaatgtgcgcccttcccctggcgtggctggctctttcttaaagttaaccagtaactggtctttttgttatccgatttctgtgagaggagccctgccaacaattctcaccaagggagcacttctgatttttgtttcctttctctttcgggtctgcggaaaacctttcatgtccctttgtgtcctagagaacggcacgccgccacccagaatgtgccagcctacttggctttcctcagcactgccgacggcgctctaaaccattcccctagcatcacattcctgacttcaaacaggccagggagattgagagctcctcgaataagtgggactttctggagattctcttgggaaggagtgacaggcagagagcaggaataattacactgaaagtttgttatttgcttgcacagttttcttcctttgtgtggagtttattcccggaagcccaaagaggggcttgataaacagcagaaaggctacagagccaattggctggaaaagaaatgacaataaaagtcgcacagaatgaagtcttctgtcagcacccatttaagttaaacaggtttacatgttgcagcagagaattaactgtttgatttgctagaaaccaagagaattttcagcacttggagtgagaaaaaaaaaaaatttacttttaacttaggtcttcaaacctccctcccctccaaaaccaggacctaattgcaatgattttcccatatgggtcaaagggatcattggaaagtccaaaggcaaggccctcggccctaagggtctgtagtttgcagcct

SEQ ID NO: 64834 - DNA, 1044 bp, Homo sapiens
ggaagcccctccccaggggcgggtgctggggctgattccatgtctcatagcctctgcttctcttgatccctttctgcatggaggaccccactctgggctgccctttgtcaggcagtgattgtgcccctggctgccatagccttggtttccttcgcctaagaggatgacagagttcttggctgttgcgctttatgtggacgttggcctaggggatacagtcaccgtctttcttgtgatgactcctggtggtggctgcgatgactcctgggctggttgagcaatttttaatttcaaaacatcacaaagctctgccctctagtggttctttgggaaacattcatattccctgtgcggggtgcgggtaggaagagaacttttaatgcaaactgggttgaaacagaacagccagagagcaggatgacttagagagagctgaatcctgtgttcgtgaatccgtgaattcacagccgaacatccctttctgtctcaatcgcctcttcctggccattgataagcttgagaactgtccggtccaatttagactattttaattaaaaaaatgaaacaacacatccctaaaaacaaaattcagtttggattccttgcttttgctcagtgcagtgcctctaaagccctttaacttgtaactgttgtttgttcacattactgataacacagttgattcatggattgcatcaacctgcctctttattttccttatgaaacatcccttcggcattcctcatcccttataaaagtattcctactttctcgcttgttgataagaaaacgcctttagtaacatacccacctcaatatttgactttttccatttcttcaaagtgaagacagatcttaatttaatatggcaagatgaactgtgtgctcccttcctcaagtttttaactttacccttaagttgactcttgcctactcagtgacctcgcaccctaatttttccgtttacttcctgtactgcatttgaagtgcctataaatcacatcttaggtcaaccctttccttaacatgaataatatttgtatt

SEQ ID NO: 64835 - DNA, 1066 bp, Homo sapiens
tttcagcaatgtgaaggatgagagactcagagcagagggaccagttaggaggctactgcaatggtccaaataggatctaatgccactctgaagaggtaccacagaaaatggagaggagggaatgaacttgggctttaataggacgccagcaatgacagaatctctttcttgagtttcacattttattcttgtaaagccacagtaacatttggtgagctttgaatggaagtgttcatactcagtggacttgctttataagaactaagattgattcactcgtgttcacatgctgattttcccccgctcttctctaagaaaatagtttaaggacaccagctagaccatactgtttggtctcagctttggtaattttgccagagaccaagtcctgtgttagggcacactattcctagctattctctaaatctgccatggtagcatggtgtttggagaatggcgttacaatatgtttcttttttttaccattggataaaaaaccagaggaaatttactgaattggggcaaacaggatttggattagacctgaagaactgatttcgagggtgagagacactggcactgtatgatcaagggggcttcagcatgctgttttatggccattttattttatttatttatttagagacagggtctccctcccttgcccaggctggagtgcaatggtgtgatcatggctcactgcagtcttgaacttatgggctcaagagatcctcctgcctcagcttcccaagtagctgggattactggcttttgccaccatgcccagctaatttttttttcttttttggtgcccaggctgaagtgcagtggcactattgtggctcactgcaacctccgcctcccaggttcaagtgattctcctgcttcagcctcctgagtagttgggactacagacatgcaccaccatgcctggctaattttttttgtatttttagtagagataggtattcaccatgttagccaggctggtctcaaactcctgacctcaggtgatctgcctgccttggcctcccgaagtgctgggattacaggtgtgagccactgt

SEQ ID NO: 64836 - DNA, 4256 bp, Homo sapiens
tttgggtagaagaatagctgggtcatatgctgggtggatactgaactttttcagaaactgccgctcctctgcaaagtgactgcaccattttatgttcccaacagcagtacaggagagtttcaggtctacacaaacccatccatacttggtaagacccaacaagcttaacatttcaagggaaggtggacttagggaggcgccagcgggaggcaacatcaatgcagttagctacacgggcctgaaaactggaggccgcgacaagcgtcgctgagtggaggcccagtaagtcccacccactaggccagcccgagcgcgtctgccacgccctgctgcattccgcggcgagagcgcgcgataggattggctctcaaggccccgccccaacaggtcgccgctcagggtgacccggaagcagttgcgccagcagcgtcgcgcggcccagttcccttttccggtcggcgtggtcttgcgagtggagtgtccgctgtgcccgggcctgcaccatgagcgtcccggccttcatcgacatcagtgaagaagatcaggtgtgcttcggtctacgggtgccgccacggtggggtgggggatgtcctagtagcgcaagggaccgctgccgagcctgggccgggcggccggggctgacacccgcagctgttctacacgcgagaatggggaggccggtggctggggcgcgcgttcctggcctcgattcgcaccagctcgccggccggcggtcccagcgcggggcccgacgcttcaccgccagctccctggtcggcgtcgggactcatttctgacgacatagtacttttagactgatgaggaatgatgtctgcttccgtccgtcaaatgcagccacattcggagtgggaggtggtgaatctgtagttagcataagcagggtagggaaaagtaattttgtgctaaagatcaaaatgccgggccgggcgcggtggctcacgcctttaatcccagcactttgggacgccgaggcgggcagatcacgaggtcaggagatcgagaccatcctggctaacacggtgaaaccctgtctctattaaaaatacaaaaaaattacccgggcgcggtggcacgcgcctgtagtcccagctactgccgaggctgaggcaagagaatcgcttgaacccgcgaggcggagtttgcagtgagccaagatcgcgccactgcactccagcctgggcgacagagcgagagtccctctcaaaaaaaaaaaaaaaaaaaaagatcaaaacgcccgtattactgtgcgatcacaggcgaagacgacccgtattttacacttgctttctattcctacttgtatgagggtgagagttgttctgtaccccggaagtatggtatcagttcagctcttaaattctgtgaggcatacacctgatggaccatcctgatatttttaaatttcccgtttggcgtttgctctttggtatacagggctgatggttctcattttccccataacaaaagtttaaccttatttggtaggagttgaacacgacatcgtattctttaagttaattttgtattgctgaaaattcttctgtgaagtcctaactttgtcgttttatttctgttactccactaacacggaagtaacttccaaatgattggatatcataaacttcgcatggaagtttacttgtctaagacaacttacagaattgcgggagtgagttccccctctctcctccccccgccccatggtaggaatgcagttccgatgctctgaagagcaaagtaagaagggaaaatgcaaaaggcggagaaaaggtcaaggatggggaggttaagcacagataggaagatatgaaagacaaaaagatacctgattagaaatggaagcatgttaccaacagttggctgttaggttaactgagaaagtgtttggaatttttttttttttaacatacaaagtgaatggaggaagttcttgtcattgatcgtatcttaaagtgtcttttctcaggctctgcttctgttcttgtaacatcagtatcgctgtagacagtcctttcagggaaatatgaaattgctcaggattagtttaactttggtgaaattctcagcttgattagagttaaatggaattctttatctttttttgttttcctttgcttatgctgcttccacaaccacttgtggcagtgaggatgacagaaaaacagcaaacgtggttcaatagttcttagaaaaagtttgctgtgtatctgtttcctccatagagaagcatgaagcatgatttctggaggtatttttgttttctctgacatggtgacagtttgttttctttttttaattttgcttataataccaactcttctatgaagttactgtgttcttgttacctgaaaggatagtaccgtcagatctgcaggtttaatactttcctgaggcaactaaatatacttgggggtttaaaaatcttgatggctttgaattttttttttttggcttggtctagaaaatgtaatgcctgtgcatttactaatggtatcctttcatattcctgttgcacatcctcattttattatctttaaaaccaggctgagcacggtggctcacgcctataatcttagcactttgggaggccgaggcccgtggatcaccggaggtcaggtgtttgagaccagcctgacgaacatgatgaaaccctgcctctactaaaaatacaaaattagctgggcatggtggcgcatgcctgtaatccctgctacttgggaggctgaggctggagaatcatttgaaccccggaggcagaggttgcagtgagccgggatcgctccattgcactcatgctattgcactccagcctgggcaataagagtgaaactccatctcaaaacaaaacaaaaaaaaactgcgtttgtttggctgccataaagagtcccagaagaaaaatggaataaatatatataattcggtagtagggtaggaaatgtccaagtgactgaatgtgctattgtagttgtgtttttataggtccgaagatgcatgctgactcagatatgcatttttaattttaagagattagttacataacagatccagttcgatgtaattttaaggcagcattcaccgcattgcccttttgtgaaccaaaatgcttatctcaaatagcttctcaactgattaacaaatgattacccttttgccaaggtaatgtctgtaacttttctagtagctgtggttatgtgtgtacttgagagcaatactattgttcatttctttcaaaaaaatgaaatctgccaagtcagattgatttcttctccccagcaaccacacccccaccaaaccctttgggttatattatcaaaaagatttttgctgtatgctggaagtccagcagggtgcagactacatgagagaaattctgaaggtgatccatgggggctgtagtgtgtctaaggagccactggacctcatggaggaaaacctgtggctcttgtgggattgccaagatggatgaggtgagggaggggtcttcaacattatttgaaatagttgttgaatacagtatttccgttttagtttttcagaaagaggacagaatttgagattgtgctttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaaggtttgtttttaatttttttctaatatttcctaataaaatcttttaaatttttcttgtgaattatagagtcgtccctcattatctgaggcaaggaggatttggaaccctcagatacagaaggctgactgtatttatatgttttgaatttcagactacaggacttttaaatagataggtagtggttgtatgtattttgggggcacaggtgatattttgatacatgtatgcaatgtgtaattatcaaatcagggtaattggaatatcacacatcttttctttatgttggaaacattcaacagttctcttctagctctttcaactatacaatacattgttaaccagagtctaagcactgttgttttcaatcttaccttcacacatgctttcagtttgtgtaatctattatacctataaagtaaacctattttgagaaaacctttattttatacataggtgtatttcttaagtgttattacactaaatgcttatagtctta

SEQ ID NO: 64837 - DNA, 7350 bp, Homo sapiens
tcccaactgagctggatcaagtgagttactgtgtggaatagttgttctgcttataagaaatgtactttttttttttttgagacggagtttcactgttgttgcccaggctggagtgcaatggcgcaatctcagctcaccgcaacctccgcctccagggttcaagcagttctccttcctctgcctcctgagcagctgggattacaggcatgcgccaccacgcccggctaatgttgtatttttagtagagacggggtttctctatgttggtcaggctggtctcgaactcccgacttcagttgatcctcctgccttggcctcccaaagtgctggggattataggcgtgagccaccacgcccagccagaaatgtacttttatatgttatactttatatgtgttactcagttttctccttttgtcaatctcttgtaggttagaaaatggatttctgactggaatctcaccactgaaaaaaagcacacccttttaagactactttatgaggcacttgtggattgtaagaagaggtattcaaaagtaatgaactaacatatcacttaacagacagtataagtaggtggggatgttttttaaagagaagtagggccagtaattttgctttactctgttctccacagagttgctataaatctatttctataaatttgacctaaagttaaagataactataaagattaaaagtagttttccctcatctttgaactttttaaaaagtgaaatttggctttttttctaaaaaaagaaaggtggggcctttccaacatgggcttcaacctactgctgtagcatgagcttggtgaatgtggtgaagcatctcatcatttttggatggtgcagtggcagactacaaaaaactttgtgttaatgtaaatattccatctctccacccatgtccttcctcttgcttatcacactctagacccagcgagcctatgtcaggtataaaagcaccatgctctttgccagtctggaccaggagctggcactggttcttctatagcccgtgtactaagaatggttttaacatttttaaatgattgagaaagaaaatcaaagaaagggtaatatttcatgatatgtggacattatatgaaattcagatttcagggtccataacattggtattacatccatgcctattcatttacatattgtctgtgcctgcttttgccaagagtttagttacaacagataccatatagcttgcaaagcttaaaatatttactctctggccctttatagaacgtttgcctaccccttgtctaagtagtcttactatagtcagcttcatgtctctgccagaaacacccctctcatatttcggttagtgcctcccttttacagcaccctctacttgtatcctagcatttaacacccttagttgaaagtaaggttgtaggctaagtgaaggcaaggaacctcatctgtaaaccattgcattcccaagaagatagcacttattgggcactgagtggataaatgctacccacagtagggaactggaaggggatacttgtttaaacacgacatttctgacattctgccaatctaaatgttgagagttggttttcttctttagaacacataaaatacatattttaatcagtaaaattctgagattttacctagcagttaagtaaaaatgcttcaagtttatgggtgcccccttcatgactttatttatattggtggttgatgcacatggtgtttgttgtgcttttttttttttatttgagatggagtcttgctctgtcgcccaggctggagtgcagtggcgcaatctcagctcactgcgagctccacctcccgggttcatgccattctcctgcctcagcctcctgagcagctgggaccacagttgccgccgccacgcccggctaattttttgtatttttagtagagacagaatttcaccgtgttagtcaggatggtcttgatctcctgaccctgtgatcctcccgcctccgcctcccaaagtgctgggattacaggcgtgagccaccgcaccaggcctgttgtgcattttaaagggtgttactggtaactaagcccttacatgtcagacaccatgctgtgtgcttcaagtggattaaaaagatttctttagctgagaaggttgaagtatactgtagttgctaaaactggaaaatgacttgcacctgtgcttacagtgtggcacaagataactaatgagtaagatgtggttttttaaaagtttttctttgaatttttatagttaagtcattatactttttaattttaatttttattgcaaagttaaaaattccttagttttttattcctggtaccactacactaccataatttacagggtaacatgcctgatgtaatgaaaagaaaaaggcaaaggtacaacagataaaagacctcaggaatgtacatctaattgacactacactgcattaatcaatagtgcactttttgcaacctgtagctatgacagtcctgaacaagaaggctttcctgtttaagctgcagtaacttttctgactgtggatcatcattcctctgtggcagatttttacagttcctctaatgcatttggatgattgcctcaaagtaacttgcagcttttctgacttctccttgcttgcactcctgccaaaaactgtagcccttttctgctgtttttagaaccttgtgctaccatatttaccaccatagagactgcccaagctttatccaccaaaactgccccctttcatgcatgggtccataatttggttgtcattgtccactgtaatatccaaaatcattatagttcccaccaccaccgtaattaccactccccaaattaccttcttcattgtaaccatcatatcctccactgctgccaccatatctaccaccaccatacccgcctctactatcaaaaccaggacaactgcggtagttgccaccatcaccttcaaatccattatatccagcaacccctcctccataactacttctgctgccaccaccccagcaccatatcctcctcttccaccagagtttctacccatggccaaaactaccatctccaaagtttcctccacaacccataaagttgctagatccactccacaactgcatctgttgtttaaaaagggcccttttcacttcactaacgcctgttaatagagtgttatttctgaaccacaattttatcatgatcatcaaaagttacaaaagcaaatcctctcttttttccactctgccagtcctcctgtaacttctgtggtttcaatcttgcgatacttttcaaagtagtctctcaaattatgttcttctgtatcttctttaacatcaccaacaaaaattttcttcactgttggatgggcactgggctttacagaactctctctagaaacagctgtctttggttccattgcactcctcagccttgtgtggttgagcacacattgctgcatccacctcttcaacacaagagtaagtcacaaaaccagagtttgtggaacattttgtttgggggtctctgattaccacacaacctgtgagtgtgctccatttcttaaaatgttctctaaaactaccatctctagtttcaaagctcagaccaccaataaacagttttttttagctgctctggctcctttggatcatggcctcttccaggttgagttcagtattaattttttatttttagagacagggtctgaccatgttgcccacactggagtacagtgggtatttggctgttcacaggtgcaattgtagtgcattacagccttgaattcctgggctcaagcaagcctccttagtaggtgggactattggcatgcgccactgtgcctaggcatttatatcactacatttaagatgcgggttaccacttagccatgcctacagtggtatttctgaatcttagtaaaccttagttttgaaagaagttttagatagcatttaccattttaaaataaatgatacagttcctgctgattttgcccaggctaaactcagatgtggggagtaagtatttttagaaaatgaaaaaaggaaaagaaaaacctcttcctcctagttagcaaagctttctataagctgaagattccacagtttaaagaagtcatgaggagtaaagataaacattttctaaaagtccagtttgaatgactgcatttatttattttgccctatttactccagtgaaactgatgtatataactgtaagaataatttaattggaagggtatcttaagtagagttatttaaatatttggtattgtctcaacttcagccatactgtcctaacagtttctgggacacaaaactttttttgcgcctagggcctttatacttggttttccctctgcttggaaagtcatcttaccccacctttcatgaacccagctcttttcatggccaagaaaaggatattttacatcattttggtctcagcttacttgccatctcttctgagggagactgctttcccactgtacataaagcggcctttccgttttctgcccttgttgctttgattaaatcaccatttatttccttcatagcacttattagttacttttccttagttgtccatctttcctactaaaaggaaggttttatgacttttcccatagacagggactttgtctctcttagtcaccgttataatgtcatcagcacagtacctgcctcttaaaaatattttaaatgaatgaatagcagtaatgctttcaagttcctaaagcaatatttctttttagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttctttttgaccaccttcttactttaaaaccagtcaagtttttggaaggcgagcttattcatgatgtaagtagtttatcctttaatgtgaaaaatgttctcctttcctaaattttacatactgaagcaggactctttttctttgcattaataaaagtgactaatggcaagatatggaaagattaagaactatgtattctttttatatcaggaacagacatatttaggaccagcttttcttcatccactgagcagagtcctattcttcctccctttcttaatttcttttttttttttgagactgagtctcactctgtcaccaggctggagtgcggtggcatgatcttggctcactgcaacctctgcctccctgatttaagcaattctcctgcctcagcttccaggagaagtagctgggattacaggcacatgccatcaggcccagctaatttttgtatttttagtagatacagagttttgccatgttggtctggtctccgactcctgacccccctgaccccaaatgatctgcccacttcggcctcccagagtgctgggattacaggcgtgagccactgtgcccggctacctccctttctttcatcttctcacttactcatcattatagacttagataatacaagtttcttttttattacatatatattgttcctagccccacttaggaatataagtctgatatttaaaaacacatgaacatttttcaaatgcaagtataaatatattttggactgttgtgcatctggactatgccattagccatcatctttcagtgtggataatttagagctcagtgtatttactgattatttcattttaaaagtgagccatgtgaaagcagatggtttggtaatttgatgaaacagaatgatatttctgccttgaacaaaatgtaggagtcagtatctttaaaataatatttacaatatcttagaatatcttacaataaatctgaattctgtattgatggtatcttttttgtctcttatctgtatagcttttaaccatttttgtgagtgctaaattggcatcatatgtcaagttttatcagaataataaagacttcattgattcacttggtaagttttggggtttattctttgaggcacagaggtgggaacatgatacactaacagttatgtactatgtgttccagcaagtatggctgtggccttatttgtagattatcctaaaaggagtcgtgtatgatagaacagcacaaaaataggtagacagtttaaaatattacttagaatgaattgagaatcagaaaccaagaaggtgtaggaggtggcatttgtgatagaaagagaatgaaactgggagtatgaaaacaactcggggcccagcgcggtggcttagaggtataatcccagcactttggaggccgaggcgggcggatcacgaggtcaggaggtcgagaccatcttggctgactaacatggtgaaaccctgtctctactaaaaatacaaaaaattagccgggcgcggtggcgg

SEQ ID NO: 64838 - DNA, 1028 bp, Homo sapiens
atggtaacaaatagttttttcccccctactatactattttatgcttggatacccccgccattaacaaattacaaaagtatatagtattgccagttagatctgaaagatggaattagaaatggaaatgtaattttacatgatagtaagacttttctaactacgtttgttgaaaacagcatagtctttattatttttatctttgaattttcttgtctagcgtatcagttcagtaaatgtttgtcaaattgaatcaaatcttattcatccttattgagcaaaccctacatatgttcaatattttaatttccttctggagcatgtttttaacatactaaaatacaaagagaaaactcagaaaatctgcagttgaacaggttttaaatgttgtaaactaccagtttctttacactggagtcaactgtgaaactaaggtgctttgttctcctactaggcaataatcaaaacacattagagattgattatattttccatattaagactgaatttttttttgtttttgagactagtcttcctggttcttgacgatacagatgaatgtatggtctattttgatagtcttcaatttggtaatcattaatgcttgtcacctgtaaattgtgtgcctccattggaattggggaagattgacttattctgaacataataaggcatttgaaatacaccaagataaagtagatgtaagtgtgtttgtgtagaaagctttgccaggtgcactagacccagaaaaccacattctgtcccagttaatttgttttgtggcatgaagctatgtgatggaatgttaatgtcagcaacctctttatttacgcaccaaggaaaaaggagtagtaattaacactttgacactcccccattgatgtgtaattgactgtttcaaaggagcactggttcataagctattgcatgcattaaaactgggttttctatattgcagcattttaagacaggggtcagtgacaatgcagaaattgctcaatgatgcactttttttattactgcattaaggt

SEQ ID NO: 64839 - DNA, 1050 bp, Homo sapiens
aaaagtaagtagtctcatttttgccatattctgttcatgtaacaggcctagaaaacagaatagtgaagcctgatgagtgttcatactaattaaagacctgcacaattacatctcatgttaagctgtggaaattatttttacttttgtaattgtggaaattattgtttgagcacttatatagaacaattttgacaaagcttcttatatttgcaaactataaactgactccacagagtattaaaaacaatttttctatagtaccataggtgatagattcaaagttaagaatcggccataaaatgattatttttagaccctaaaagttttgcacattttacatttttaaatagttatacattttaggagataaaatctacaaagtacatttcataagaacaatttctatttagttaaattacctaagcttatttttcacactaatagctcttcatttaaacacagaggatttcttatctacttattagttttttctgtgttactattactggtaaacctgaagttttaaaatactttcacaaacattttcagttatgaaaacattccattttgcttcaggtcactatttaaaaatcaaaactacttacaaaccaaaactgtcaaagtgtgtgtgtcatttaacatttataggccaatacagttagtactagatataattaaagaataccattaaaagtgatacttgttctttataagacaaaagtagaaaattgcacaaataattcaaattttgcattataatttctaatgaaacatgctgttgtaattattcaaataacaacaatgtgttaggcctagaagaaaacttaaggaattacccagtcctgatcctttcactttaaaaacaaaactgaggagcaaagagattaaatggggacttatagtcaaaaaatagcagtgctaggcctagaataggttcatttctaaaataaagggctagaaattttaaaaattaggaatcctaaatatataacctagtcctaagtaggagcagaattctaacataatatcatatatacttgttttgatgct

SEQ ID NO: 64840 - DNA, 2667 bp, Homo sapiens
gtaagtagttttgatttttaaatagtgacctgaagcaaaatggaatgttttcataactgaaaatgtttgtgaaagtattttaaaacttcaggtttaccagtaatagtaacacagaaaaaactaataagtagataagaaatcctctgtgtttaaatgaagagctattagtgtgaaaaataagcttaggtaatttaactaaatagaaattgttcttatgaaatgtactttgtagattttatctcctaaaatgtataactatttaaaaatgtaaaatgtgcaaaacttttagggtctaaaaataatcattttatggccgattcttaactttgaatctatcacctatggtactatagaaaaattgtttttaatactctgtggagtcagtttatagtttgcaaatataagaagctttgtcaaaattgttctatataagtgctcaaacaataatttccacaattacaaaagtaaaaataatttccacagcttaacatgagatgtaattgtgcaggtctttaattagtatgaacactcatcaggcttcactattctgttttctaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattctttaaaaaaaaaaaaaaaaaaaaaacagcaaaaaactgtatgcagtatttatttaatatagattgtcccagcagccataggacaaatgcatgacctttcttttggttgccccatactgttttgcttattagatttaaacagtgtataatgttggaaaacagtataaagttttattatggcttacttggtcacagttttcataccttagctatttttcttggaaattttccatataacatacgatataaaacatcttttttcagccgtaagaactaaaatggtctactgcaaaattgatcagacccagagaaaagtagttgtcaggtaagatatttaatgctttgcagcattttatagaacgatttagtttgttccgattatttcacttaaatgtttagagaaccaaggtggtgttatcacttgactgtagttaaatagttgctatttatcataattttattaaagttcagactgaatgtgattagcttatttaatgaaagagtcctattttccagcacatttcatttaatggctgagcattggctagaatactaatgacttttatgtctgctttatatagttgctcaggagaattagaaggcttaggatcaatatggtaaagattttttttaaataattatgtaattcttaaattctcttactattctaaattaggtatatttaatcttgcttttaactggattcaaatctgtagtattataaaagaataccagaggctaaaaggttgactaacactgtgtttaatttttcaatttttagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaa

SEQ ID NO: 64841 - DNA, 1039 bp, Homo sapiens
gtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctgggaaagataaactaattttaccttcgaaattattatacaaaagattttaaagagtctgtaaagcctctgcagttatgagtatgtggtaaaaccaccatctcttggctgatttccactaccttagtagttctggcaccagaaaagtatacaatgtgaatgtgtaggcttatgtagtagatcttcaaaatctctaatatataactgaagtaaagtgtacaaaaactgccttttactacttcatgtttcctcccatgcttcagaacaccattgttgaagaaacaggaagggcagtgagatatttggaagttggcatgttttcaagacactgtattgggtaattttaaaaatagtgtgttaaataactttttcattttaaggttcttttctgatgttaaaatacttactggaaatttagaaaatagagtaaagtagaaagaaactaaaaatcattagtaatcccttatccagagaggcttgttgacattttggtattatttgctgctagcgtttttttctatttttagcctatttgatcattctatagaattttatgtattttcctctgtgagcagtttcttaggtcattaaaaacaattgtctatggctgcaaaatactcccttttatggatgtttgatatatctcctactactgaatgtttgtttccagtttatccctaccaaaaattaattcgagttaatttcatgcaaaacaatctttgatgtttttgagagattcccagataaaattttctcttcaaaaggaatactgggccaggcactgtgactcatacctgtaatcccagcactttgggaaactgaggcgagtggattgcatgagctcaggagtcgaaaac

SEQ ID NO: 64842 - DNA, 1047 bp, Homo sapiens
attagcttcttttagttcccagatgctattactggaaagaataactagtaatggataaaaacctacataaatatttcctattttgccatcaaagtgctgggttcattttggtgtatttggcatccaagtacaaattaacagtttcccaaaatcctgattctttgacttttttatcttgatgatggaaaggaaggacacgtttacttgctttagtttctttccccttaactacccacttgctgagaggggtaggagcagggattggctttagagaaacaagatacagtgtagattagctaatgtttgcgcttaacaaaacttgtcctgtttaacttacctgagggttctgcagcctaccgcagtaattttagttctagctgttttcagatatattgccttgtatcttcgttctttcgtctcctatcctttttagaaatttatcacctgtttctctttcagcctgacttacaaaatctaatttttggcctaaaaatttcccctagcttggtactagtccttttatttctgcctgtgattatattttaaaattaaacttaaatgaatctaattcattggatatataaaaaaaaaagtaagtggcttgctttgcttactctggttttccatcctcattcctggatataatcaagattgcagtaggctaacaatctaatgctgaaaacaagaatgaaaaacataccatcttttcaagttactttggacccatagagagaaagtggattggtacttaataccttccctgaatttaacagaattgatgtggactgtacataaaatatgttgaaaaataaaactatttttttggctataagtcttcataaaattcatttataacagaggttgataaactttttccaaaaagtgccagagtaaatattttcagctttgtgggccaaatggcctcttacaactgctcaattctcagtgccatgccaaaacagcctttacaatatgcaaaggaatgggtgtgactgtggtctattaaatttataaggagatctacttttgaatttgccccacattaca

SEQ ID NO: 64843 - DNA, 1137 bp, Homo sapiens
attctttccatctcagtttccaaaaataatgtgaatttacttaaggattattaaaaacaattggacttgattagcttacttttagacataaccttttattaacataaaattttaaatgctcaaataccactatttccaaatttagatgagtaagaaatagaagtacatatccgatgcctcacactctccttccccaaacaggctggattgtatctatttgatttatacactgtgactttttcctgctgttttctatcaaccttaattgtgaaaaatggtgccatgttgccctcttgatattattttggagatcagttaggtcttaaagcatccagatgcgtacagttctacacatatctgtagaattagctcactaaggtctgctcggcaatatttttaattgacttacatgttctgtgggaaaagaggaatcataaaaagtctttgccattgcattcttctcttcactgggttctcccttgggatctggatggatactccagttattcaaagtgtcagcaactctgttaatgctggtagtatctgattgataaagaggaaatggcaacaactgaatttttctctaggtactcattttagtgactgaacttgtttctgatcctatgcttttgtatttaaaaagcaacaaatttctattttaatgttgaatattttgcagttgtcctagactttgctcttaaattaggcatttcatttctgaaaacaaacaagattttattattgctactttctaaaacctgattactgtaattccacattaaaagcagtgaaagaaatggtataaataccttctaaaacaaaataactcataaaatgttatcattattcccctggttactgtatttcccacacatgtaagcatttgtatagtgaatattttaccaactcagattaatggaaaaagtcagaaccaactacataccagatttataaactatttaaagaaattggccacagtgagaagtccaacaaagggctgtttagaaggggtcacattgggctttaataaattgatagaaatgagttagagaagtatgtaaattatgaaggttaaaagatactgatggcatatttaagagtattttacaagttgaatttctacagaattttagatat

SEQ ID NO: 64844 - DNA, 1093 bp, Homo sapiens
ggaagtttttaaggatgaatgaagagcatatagaaagaagagcaataaatattcacacttggcagaagccttaactacttcactgtatttgctctaaaagttaaaaacaaaagaatattaagttgttcctaatttaaaataagacgaacttttaaaacaaaatttacaaaatatgactgtacacatttatcaagaataagtagaaaaatattttgagaattaaaacattactttgttttcttacctggtccaatatcctttccaacatcatccacaccaatatttttacaaagagccattgaaatgatctttttgttttctgatggatctagtggtctctccttcagcaacaaagaaatgcaaggggtcgaactgctcgctgtttgactttcaatgtgatttacttttgaccaaggaccggggtctgaaaaattcatgtatactggagttttctcagtttttttatctgaagttgaaagatcaaaggttgaccttccgcttctgtttactaaatctccagatggctctatgtgaaatgaatgtgattcctccagctgtccttcactgaacatttttcctgaaacaatgtcatttaatgattctgttttctctgtattatttaacaatgtatgctgtctttcattaatgctcacaaaaaggaagaggtcattttttgtggcttcagttacctgattctcatcaatctgattctttttattggaaaactctgtttctgtgcaagttttcatgtgaacagcagttttcacatctttggcttgtgaagcatgactattctcattgttaagatgaagatgggaaatgttcacattagtgttttctaagtatcccaaacagttattaaattgactgttttgcatatcactcatatttttacacatagtttttcccccagggcttgagttaggtttcaccaacatagacatactatggacatttttatctgagttcttcagaagtagttttgaattagcactaaaagcagcatatgaaacatggtggtcgattactatatcacagggaacagttagttcagatttctctaaagtatcattacagacttgcagaaaatctg

SEQ ID NO: 64845 - DNA, 1047 bp, Homo sapiens
aaaaatactgcttcacctggcatggtggtgagcacctgtagtcccagttacttaggaggctgaggcaggaggatagtgtgggcccagaattttgaggcttgtcgtgcactatgatcgcacctgtgaatagccactgcactccagcctgggcaacatagcaagaactcatctcttaaaaaaataaactactgctcaaaacaatttgcctgccatgtctatcttgtttttagtaatggggtggttcttctattacatataatgtggtattatataataatgtggtatgcatgtttgaaaatgtataaagatctccattttgcttaaatatgatagactatataaaatgaatgtaaagtgatatcgttataaagagtatggtatattaaacttactaaaaaatcatttgactttcaaatagaaattgctgaatggttgaactgaaacacagattccacatttatcacatttgctcaaatgttttatacttgtaggcaatgtttttaaaagaatctcttccattttacactagaatgttccagaagtaaataatgaaaacagtgaaatgtcaactgaaaaatcagaaaacaccattatacagaaatataatactgagcaagaaataagggaagaaaatatggagaatttttgttcagatactgaatacagagaaaaagaagaaaaaaaagaaggctcatttatagaggaaataattatagatggtaaccttaaaattatattgatattttctaatttgtatgttgatatttacagtaaatatttttgggaaaattacattctgcctcccctcttcatgacttattcctagtctttttggattctggtttctgccttcactgttttgctgagaatgttcttggagtcaccagtaaccttctgatgaccagacctagggcatttttcttaattcagataacctttctgtaaccattggaataatttattaattcttccatcttgaaaaagtgttgtttaaagctgatactgattggaggtgttcaaactcaggctgaacaaccacttggtgga

SEQ ID NO: 64846 - DNA, 1909 bp, Homo sapiens
ctagtggtttgctggagccagcttttgccagtgggggctggttgttagatattaaggaattttgtgaactggttgttaaaccaatggtagtttgaaattaactatgatgtgaatatttaacatgaatgaaaatggcaaatgcctcaaatcaggctttttttttttttttgagagctagtttatcagtttactactacgagtatgatattgacaagaggttggaagtctgaattctaaatggtgagaccttccagcccagtatcctcattgagagggcaactagcctaactctctggcagaaaaatggaagattcctttcaggggaagctaacctgcccgagagaaaagactatagctgctacagttaagctttcccagtgaaatagctcagccagatcaatccacagtgaaacctaccatttgacaaaactttcagccagcattttaatacctcatttttaaatatgaataggtagttaaggattactggacatttgaagaaagcctctgatatggtttagatatttatccacccaaatctcatgttgagatgtaaaccccaatgttggaggtgggacctggtgggaggtgtgtgcgtcacgggggcagattccttatggcttggtgctgtcctcaagatagtgaatgatctcgttttcacgagatctggttgtttaaaagtgtgtggcacctgcctgccttgctcttgctcctgctttcaccatgtgatgtgcaagctcccacttcaccttccaccatgagtaaaagcttccttaggcctcaccagaagcagatgccagtgctatgcttcctgtacagcctgcagaaccatgggccaattaaacttcttttcttataaattacccagtctcaggtatttctttaacaatgcaagaacaacctaatacagcctccaatatgaaaaacagacaaaacaaataggataatgaaaaaaccttgtagaaactaagaaagtatgtttagttaaagggaatatgttaatctacaaaacaagaattttgagtttataaagaaactcagagaataaacgagagccctttagataaatatattagcagacataaaaagtacaaaggaaaggttggaagataatactgtcttctaaaaagtagaaccaaaagacaaaaagatggaaaacaggaaaggaaattggggggtcagttcaagatgtctggtgagtgtcagagagagaagagagaaaatagagggagaggaaatgaccaaagaattaatacaaaaaagtcatccaggcctgacagatgtaagtttatcttgcccaataccaatgcatatcattatgaaattttgtacaacacataaagaaaagattctaaaattgtacaagaaagtaggtaatatacagggattaagaatgagagtggtaacacaaggtttcagacttctcagtggcaacactggaacgtagaagacaatagaaccatgccttcagatgttgggaaaaaattgatttctgaagcagagttgtattgtatttagccaaacaaattgccgagtattggtagaatcaagacatcttcagacatatagggtctcaaaaaatttaccaccctatgcctcctttatcaagaagtagtagaatgtttgtgctaccaagacaagggagtaaaccaagacaggaaactatgggatctgggaaacaggagactcatgacagaactgaaaaagggtatcctcagagataacctaatttgtatagctgacagagagaagtaggtcaaaattgtaatgaaaggatggatgtctccaaaaaactgaaatcgagagaatacctgaagtaggtagtttcctttagatagagttattgggtgcagacaagaaatgattgatattgctagtgcactgttttaagagcatgatgttcttggcc

SEQ ID NO: 64847 - DNA, 1064 bp, Homo sapiens
ttttaagacgttaattactgaaacaactagatttatttttatatccttcagtatccatagttgttttaattattatctcatgtttttgaatatttttccacagtggaaattatgaattcaataagttattttgttcaataagttaagtcaaagaccatctggcctatggacttgaataattatttattatacttgttttctactgtgtacttgcatctgaacttattcaaaatttacttattttaaactcacagtttagggctgctggttacaacactgaaggtttttctctagccataaaatatgctgttaacatatttaacataatgtttaccactcaccgtctactaacctttattttggcagtattggtaataaaactgcacttgtctgttcacacttaaatcagaaacatctatgtgtaacatggtgatgtaaagggctgtggttgttaccttgaatggagtaaagtagctagttcaatcagtgattgaactgtcactatacttacacataccactttctaagcaaccttgctaattgaccatgaacctttgtgtcattaacaatagtatgcttgagtgatatgactgctctcatcaagtatttttttttgccatttacttttatcctgagtaaatccaatctttgattttatcaacttttatattagacaaaggtaaatcgcatttttctttatatcatgttcattactcttttctacttacatttattataatttgtagtttctcttagatctttgaatctattaaggtactacaggatatttaagtatgaaacatggtgcattttcttgaggagcttatggtctataggaaagcctttattgttaccggctatgagataattaatcttaattatttaaatacataaaggaatacttaaatattcatgccatttattagtacttgagagtactttattttaccagtagggaaaataattctacatcacagtgcagctgtagcaattacagaatcccttgaattcggcttagtagaagtaataggtaacagtgccttgcacgtggtagatgctcaaat

SEQ ID NO: 64848 - DNA, 1055 bp, Homo sapiens
ttgctataaagagctacctgagactgggtaatttatgaacaaaagaggtttaattaacttacagttctgcaggctgtataggaagcttgactgggaggcctcaggaaacttaaaatcatggcgggcggggaagtaagcatgtcttaccatggcagagcaggagacagagactgctaagggggaaagtgctacacacttttaaacaaccagatctcatgagaattccgtcatgaggcagcactagggggacggtgctaaccattagaaactgcccccattatccagtcacctcccaccaggcccctcctccaacaacgtggggattacaatttgacatgagatttgggtggggacacagagccaaaccatatcagtacccctctggtgggggatgttaataattgggggttatgtatgtgtggggcagggagtatatggtatatctctttaccttcctctggattttgctgtgaacctaaatcttctctaaaaaattcttttaaaaatcattctcagtcctacagctttctaaattgaattacaataatttttattactaaaatatttgtgtgttttcttttcttataatttaagagttattttgtgacgtgaaaattaatatattttttgggaacaatttaagtcattatcacttcaagtattaccttccccaacgagtctttatattttctcctttcaaactcctaagaagatatattttgaatcttctcatttatcctccatgtctttataccttatatactttctatttctttatgcctgtgagcatcttatgtaattttctttctttttgagatggagtcttgctctgtcatccaggctggagtgcagtggcgcgatcttggttcactgcaagctccgcctcccgggttcatgccattctcctgcctcggcctcctgagcagcttggaccacaggcgcccgccaccactcccggctaattttttgtatttttagtagagacggggtttcaccatgctagccaggatggtctcgatctcctgaccttgtgatctgcccacctcagcctccca

SEQ ID NO: 64849 - DNA, 1041 bp, Homo sapiens
catctcaaataaataaataaatagttcatttactttagtgactggcttttttctcgttttatatcattattatttattttctgaatctgaaaataacatattcacattatttccatttcaaacaatatagatgtgtaaagtgtttctttagtctcagtgaccagtatagatcactgttaacagtgatccctttattttaatttttaaaattgtttatcagttgcagatgaagatgtgtgccctggaagaagaaaaggtatttataatttttttaaaattttctgtctattaaaaagtatttacttttacaaaataatttaaaacatagctagatgccttttattatccattgtttaccataagagaaaagagcattagtaacaaactaatagagatggttaactgcttaaaatcttagaaaggacccaagataatcatgttacttcacttccatcatttacagttcagaatatagaggcctaacaagattaaatgacttgccaaaggtctcactttgaagtggcaaaattgggactagaacccagatctcttcaggccccaaattaatgttcttcccattccactgcagtgtttctattaaccatgatgtttttagtgctttttcaatggaactactgtctttaaaaaatatggaaatgacttgcaactgggtgcagaccaactggcaaaggggataaagctccaacaaacctagaaatttatctgacgctaaatattttctctagctatttaatagttaatacattttttattatatcaatgaacataccattaataataatcacttatggtttatttttagccaaaggtcttctgtaaaaaattctcccatatttttatattcattagataaataccacctgtatcttattaattagaatatatttattctagttgtatgaattaaataattataaagtgtctgcaagttctcaggtaggatgctctactgataaaatgatttgtcattataataagacattctatttcatgataattgtaaccatataaaggccttat

SEQ ID NO: 64850 - DNA, 1053 bp, Homo sapiens
agcaatcccagatcatataattcatgtttatatgtttttagatcatattttgattgttctgtatcttttttactctacacatgcaccagcttgtgtataattaatgggtataatttttcacacaaagattcactttttgtgacaaatgccatccatattttacatttacatactaaattaataattatgtatgaaggagacaggcttataggactaatttgccattcttttcaagttatgagagtattcacaagaataaaagacaatatgatgaaaccaacttatgtgatatttaagaaaaaagcaacttgaaacttatggttctttaccaaataatttttttgggaaaaatgtttttgttactgaaaaatcgaaaattttttatagttgtaaatataaaaaagacaattgtgtttatattctttgaatgttttagctaatgtcaaagcctactggttgttattatgtgaaatgatagtgtgaaactgatgctgttatagtataacaataaggacgtggctcatgtattttatgtacacatgcattcaactgtagtgacaaatggcttcatgctgtgtgattaaatgcatattagcgtttgccctaggcatttggttattaccatctttacttcattacattaccacactgtatggccatataatttataagataatacacatcactttgttgctgataggaattattctgttttatggatggtgtcctttaattttgcctttcatggattataaaattggttaatatctgctgaagtgaatcactggagaagcaaataaagatgttggcctcaggtcaaagtgtcatttgtgatactggcaaaatcttacaggctcatttatccctgtacatgattgataacagcatgggttaaatggagaaagctttgcttccattaaaggatcatcatgaatgaagacctcccacttaaaagtcaggcatgatgagaagacaagagactatctacaggtcaaattaaataacttaaataatttaagtagaatgacagtgtaatttgtccattctgtgtta

SEQ ID NO: 64851 - DNA, 1087 bp, Homo sapiens
cgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacaggtacgaggcctggcggcaggacctcggcggggagggggttacctggaaggggccacctcggcggactgggttggattcgaacacatagcgagggttgcccgcggcgacaggtgcccgatcagccctcggcagggtcactgggcacggcgtttgtcccaggcgctctcaggggctgcttcctgggcgcgcgtcgggttccggcgaccgaaaccgcgcgccgggcgctcttgcgcctaggctttgagtacaacaggttggtgattcagttcgacagaaactcaaagtgctgagctaggggccttttttttttaatatttttttttgtttgttttagtttgtttgacagttgccagactatgtttacgcttctggttctactcagccaactgcccacagttaccctggggtttcctcattgcgcaagaggtccaaaggcttctaagcatgcgggagaagaaggtaagcactaaaacgtccctggaacccagagccgcatagcacagatctcagtgagaaagtgcagtatttgaaattacatacccccagcaatcatagaaacactaaaatatcctttagtttaatttgtggcatatttggcaaggttgtgtttttttatgttctttaactgcaatttatagaatttgatgtctgtgagtctcctttaataagtatatacgtaagacctagtttgtggttaattgaatggaaaacctatttcagcttctgaaaatcagtgagtgacatttctctagatgaagctgtgtggcgattataataagcataattacttgttcttcctggagaggcgaacggggagtccaggatctagtctggacttgcgagaccctgggcgagataacttaatcccgtttggcttgaatgtcttcatctgtaaaagtgatgcgggtggggcgtaaaatgatctctgaggtcctttt

SEQ ID NO: 64852 - DNA, 1052 bp, Homo sapiens
tagtctggttttcttaagtaatgtgtactagagctgggagaaacaggaagacagaggaaaaccaacaaggatgctagcatggcaattcagatgtgaggtaatgagtttgaacctgtcttcaaggaaaaagaagtcgtagaacttgatgcctgattagaaagaacttggggccacacgcggtggctcatgcctgtaatcccagcactttaggaggccgaggcaggcggatcacgaggtcaagagattgagaccatcctggccaacacggtgaaaccccgtgtctactaaaaatacaaaaattagctggacatggtggcacacacatatagtcccagctactcgggaggctgaggcaggagaattgcttgaacctgggaggcagaggttgcagtgagccgagatcccgccactgcactccagcctggcaacagaacgagactctgtctcaaaaaaaaaaataaagaaagaacttgggaatgttggaacaatatgacttgaacctaagcttctgtgctgaagaaatatatgtatggaagctgggagcaagaaaacaaaatttggatttgacaggacaaaatggttcatattttatttatttattttttttgagacagagtttcgctcttgttgcccaggctggagtgcaatggcaaattacaggtgtgagccactgcacccggccaaaatagtttatattttaaagatagctcaagaaaggataaaacaacaaagagactaataacccacgttttttttagtgaaggacttgaatggacatttctctaaaaatatatgaatggccaacaagcacttgaaaggtgttcaatgttgttagatattaaggaaagggaaattaaatcaaaaccacagtgagagccaggtgcagtggcatgcacctgtaattccagctattctagaatagctggaataataatttttaaaataacaagtattggcgaggatatggagaaattggaacctcatattcacattgccagtaggaatgtaaaacggtacagccactgtggaaaagtttgacagttcctcagaaa

SEQ ID NO: 64853 - DNA, 3099 bp, Homo sapiens
tttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaaatacaaaagaaattagccagacatgatggcgggtgcctctaatcccagctactggggaggctgaggtgggagaatcgcttgaactcgggaggtggaggttgtagtgaggcgagattgtgccattgcactccaacctgggcgacagagtgagactccatctcaaaaaaaaaaaaaaaaaaaaagattatccaaaaagatattggacctactctttcttaggatttttttggcggggggttagaaatacttcacagaatttgacatttcagtataaatctgtgaccttaatataatcacttggttttatatgttaaattattgcacagcagtcatcatattttgcagagtttagttcttaactcttgctgtcagtcatgttttattataggtagtggggtcagtagttttcttcttctaaaaaatactatttgctatgaagttagttcttcagaagatacaagtttgcaatgaaaaggatttgcaagggttgttatgctatcaaataaacagacctaaaatctaggagacactagaacttaatgaagttgcccctgttactgattagtaaatactcccatcttcgttgcaaaattatctctctgtataactacatatgattattttgaaatttgttaaacttcataagtaatagtttgagaatgtggaaaaagtaatttgcttttctgctcttaaaataatattgattaatgttaccagaaaccttttgcatctcttaatatgtctgaacacaaaaggaaaacaccataatcatataaacccattctttgtctcttcttctaaatcatatgtataaccagtttttccttaagaatgtagcagcatataagctataaatttctggagtatatgcacacaaatttatctgggtgggtatgtaggtatatgtgagtttgtttcctcttccaggagctcaagaaataacatactcctgaaaaatagaatagaaatttctgtgctttatgtttttgccaggctattacattttcttatcatttaggatcacttataaaatgatcattgtttattttgttttataatttttacaggagtgagactgcaaacccacatgtttgatagttcctaccaaattaaaagtttagaaagcataaatcatattacagtgcatatgtgagtgtatgtctctcttttaagatgcatcatcttaaggcagataaaagtaagtccttaatcattacagactgccaaagactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggttggtgacaactgggtttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgctctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattccatatagaatattctcttttgataatgaaaaaaattaaagagagcacaaactttgactatgtcaaagtatttttatttttaattttttgagacaaggtcttgctctgctacccaggctggagtgcagtggtgcaatcacaactcactgtagcctgaacttcggggctcaagcaatcctcccacctcagcctcctaagtagctgggaccacaggtgcacctcggtacacctggctaatttttgtgttttttgtagagacagggtttcaccatgttgcccatgctggtctctaactcctgagctcaaggaatccacccacctcggcctcccaaagtgctgggattacaggcatgagccaccacactggactgctgtgtcaaagttttgcatcttttttttttttttttccagaaggagtctcactttgtcacccaggctggagtgcagtggagtgatc

SEQ ID NO: 64854 - DNA, 1033 bp, Homo sapiens
aggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagtatttattgcttgtttcatttaagcattcttcctcatataatggcatataatgaaatatgatattatattaattaaatttgaacaacacattgagtgttttcaaaacaatatttatagcatgatgtcaatgtatatctttcacccaatggggctagcattctatttagacaatttagttgcagttgtgaaagtggtattttctttaacaaaatttaaatatttaatatagtgtttgaggcaaatatattactccttaatactaaagttattttttgagctatatctatacataattgaaaaaatcagtagtaatgttatgctaaattataagagtaatatagcaagacttccagcttaaaagaagtaatacgaagtatcatacacataagtgaacattgattattattcagtattatttaatgttaaacatttagaccaccttaaatttttttggatc

SEQ ID NO: 64855 - DNA, 1064 bp, Homo sapiens
ctcactatttgacccttcgggttattttgagggactccagtactcagttccctgatcgcgatttctttctctgcgccccaatccagaaacagctgagcgagctcttttgcagttccgcttactccctccccaaagcttgctgggctagaggacccttttcctgctgttaggggagatttatattcaaagagattcaaattcaaacgtattattttccaatcctcgctgaaagggcctttcccaagggctcttattaactgtccccacccccaccttggggatttttctcgctctgggtttcagaatcttctatcccaagatagataaccacctcttcattgattaatccaactaccatctggatgactttaattacaataaatttaaactcaccatgcactctgatgttgaggggttttgtttgagacttggaacttcagcaggactctctccccaaacatttcctatctgatctccaagctgcttggtgtgcggtaatttaatgactatttgcggttcttctgttgcatagcagagttgtatttcttgtaataactcacaagtattgaaactagggaatcgtacaaatcatcgtttggcccttgggccataaatttaaaggttaaaataacagtaaaatttctatttaatgaccacctccttttaaaaatcaatattggtttaacacctattatgtgcttagcacagaaatctatccctcaagataagcataacataaaggtttaagcaaatcagccgtagtgaaagacctaataaacttgatacgctatctctgatgaccattgaaaaagtttaaactttggtaataatctggtgttggatctgctatgccttgcgagattaattttgttctggaagatcctgttttcctcctggcgcctacatccttttgttcctattcattcctttttgcaagtctttctgcacctgtgatgcttggagcctggtccccgggtggggaagcaaggaagtgagtagtcgttatttacacatgaattcaaacgtgtaggcacagcgactttgccaattttatgttaattaca

SEQ ID NO: 64856 - DNA, 1583 bp, Homo sapiens
gcagcagccccagcctcaaggccaggtagggagggtgggcggcggggtcgcggtggaccaggaaaggccggggatgcgtttggggccttcgctcggttgcagcgccgcccagaggtctgggccgggcggggagccctccgctcgccctcggccagctcgggggaggcggctgatgactcctacggggtggtcgcgggtaggtgggggcgcccggtgcaggattcgcgcctggggacggcgggtgaaggaatagctgggcgggagtcgtggggctccgtcacctcttgggtcctgggctctcacatggtgaagtttgggctcgtggctgaactcgggatctgtgagacccaggattggcgccgggggtccgaagggggcgccggagagtttggggcagtggcgatccattgtattggaacctgggtggccgacaatgcggtcttggggactccggcgtgtgagggttgcggaggcgggagaggaagagtcgcggaaccgcgtcccggagacactggggggcccgggagggctgggctacgggagaatccccggggcgcagggcagaagagggggcccggcagggcgcgaacgcggctccagggccgggtgacatatgtttgcgctggtggccaagatttaggcgatttttcttccacgcgttcaaagttgctcttaggtttcctccccttttaacaacagcaggaagtaaggaatctttctttgccttctatgcctcggggtgactgagagttgggaagaaatggggcgggggttggggtgggggtagtgaaggccgtaaaggttgaagaaccaaagcatgcttctccatctcggcctttaaggtccgggtgcattatgtagcgtggggttcaagagttcatcttgcatgaccaagggaatctaaaattttgactcctacttgatatttaagctcgcgggaaatgtgtagtagtgccacactgtgaaacggtcccatttgaatgataactggaaggcgtggtctggtttggagaattggtgagcggggtgttttaaagccacctctcccgaacaatacagaatctggtaggtgcagcttctgattacatggaccagggaatcctgggttgctaatgacttcatcctcagctaccaacaggaagcttcgtggctttatgatctcatcagatttcttcattatttttcacgacagaagtgaacttttgttttaagtttatacattaccgtgttccaggttatcttctttgtttttacgaaagttctacgttcatgattgagcaaataagtgtgaagggtagctggtctttgtcttagattgtccattgggacgattgtgaaagaatgagaaaaatttgcttcaagaataggaatataagctttctcagaaaattttaggccctttgttttcaagacttgggagttaacaaaaataatgtgatgtgccaatttggagctaagtaattaaatgctgaaacctttcagaaatagccataattttgtattacatacaagtaagccattttaaggagtttcatgaaagacgtttggcacttcacccattatttcttgctgatggtaatttg

SEQ ID NO: 64857 - DNA, 1018 bp, Homo sapiens
acaaatgaaaattactttctcatcattgaacagcatgataggtatttgtgccgcattttttatcttttaaatgaaaaatatttattaggtaaatggaactgaaatactacctagttacttcttttagtagaatacttctgaggcaagaaactaaaatctacttgtcatattttccaaatgttatttatcagagtaacacgaaatgacttcccaaacacacttgaaaacagtaagtagattcacttggcacacataatctaaaggagatttattttctgtttactagaagttattgaatcttaaatattacccctcatgccctctccccctgcttttttaaaaaataagcggtggggggaatcagctaaaatacagcatagaaaatgcaggtttacccccctcccccgccagcctgctttgttaacatcttgtattgggatcaggccatctgtacagagttacacttctgaattatacctcattttattcctcaaactgtgcaaatattccctttgatttcagttatatcaaaaatggcaaatctgaaatatgccttgtaagtctaaatattctacacttcagaagcttatttatatttttataccattttaaaaagctttttcataatgcacatatcagttgaatgtttttgttcccctttgtggcagtttcttgtgaaggtgcaaatgagtactagttgtgatgatgtaatatggatacttatccataaagaattagcctgtctgtcaccttgtttcctgtaacctattcagaagctgacagatggtaatgacattcagttgttgccgacagggatctaacatcctactttatgccttcttggtcttgaaatacatcattttcatcagttgatgggaaggtacatgataaacagcttttcatgagtttgaaacaatacttttttgaatacaacagctctgttagttattaggtagttttattgtactaacagtggaaaaatagagtgggaaactccagcattataccttaaatgggg

SEQ ID NO: 64858 - DNA, 1014 bp, Homo sapiens
aaattttctcctagaggaagtgcacttccctgagatctgaggaagcagcaagtgcaaatgtcgcaaggcaggaacaagcctggcagttcccttccctggcaggatcttgctgtagctcagtggtacttcagaaccacccagagggcttgttgaaacacaggttgctgggcccaactccagagtttctgaatccataggtcttgggtggagctcaagaatttgcatttctaacaagtttgtaggtgattcttatgctgcttgtccagtgaggagattttgagaaccactgacctggatcttgtcagtgttggcttcttgacattcttatctccttaaatatcatctcttcgcaaagaacttccttgagcaccagatctaaagtcccaccaggtttcctttgttccaacgcttctgttttccccaaagtatttttccttagctgacaagaccagacaggtgagtttaggagtctgactggacatgtgtatagagacaatagtggaatctcagagattaaggtctttgagggtgaagaatgaagggctgagaactgagcctttgccattgtaggtgatagtgtctattacatgcctactatgtgctgagcactggcctaataattttatagtgttatctcatttaacttctcataataattctagaatgtaggtactattgttagcccgttatatagacaaggaaactcaagcaaagagagatttattaatttgtccaatatcgttgctagtaagtggcagaggcaggatttgaacccaggaggtgtaacttcagagaccgtgctattaatcataagctttcagggaaaaatccttttgggaagttgagggtataggattaaatagaattggcaaatgaagtcagaaagaggtttaatgatagaatactttgaagaaggatgttgggtctttgggatttaacatttatgctgggaggttatattttccattatttaaaaaattagaatcattttcccagagcatacttttgccaaaa

SEQ ID NO: 64859 - DNA, 2003 bp, Homo sapiens
aatcaataatttctgaaagggagatctggatgtatatagtttgaaaaaactaaccaggcgatgctgatgagcatcgcctggttacagaccattctttaggccaggcaaagtggctcacgcctttaatcccagcacattaggaggtggaggtggaagaatcgcttgagtccaggagttcaagaccagcctgggcaatatagggagaccttgtctctataaaaagatatttaaaaaactggccagacatggtgtcgcacgtctttggtcccagctactcagaaggctgatgtgggaggattgcttgagcctggaaggtcacacctagggtgagttatgatcacaccactgcactccagcctgggcaacagagcaagtccctgtctcaaaaaagtataaatttaactcttactaaaattcttgagaggctcttgattcccttgaagataaaatgtgagatccttattttggtatataatattccatagtttggttcctgtctacctcatatccctgttctccaatacaaccatgctgaattactacagttctaatgtgccatcttagggatatttctaggtcttcatatatgtgatttttatcttcttggaaccttcttttcttttgctttccctggataatttctcctcttcctttttttttttttttttttttttttttttaagatggagtcttgctttgtcgcccaggctggagtgccgtggcgcgatctcggctcactgcaagctctgcctcctgggttcatgccattctcctgcctcagcctcccgagtagctgggactacaggtgcgcgccaccatgcccagctaattttttgtatttattttagtagagacgaggtttcatcgtgttagccaggatggtctcgatctcttgacctcatgatccgcccaccttggcctcccaaagtgctgggattacaggtgcgagctaccgcacccggtctttcctcgtccttttaatactcagttgtcatgtcctagaggaagtcttcccagattgtgttatgtttatttacttatgctcttttatttctctagttcctagcataacacttggcagtcagtaaatgtcagttgtataaatgcagaacttacctttaggtgcaacaatagtagcattgattcagcattcattatgcgccagttgctggactgtgctagttgctgctgaccgtatgtgctttattgtttactctcacaacaacctgatgaaggtaggtgttactattacccatattttactgttgaggaaacggagacttggttaagtctaactaattgtctgtgtggctagcctctaagtcacagaatttatatagaactggatttgaatcctgtggcctgtttgcagagctatgcttttatacagctgttacacagttgtttcaaagttccctcgtttattttttcaaattcatgataaataatttcttaataagagctgattattcttaggctacatgtttttgcttttaaattatcaaactggattagctaaaacaaagattttaaaatatttggcatttaggtatgaatgggataggtatatgctagagttccacacagatttaattcagtggacttagtgtttatttctattcggattttataccaaagaatactgtgtgctaaataaagtaaaaatatttatcttaactgagaatattagaactacaaagaacattaggctttataagtaggaaaacaagtattctacaagattatgtactttgctcaaagtcttgtagcatttatttgcagaatcaggactggaatttggggctcctaacttccaatccagaatgtttatctttctcaactatgaaaagctgatatacctaaaactgtaacaatattttcaaagcttaaagagaattctatttttattatattctaggtatttgtgaccaaattatttaacacaaaaagaacaaagtgatatgactacttaaggcaaaatcatttattcagtgcttaagtaa

SEQ ID NO: 64860 - DNA, 3648 bp, Homo sapiens
ccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactgtaactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacaggtaaagttttacaatttagattcataattattactttcttctatttttccagctatagcccacattttaagcttttttcacttaaagcaggtctgcaagtacattttcaggacaaaatgtataggtaggtatcttaaggacttattttttaaatttttcttgcctataggaaaggtctatgttttaggttaagtagttctgctttttcttggctttttgccaaaggcagcataatctgtacagtatgccatctaatctgagacatcttgaggtaattgaggcactgtattgtgggcattgctgtagtataaacctggtacattttcttagtttgccaattttatctgaagattaacattttattattaaatatggttatgtttaaatatgttgcaatagtccaggtgacaaatgatagcttttttcagatgaggcaacagggatgttatagagttaaaatctgaaccattaaatgtggttatgtgcagc

SEQ ID NO: 64861 - DNA, 1044 bp, Homo sapiens
atcttaagttatttaatttgttggcatacagtttttcatagtattactttataatcattttaattttgatagcttctagtgctgtttcagaatgttttgggtttttttttttcccacatgtatttggtttttcatcttctatgaagagtcacagttttggttggccgacccttccttatcttctatcactttcatgtctttatttttattattattatttttttaagtagggtcttgttctgtcacccaggctggagtgcagtggcactatcatagctcactgtaacccttgaactcctgggcccaagcaattttcgcatctcatcctcctgattagctgagactacaggcacacaacactatgctcggctaattttttatttttttaatagggctgggactacaggtgtgagccactgtacccagcctcttcttttaaaaataattttgctctacttacatggaattggcagcgggaggataggtagatagttgcaggtttgcagtctacttgtcatctagacttaattctcacatctttgattcttggaaattaacatctgttgtctaatttcttcctgtggttttgtttcaaccagtttgattacaaaataatcaagtctttctttttaaactgttttgagttttacacaaaacaagtgtttaaatatttgtaatactgatttgcatttgcttggttttgtttcagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggtgatgtcagtg

SEQ ID NO: 64862 - DNA, 1719 bp, Homo sapiens
ctgaaataatcattctccatggataggattaagaaaaaaataaaataccagtacttgtagttgaacttaaatatgatgtgataagtataagctaatttggcgattttctttttttagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtct

SEQ ID NO: 64863 - DNA, 1054 bp, Homo sapiens
agatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaac

SEQ ID NO: 64864 - DNA, 1052 bp, Homo sapiens
acctgcttaaaataaaaacatggtaccctgttttctctaatagctgaaataccaattctggagctttgggcatttgtgaacaggttcttagatggtgtaaggaagtatgtattcagaaattaagtagataactctctaagggaagagttgaagtgctggttatcaggaatcaaaggaacactgtcctcggcacactagctgcagtggacggagaggggcccgctgttgttctcactcgttttgcttgctaccgctggaatcccgacctggtaacatttgttagcctttctttcaccctttagttgccttgtcatagttccagtgagcaaggtagtgggagcacacggttattggttctttgccattctctttctgtgtgctctggcaggcagctttgtacttttgtttctccaccgattagtaactctcacttaccttaaaggggctgtaatgaccagggacctgatttatgtacaagaaatgagatctatatgccagtcttcagccagtatgtcaaaaacacttgtcttttaatacgacaaacaagaaagtagtctgttatcctgttatccctttatactgtaacctaattctttgagtttgcctggtatcacttttccagggagctcaaagtacttcccatatgctgtctcattaatgtatgtgaattaaagcagagaccaatgtctgcttttgctgataattctcgtagatattgtaaatttttcttgttggtagacttcttttacctacctgcagccttcttttcagaggcaatcgcagtcttcagcatgacgcctctaatgccaactagcaggaaaataaactttggactaccagaaccaatatccagtaaaagtgttgtaatcttgggatcatagtatagaaaatttttccactcagtcacaactgtcaagttttaacaccataaacacaattctctttacatttatctattaatattttcatgaggttttggttactatccaacaaatgtcctttttctttgttgtcttgacaattctttgtgtgagtaatattttaaaacctct

SEQ ID NO: 64865 - DNA, 1003 bp, Homo sapiens
tttggcacatttacttgtcaagtccagggtacattgtgtatgaaagcatctgtatgaacatgagctagtttgtgggtggtggtgcttgaagggaaatatcccaggatgcaatggttgggaattaatggtcagtgagaacagaggggacctgtgagggctgcattgtatcatgcctggaggactctggaaacctgtggttcacaggtgtctactctcctgctctaactagttctttaatcttttatgcagtgttatacaacctgcagaacctcctgatttcccacaagttaatatggggaaatttattctttacctcttaattcttctgtgaagattagccttttctactcattgaggccaaatatcccctctcaccgccctcttcagctgtcttactgatctgtaattaataagtgactcagccttgtcatttaggatttgtgtgctaacctacttatagctcaagtgttatgacttatgtgtttcatctttatattatcactagtccaaaagtctgtctcattggttcttaaaaggcagtctgattgaagtttgaatcttgcatgtcttccttttcctgtcttaccctgtgtactgtggtagtatttattacagaatttatgatatcctgccttattttatgagtagtgactactgtttttaaatagcttggttaagggttcttagagtttgttttatctcttggctctcttaaagctgtttcacttaatccaagtttccagtgaaaggttaatgcttaaacaacttatctgatggctgacttttcatatatttatgtttaagtactaggaaacactagtatatatttatcagctgtgtaactgtgggcacatttaactcacagagcctcaatttcctcaaaataggattattaataatcattttgcagagaagcttatcagaattaaatgcgagaagacagagcctgtcatagtgtaaatactcaaatgttagctattaataataaagatttgaaaaatta

SEQ ID NO: 64866 - DNA, 1092 bp, Homo sapiens
gacatcccatttaaagtcgcattctttatcttatccagctttatttttcttctcagcattgatctaacacgtatggattgtctttatcttcctacaaagtcttaagttcctgagaacaggaatcttattttgcttactgttgcatcttagcatatagaacagtgtttggcatataagtaccaaatttttaaatgaatcgctattaaaacagtatttcagtaagctaccctcataattgctccttatcaataactttggaaattaccacatttttgcctaaggattgcttagaccttattacaaatgaacaaggtactaaatcccagtttctctatgatttttctccttctaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggttggtatataatgttagattatcacgggaatattggcaggattttgtctacctttttatgagatgcctactggctttatattacatttttagcagtaaatgtggctaaaatatgggtctgtgggtaaatttgataaagtgcgatgaaattttgttagctttattgggtgtctcctagtcatattttatatttagcagaagcagtcaacacactttgattttcctgcttcaggttatagttgcagtgtaaaaagtgttctcataccacttggtatgagaacatagcgaaggcaggcagagagaaacccagattgcggtgggagagaagaaggaattatttaaagggaaa

SEQ ID NO: 64867 - DNA, 1050 bp, Homo sapiens
ctcttagaatttggatttgttgtgtttttgctctgaaatgcataactctgtagaaaactcttagctctcaaatactaaaatatttctgtgggcttagtaaatgttcatttctgaaataaattcattttaggtatgcagatgcattatttaagtcatccgatatcagatcagccagtttagaggacctgtgggaaaatctgagtttaaagcctgccaactcccctcatgtaaatatctctgcaaccttgtctccacaaggtaagctaaggatgaagcaaagtaagaagtagaagacaaacttcaaagttatttaaaattttttaatcttaatctttattagattttaaatattcaaagtacagagaaagagtgcactatgtattaaagctgtttatgttcaattttaacagaagtctattatctttaacaaatagatcagtgttagaactcttgaacactgacttttgtccgatcagctggcaaaggttcagatctgagatgttttgcatgcagatttgtattgaaaatatgctctccgatgtttcttttcctaagattttattaggtcaagtaaaatttgaaaattacattaaaacattaacagaattcttcggttcttccttgtctgtagcaatggaatatagtttaatgactttaatttccaccctttcccccattccagttgtggaaaccctgagtggaataatctgcaaccaatagtttcaaacaagtttttagcttgaatgaatcattctttcttccagagtccttattaacatgttacatgacttgatctcttatctctgacagattgctttttacagtacaaagaatgaaaagaattcctgttgtccaaagcctattctcctacactctaaacaaatcttggattgttttactttgttataagaaagcacttcgtaaggttgactttttctttctttttggccacaaatttactagcttagacctgcttagaaaaatattatggtgagcatatagtaactattaattgttacttttcaccttgtcatttttcctgtgtagtta

SEQ ID NO: 64868 - DNA, 1050 bp, Homo sapiens
gaactcagatctgagatctagtcctgcctgaggcctgagcaagtaacttggagtttctgggtctccatcgtaaatgtgaagagcaagagtagagtttgaatttgtacgctcttttcacctctgtgttgtggtggagagtttgttttcgtgaaaaaggaaaaagtaaagggaaaacattaagctgaatttgtaaatgtgatacgtgatctagctatatattaaaaagaactacacatatcttttaagctcatgtagaaatttatcctgatggcttgaaatagctactgaattaggtaccatgtgtatatttgttattctttgccttttaaataatcttcccttgccttttaaataatcttcccctctcccctatagggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttaggtaagtaagatctaactggatactagcatttatcttttggaggaaacaagaaaaagttagttctcaaactgaaccagaatagtactactacaagctgggagtggatctggattaattcatggaaagtatgtttgttcaaaaacttctaggggtcatttggaaagaggctttaacaagctctaaagttatgcagaaacttctggttacccaggagtataatgctgctctcattcaccggaagcttaagcataaagcagcaattctctttttttagaagagttatcagcaccaccattactcccctttcaatctcttcaaaatggcagactctctgctttgtctctctaccaatgagccacataatttgttggaaacaaattggaggtttcagaaaatttctcttatttttctcaaggagagttggatacatgagtattgtacacatggtatactcccaaatgta

SEQ ID NO: 64869 - DNA, 1056 bp, Homo sapiens
gatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagtgcgaggatcctcctcccctcggctctctttttagacacagtgggggttgaatggatgcgcgcgatataagcaaattaaatggttcgtggccgcatcctagagccctttaattagagttaccatttgtagaaggcctgccgtgcacaatccctcgtttcatctccccccaaaccgagcaggtaggtagctgtgttttacagaggaggacactgaagttacacagctagtaaagagccagaattggggcccaggtatgtctgaaaccaacgcccagcctcccagatacagtgacatcacagagatgacgtagggattcatctctatcaacagatacttgtgggtgtctatttgggggatatacagatggagcataagtggggaatatgactggtcctggctcttaagaagttcgaaatctaggtggggaattttaaaataaaaactagcacttttaccatctggccccaacgcatctttccatcatctctagccacttccttttctcattttcttgtgccttggcttctgccctctgagtgaaatgccctccttttcacctcctctccccctcctctccccctccagacatgttttaactaggtgaaatcctactccttttaaagatcagttcaaatgtcatcttttctgggaaggttttctcaatctcctcccaggcagagttagtttcttcctctgctatattccctgggcaatttcataatgccactta

SEQ ID NO: 64870 - DNA, 1041 bp, Homo sapiens
atcaaccctttagcccagtgtattcacttgtaagcccaattaaaagcattatttccaaggagtttacctatctgctcttaggaatgaaagtaaagaatttaagattgaatcactgattaaaattgtagcagcaggtagtttagagtgtgtcttctaatagtttaaggccctgtattcttgaaacatgctacttaggagtaggacaaaaatattccaactaactactacgtgagatccagaaatctgataaattacaaatgtcattttacaagtatctgtttagtcattgaagtagaatatagctggataagatcttagcaagctcatttattctacaaacgagaaaactgaaacccaaagaggttaaatgatttgccctgagtcacattgctagttggtgacagagctagaatacttttagttctttttttttgtttttttctttcctaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactgtaagcaaatttgactttggttagatgcaatattgtcattgttttcaggtgacggttttatgaggcctccttgtgcatgtggccgtgagctaggttctaataatataacattgccaatgtagcatttaggaataatagcagttcctcagctggcagcctagctacttgtggattttcaattgcatgggaaattaacaatttagaataatgtccagaacgttcctgtctttctccagcctcagtgacactccagtctctgaagtgctctgagaaataggagggtggagtataaattgcagcttgtattgaaagagtgtttgaaaagtctgaggctaattccagccaggactgtgcttgtgcaggttaaaaaaaaatgtgagtaagttcaccacaccctaattctc

SEQ ID NO: 64871 - DNA, 1974 bp, Homo sapiens
actcagcctttgggacagagaaagctttaggtggagggactgtttttgcagcgcctttagcagtagcatcaaagaagaaatgtatgcatggaaattgtcatcagctatggttggctcacaggctcacattaataaacatgcttttcttttttcaccattaacagttttttcttctatccatttaattgctacctagggcttaaatggaagcttaagtagctattgtaaatgatttgtaaacatgtttttctgtaggtttgttgaataagaagtaaaatatgtgcaatattacgtagcaattgagaagcccttatttggatagttataaattacatataattagaaatgatgtctaaagaattttgattaaacgtagctgtgttctcttgtagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcaggtatggaaatatgttaatcatactccgtgcaactacaattcagaggcattttcttttttttcttttcttttttttttgagacagagtctcactctgttgcaaaggctggagtgcaatggcgtgatcttggttcactgcaacctccacctcctggattcaagcaattgtcgtgcctcagcctcctgagtagctgggattataggcacgcaccaccgtgcccagctaatttttgtatttttagtaaagatggtgtttcactacgttggccaggctggtctcgaactcctgacctcacgtgattggctgccttggcctcccaaagtgctgggattacaggcgtgagccactgtgcccagaccagaactattttcaatttaaacttcctgaagtcttggtactcatggatttaaaaaaaaaaaaaaaatttgtaaaatgcagaaaagtaaaaagaagacatttactcataattttacctctcagaggcataatcactcttatcattttgatacatagatatattttttatacattaatttccttcaacattttcttttgaaaaattccaaacctacagaaaagttacaaaaacagtacaatcaacactcacaagcccttcatgtggatccatcagtttttatcatgttgtcacatttgctatgctgcccaggctggtctggaactcctgggctcaagcagtcctcccgccttggcctcccaaagtgttgggattacaggtgtgagccacgcgtctggtcctcttttcctttaatgctatgtttactttacaaatgcttgcttctaaatccttttttctttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaagtatgttgaatattttgtggtactttttttgttgtctgtggtttttcattttagctgccatagcttgttgcataatattattttcagaacaaaactaaaatttagtaggagaatagtctaatttgaagaaggaaaagcacaaaatgttgggactacatctagagttgttaagcattgaaaagaaaacttaattcacaagcaaaaggaatgtgagtaggctatgagaatagaaattaaaaacaatgaattcctaaattataaatggttttttgatgaaaacaccagtttgaagtaaaatacattcttggtcttgatttttgaaaacatgacagacatcctgtgaatgttaattcacttttcttctccctgtgtggcacagcaggaaatttaactttgcttttgttc

SEQ ID NO: 64872 - DNA, 2050 bp, Homo sapiens
gcttgctttccgggaggctttagattgttctctgtcacttctactctctgtgcttcctgtttctttctcttcctctttatttactcgccagttcttacaagcttcctttgtgctgggtgctgagcggataccaagatgaataagtgtaggctctgcctgcaaggcagtcctcccttccattgctctgggatttttgttgttgttgttttaagatggagtctcactatgttgtccaagctgcagtgtagtggctattcacaggcataatcgtagtgcactgcagcctcgaaattccggcctcagtgatcttcctgcctgagcctcccagtagctgggactgcaggcacccaccatcgcacctggccttccattgctctgtacagggtgactggctgtcctagtttgctagggactgagtgagggttcacaggacttgggaatttccatttgaaaactgggacagtcccagacaaactgggaggagttggtgaccctaggtctgtgcctcattatacttttcttcctaacaataagtataacttttatttatcgagtgctggctctgccagccactttatatgtagcatctttcttcagctttaaaacagccctgtgatgtgggagtccccattctgcagaggcccgacaaagttggggatgcatgcatgaggtcatgctatttttttttttgagaaggagtttcactcttgttgcccaggctgaagtaccaaggtgcaatctcagctcactgcaacctctgcttcctgggttcaagagattctcctgcctcatcctcccgagtagctggtattataggcatgcaccaccacacccggctagttttgtatttttagtagagatggggttttaccatgttggtcaggctggtcttgaactcctgacctcaggtgatctgcccacctcggcctcccaaagcgctgggattacaggcgtgagccaccgcggccagccggggaggtcatggtattaagcacggagcctggctttacacccaggcctgtctgtgttcttagtgagggcgctatactgcatccttgctcaggaggaacggctctgagatagaggggttatttcacaccagactccctcaaagctctgacacactagcgcaaaccctgagggaagctgcagaggcaggtgtgggggctgtggcgctcccgccctctgctggccaacctggacctgcagctcagcgatggcctcttctattcattacagacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccgtaagtggaactttgatgcgtggatgggacgcagtggatgtcagagagccgactggagtctcccagaggggtctcccactgtaaggcagagcccagggccactctctaggaactgagaagaaaccttgctgtctcagttggttcacttggcgaagaccccagcagagtttatttagggtcatagggtcaaagttagaatctgctgcagggttagcagagctctaggatagtggcttcaaaatgtgtgtgactagccgagtagcctgtcgggccttagaggccacaccaaggagttgggttattgtcctaagagcagtagggagccattgaaggatttgaagcaagagggggaacgtaattagatttatgcccttaagtttaaattttggcatggggcacatagtagatgtgagggagcatttaggaggcgagagaagaagtggctcgggctggggggtaagccatgagcagggtggggagcgctggtaccaatggttgcttgccttgaggaattggagatcccgggcttagaggtcccgcggccctccattccctgttagcatgctcctcccggggcctggctcggtgttgagtgccatcaactcatttgttctccctacgcagggagc

SEQ ID NO: 64873 - DNA, 1116 bp, Homo sapiens
attcctgccacttaaaatgaagccacattattcaggagaaattagaaatctgtctaggttccttttccaacttctccacctagagtttatcctctctaaggtaagtctcatgttgaccacaaagaagcagcagctatactaaataagtaaaaactcaaaaatgggcttaaatactgaagtgataggtttataatttactttgaaatacttaagcaaaaataagatgaagcaaatatggcaaaatattagcaatataggtagtggtatataggtattcattatactattctatttttctatagtctaaaaatctttataataaaaagtcactttttataagttaagggaaaaagagagagcttaaggcgtttttgtaaatgaactccctgccctaaacccagaataattaaagtattgattgtatttcttttcttgcagagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggtatgtacttaggatcaagatgtggagtgtcctcacttttccagtgttttagaagagttcattgataacctgcactctaaattctgaaatgtgaatctagttttagaatagatttgcaggaagcaagaaaaaagttcaaagattttccttgggtttaggaaatcctgagtgtcaaagtagctgaacaaaatgagaattgaaatgggatttaatagtttcattctgtccctgaaattgtcagtgccttatatcttatatctggtgggcaagatggagggagtgtggagggaagaaaaacaaaagaaaatctgaatgtcatcttaggtattacttttttttcctaatagttcttatcaaattgataaatatgttttgacagatcttaaaccaaatgtagttcctgttgcatattttgtaagatataatgaagaaatattacagcttgttaaatccataaagttccttgagggatttgtattctt

SEQ ID NO: 64874 - DNA, 1242 bp, Homo sapiens
caggtaaagaaagataaatgcattattccaggcagagagcacaacacataggcaggcagtgtgaaagttctgtggaatggtaaaaagtgtgtctggagcaaagcttgggataaaacagaaaaagataaaatgtaagatttgtttaacattttttaaagtataatatgttaaattgaagagagaagccaaaaaaatagcgccatcttctttggtctaatatatttaatttcttggttttattttgcttatggacatgtaataaactgaataactactctcaggcaataaaaaacaactcctctgctgggttaatttttcttttgaacagctttattgaagtataatttgtatactataagtccatccattaggtgtacagttcagtggttgttagtagtagattcaatggttgttgttactgttagattcttaagttttaaaagataacttagagtttagcaagaagtgtcattttcccacttccagatatagaggacctcctgagactcttaaaatttaatacacctctgtcaacaattcttaattcatttacatttccatagttacctgccaacctagatattgtacctctgcaagagttaaagtagctaaatatagcatagtcctggtgcctcaaaataagaaactcaattatttctaagtttgagtttgccatccttccatgttcaatgtatttaaaaaatagcagtagtctgactaatgtcagcagatatgtacttgtcattatttttaaaaggcaaatgggatacctggttcagacggcactgttataaatggttttgcattagaactgcagtatagtagaggagggctgaactagaagggaaaaaaacatggcttgcagttactgctctgctactcaatcaccaagagccagatcaaatctcttaatctttctgaagctcaagtttcctcatctataaaaatcaagtgtgataatagttaaacctttctgcataggatttttgtaaggatgaagtgagataatgcatatgaaaatattgttgcatcgtaaaagtgaattaaaaaaattaaaatctttttcaatatcctagaggacaataatacccgagttttgtttgaacgagttttaacatctggaagccttcctcctgagaagtctgggtaagccattgtgaaaagttgttgatcaggttctaaagacagctttcttacctgaattgtggtctatggggtgaatgtttgcttgagtatgagttt

SEQ ID NO: 64875 - DNA, 1052 bp, Homo sapiens
aattttttgtatttcagtagagacagggtttcaccatgttagccaggatggtctcgatctcctgaccttatgatccgcctgccttggcctcccagagtgctgggattacagatgtgagccaccgcacctggccacaagatttttaaaaataagccagatgtggtggcacacgcctggtctcagctacttgggaggctgaggcaggaaaaccacttgagcccaggaggtcgaggctgcagtgaaccatatttgtgccactgcactccagcctacgtgacagagaccctgcttccaaaaataaaaaaaattaataagtgatggatagatggagggaacttggatggatgatggtgccagaaatcactaaagctttttatttctaattatcattaatttttgaggagcctaatttggttatgatatttacattgatagttttacaaataataattattttaattgaatattgtttgttaatttcttcccttagttatgtttgcttatgaacagtgcctgcttgtgctgggccatcaccctgatatttggtatgaagctgcccagtatcttgagcagtcaagtaaactgctcgcagaaaagggagtaagtgttccttccctatccccactttgatatttttgtggttttgatatagcaattatttactgaaaaatataactgaattttggtaataaagcataagtattgaaaatttaagtttacgttcatatgaatcttagtgacactcatataattagacctccttagaattaaaataaactggcagttttttaacgtatcaaagtaatgaatcatttagagtacttgcatggttattttgtaagttaaaataatgaaaggagtttttggaatttttttagaatccagaaatgcatatgtgtttatgtatgtgtgtgtgtggatacatatatatgtgtgtacatacatgtatgctttcttagacacataaataaaataaagtagatgtaactttattaattttattctctcacaactatattaaaattattgaagatgagctttcttttttttct

SEQ ID NO: 64876 - DNA, 1050 bp, Homo sapiens
gggattacaggcgcacaccaccacacccagctaatttttttgtatttttagtagaaacggggtttcaccatgttggccaggctggtcatgaactcctgacctcaagtgatccacccaactcggcctcccaaagtgctaagattacaggcatgagccatgtcatttttttttcagtagaatcttatatgaaattattgagccttttcaaatgattctatctttaaaagttcctgataaatggaaacttactgccagctcataagacataagcacatcctccttgatcttggaaatgtataatgtgattgaaccttttttccctgcttttcatgagctgtatgaacctttattaaacaagaaatcttttaaaataaaaatttaaagttatttagtaaatgaataaattaactgtattgtactaatttttaagaaactatacttaattttaaaatatttttgtttttttctagggtatcaatattcatttagctaaaaaaatgattgaagatcggagtagagattatatgaatgctagacgtgtagcaaaggtatggaattccatcaggctattttaatgattattatgagtctgttgtttacagcagagctttccctgtctggtattactcttgatattttcagtcattagcaatcttaacagcaattaattgcaaagtctgaggagatgacatatttgaaatgaaatctctctttgtaagaacaaaatataataaattgggtttagaagaaattgttttttaaaatatggaaacagaagacatagagagagacaaggctctacttagaattgatgaagtaattcttttccctctattatttgggttcatctgaatattgtattactctgtggtctaataacatagctctcagggacacattttgattgtgtgcatacctttccattcattgacactcttggaagttaggaaaaatagcctattaatacaaactattgaaattttaaaagacagtttctccaaagatggcaataataatgccaccagatcttcaatcctattgatctgtcaa

SEQ ID NO: 64877 - DNA, 1061 bp, Homo sapiens
taatattttaagtttgcctggaaggacttttattaagatgatagttcataaaagctgcaaattaaggtagaaaagactataagttgatgtgcaataaactaatattagacgtttgagggaagcaaatcagcaatctacttgattaccattctggctgtgcagtatggaattaatgtcattttttgttttttttttttagatcagaggtttatgaacttgatttcttgactttcctgatagctggagcgtctcaaatgattgtacacatttcttagtctcaattttaattaacctttagaaagatctatgccactcagcaattttgaggagagacaggggagatgacctaatgggaggtagagtagcaaaaccaattgagccatgaatgttaactagtgattttgatacttctggctaaattactcacttttctcaaaaagcaaataccctgctgtatttttcttaccccaaaattacagattattctttgaaaggtaatgtttggcatgctgttgacaagttatttacagagtttagatgtttattaagtaaagtaggctgagtctataaatgttaagtgatggttgttgatagatgccctatatattgggacaaaatcaaatctgagccaaggttttacctttgagattcttgactgaaattagtattgtctaatttatctagcatttatttaactttttaaatcctcataggcctggctaagaatttgagaggatttaaaagtagattttaaagtggggatgtttatgttcagagaaaaataccaatgaattactccgaagagaaacttaccgttcaaaatcagctgtaattttctttctcttattaaaaaaaaaaaaaaatccctaatctgtcatgagattagagataaaaaagaaaatgttgagttattttttaaaaatcccaactctctcctttgtgaaattgatatgaaaataaaatgtaactgagacagaaaaattgtctcaatccttccagtgaaaatagttttggtcaacagttattgtgtgcatttcttcctactcagtatatattttttg

SEQ ID NO: 64878 - DNA, 1129 bp, Homo sapiens
tagagcttcaattattcctccattttagtctgaatttactgatagtattatacttagcaccctttctaaacctttttattgaagtgaggttttaaattaatattttaacaaggattataggactcataaagacctttctgtaaaagttatacatttacatttttcatttcccttgatatttaagacagtataatctaaaacctatttttgaatgaatatgtgaatagtaactggtagttttatccacatttatttagcaattattattgaatgtctgctatatgttaggctttgttctaggtgctgtgaaataaaaaacgttatgcctttgtggaattttttaaattatgttgactcgcttgttttctgagtaagcagaataatacctagatggactactgagaaaatacacttaacctaaatacatgcacaaataatatttttggaattaagtggttgaattttaaaaggcaagcataatgaagtaatatcaagtgattgaaacctgagagatgggagggaaagtggagtttgtcaagattgttacaaaaaggaaaacatttttcttatttaaaagggtaatatatgtgtttattataagaaaaaaactctaatggagaaaaaaaccatattcccactacctttgaactataacttaatcacagttaacttttccagatctgtctataaaaccttaactttttgtagcttgttttttccacatggtagcatatttttgtgttatttagtctataaaatcgcttttaatggtggcacagtagtacatcctagatacatgctgtttagccagtcctaattatcatttacagtgtttccagtttttgttttataagaatctcttgcatgaatacaattttatttcaatatttttacatagtcataattgtttctttagattgaccttttagaattcatattttactatcaaaggttgctgttgctggtgtgatcttttgaattgagctgggtaatgattttttaatctttcagaatttaagtaaatatgaccaatgtgtactttgttcaagaatagagaaacagggttgaataaatatacaattttggggaaaacgatgattatttgataagcattttctaaaaaggaact

SEQ ID NO: 64879 - DNA, 4330 bp, Homo sapiens
tttataagaggatatttttatgctttgtaatgtgacattgcatctgaggactttattgttcatgaattaagttaggcatgagatttttaaaacagtaactttagttcactgttgttttttttccccaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaatgatactttgatatttttttcttgctttttatatcttgaaatttgaacccaggcatgtatattttaaagagtaaggaccccattcatgattatggttaggaggaaaatgttaatttttgaagactggaattagtaaaaatgataataaaagttttaatgtgtcaataacaattggcaccaagtagtcattttcaggttattaatataaattaatgatatggaaggggtaagatgtaaataactgatatccacattaagctgaaaattatacgcatttctttttgtaacttatgcagtactcttatttttaatattaattttgtgatatagattttcagcataatcaagtacactgcagcctcaacataacattttctgctgtacctgaaatttgataatatttaggtctgttttggacctattcaaagggctttggtcatcagcagtactgaatatacttcagcacaacacagtgtcatctgtgatatgtcctcagaatggacccaaccaatagcagatttaaatagaggctacagtgtactcattgtatttgtgctatagtttagattgtattacttggtggggagggaaattactggataatagcaggaacattgtgtgtgttttatttttgtgtgtgtggttgtgtatgtggtatgtatgtttgtgtgtttgtatgtatgagagagattgtgccttatgtggagtctggtagttttggcccatgaccataccttaaagtttcatcacctatcctctgggaccatttctttccttaatatatttaaatcaccaaagtagcttggcacaaaacaggtgaggcctgtctgaaatatgctgaagcccgtgctgctttgtattaactcattaaaacaaggaacctggatcacctgcacctgatctgcattctagtctggctttagaaacacattagacttaaattcaaacgcaccagaaatgaaaataattgatatataattgtttttgtatagtgaagtagaactttctgagtttttgaaatttccttgtttctcaattattcaggcattattcatgcattttattatagcgtaagttaaactgaaataggcagttagatactccattctgtaactctgaacacaatgggtttgtttctccaatttcctagctgtaagttacaaactgcatcctaaaaaaaagtttcaggaagaccagatgttattccaaggggctgaaagttgtctacataacaggctcaattcatataatgaaatgaagagctgctagcagttgcctgatttatttagttggtaatatttgcagttacttcacacacacaaacatacacacgcgcacaaataggtatatataacatgtattaagaacaaatggtaaataatatatatgtatattttttaaaatttatatttttggtttaggaattaaggttttaaattgaatgctggttttagaaatgcatatcctgagctgtgtttttctctttcctggtttgctgtttattttttattttcacattctatatttttgtttagcctgtgagaggctaaagttttctttgatcatatcactcaatgtggccattaatatttctggagaagacacaaacctatttataatactttttaaaaatccgaagtgataataagaatgtttttacattgaaagtaatacttaagtgtttacataacattctgtatgcactcaagaaaataaagttttgttaatacatttgttgtaactcagtacttcatggtgggaaaattgtaatgttcatttctttatattctgctaagccaacttgtgtgactccaaatacctttttttaatagaaaatacatacatctttagtaacggaagataatttgcttccccagagaaactccttgcaaatcctatttaagtacaaaatgtcaaaggaaaaaagtattaaactttttaaaaaaatttgaaacatcagttggaaatgagagcatattaattacttttaaaaaaggttaatgatgctgctatatgagccagtgcatcagatttgctcataactgagagttgagcagtatctatttagctatgtaaaatttggatttaaaatgtcattctgaatttgtcacatgctttcatttttttgctgtagtgtggaaattgttggaggtaaaattatcttgctctagtgaatggcatttaggacaaacttctgtgtattcttaatatataatttcaaaaactaggccaaattactttggtgttatatataatacataggagataacattttgcctccactccctgaaatacattgttctactctttattccaaaactgctaggtcacatgatttaacagtattattataagatgagcaagtcattaattgtatgactattcttaaagtgatagttatcaagtataaagtttaaatatcactatgatatgaaagtacttttgtgacttcttagtttcaaataaaggaaacatttaaatatgtctccagctatttaatcggataaggatatcttaaatgcagtttagtatatttttggatttaataaatgagaggttttaaacacttgagttaagtggaatgccccagtcagagcctcagtgctctttaaagaactactttttacaatgatcaaaaaggtcactaaataatcacaaaattgagaaaacctacagaattttgacatattcttttaaattgttctgccccacccagcctgtggtttctgtagcttttcatgtaattaggtgatgagtgacaacatgtaagctacaatatcttattgttagagaagtaatttgttttgaatcgggccacattcataaggaatttttttactgaagcatgttttttattggtggctgaaggagaaatgaagaaggtaatgctgctggtaatagcaacgatgtatcttgctgtctgtgaaagctgtatttctttaataaaagcatatagagaattgattgttttatttaaaatttttacaaaagatgaattcttttctctatacttggtttttccttccttataaataatgggttgtgtagcatacatttcagtttttcaaaatgacctttcttcttggaaaatggaagtgaactcaggatgcaacatgagtgtcctaaattgaaataaacttttccactgttgatactgttttaatacctttacatagcaatttaaattactgtattataatgttttctttctgttgagcaatgtgattttaaaatgcagatacaattactgcattatatagattatggtgatttctatacttcagcttgcagcc

SEQ ID NO: 64880 - DNA, 1354 bp, Homo sapiens
aatatttgcatttcttttgagtctttaaaaagttaattataaactgttcatatgctttgcccttttttttatttttaaatttttattaaaaaatgtttttttgacacagagtcttgccctgtcacccagtttggagtgcagtggtgcgatcatggctcaacctcctgggctcaggtgatcctgccacctcagcttcccaagtaggtgggaccataggtgcatgccaccatgccccactaattctttgtattttttgtagagacggggtttcgccatattgctgaggttagtctcagactcctgggctcaagcaatcctcctgcccacccaccaaccccaaagtgctgagattgcaggttgagcctctgcatccggctgcattttctttttgaaccactggtggtttattgattgtactttaataaatttagtatttttgtcatgtgttggaggttttttttacgtttgtctttttttattttggtacttttctcatgcgcaaattttaacttaccatgtaagtttactctttaaaggcttttttttttttaaagacagggtctggctctgtcacccaggcccgagtgcagtggcggcaatctcagttccctgcaacttctccctcccgggctcaagcgatcccaccgcagcttcccaagtacgtgagactacaggtgtgtggcacacacctggctaatttttgtatttgggtagagacgggattctgccgtgttgcccaggctggtccagaagaacgcctgagctcaaggaatcctcccgtctcggcctcccaaaaggcttctgaagagcttttccaatgcagaaatacatttaaccgtattctgctctagttctgtcttgtgttttgtttttaacatttaaatctttgatctctcttaagtttatttgggcagaaagagtaaagtaggaattcaactttattttgataaaattgacttcacagttattctaacagatgattatatagttattctgaaaccatttattgaaaaattcaccattctgatttgaacatgccacctttattatttgctgattttccatttgctgttctttctgagcctgtagtttcatatatgggaagagccaatagtcccttataaactttacagctttagttccttgagcaagctattcataaagttcttatatgttaggaaagcatcctaattttaattttgaattacagtagtcaacatgtctttttttctaaataagtaaatgcttaccagtggtgcaagctaatttattccaaagaaaagagtttatttctcctaggtaattaaaaaaatctgaacagatactttttttaaacttttccaaactggtgttt

SEQ ID NO: 64881 - DNA, 1050 bp, Homo sapiens
ggaatcagttaggttactcctctatgaaagtctcagcacggcaccgtggctcacgcctgtctgtaatcccagcacttcgggaggctgaggctggcggatcacttggtcaggagtttgagaccagcctggctagtatggtgaaactccgtctctactaaaaatacaaaaattagctgagtgtggtggtgcatacctgtaatcccagctacttgggaggctgaggcaggataatcacttgaacccgggagtcggaggttgcagtgagccaaggtacagccactgcactccagcctaggtgacagagtgagacttcatctcaaaaaaaaaaaaaaaaaaaaaaagaaagtcttacggagtgctactccggtctacttttaattttgaaaaaaagttaaccacagagagagacttaagacttcaaatatatagtatattcagttttcttaatattttagcaaaaaattcacttggaatgacaggtttgttgccaccttatttttaatgaaacgtgacatttggaaaacatttgtggaacagatagatgaggtggtacatatttcttaaagtggagcccatggcccatttatgtcataattaggtgcgttataaaagtatagatacgtagactctgatttcaaacctaactgttcagtggggctgagaatcttcgtttgaaacaggtaccacagtggtttttatgtcaataaaagcttgcagaccacagagttagatgatagctggttgttttaaaatatattcttgataaataagtggatgaaaaaatggcagatatttgaggatggtattttactgatttttcctgcccacctgctccccacccccatatatttagttattaccctgaatagcgagaaatactcattataaaaccagggttgaggctcaactctgctttttctgttggtcatagtaaaaagcttacatcgtcttaaatctttcagtctaccatctttctccccctctattcatacttttgtgttatcactttaactgatccctactttaacttaatttcagtatggctcctaa

SEQ ID NO: 64882 - DNA, 1721 bp, Homo sapiens
aaaaaaattatttatttactatttaggtagagacgaggtctcactgtgtttcccaggctggtcttgaactcctggacttaagtgatcctcctgcctcagccttccaaactgttggattacaggtgtgagtccagccatatttcaccttttaaataatgtataacttatcctagaatttggaaggcctaaaatacaagccaaatgatcctcagcttggaaaagctacatgattctaagaagcgcaaattaattgctggtagttcttaacaaaggagcatttaggctcataaatacgtgtttttagtgaaaaataattttgggaagatttagaaaataatgaagagtatgtgtcctattatatacttattattaataaggaaagaaaaagttgaaacacccacagcattgaaacctgaaacctggtttatttcgttaggtaaacattagtacttaagctgtttagaagtaacagtatcgccaattttagtcaaggtgcatatatgtgtaggggttagaagaggcagagaaagagccaactatgtgtgttggacaatgtgtttttttggatttattttttccaaaatctttctgtaacagcccttcctagttttctgcctcctatttttagtgatgcttgtttggtgtaacagttttgggcaggcaaattgatttgatctttattgttgatatttcttaggaaactggagcattatcaaatattctgtttggggacagttgttcctaagagaagttgctctgtgcttaaagaatgagaattgggtttttcttagagatacagcagaaaggtactgtgttaggtgatactgcattccttcaacattatttcagggaatgtaggcatttacatcccagatagaccttcagaagggcaaaatctgtatttgggtgtttttacctattggacaattacccataccaattcatgattttaagcttttttttttaaatcttcgatttggtgacggtgattttaagcttttctaccatgtctctgaatctttctctttagataggacctacctgtgaatttgagtctttttgttttgttttgttggacagttggtaatggtgtgagaattgggctaaaaaagggatttgagttggcagttgtttaaactatctttagattaatggacaacttaggatacatagtaaatattgaataaaatcagaagggcaaagcttctgtgtgtcctaattaatgtttttctaatgtttgacttagtttatttagtgtattaaatctggattattcatatttgaaagaagtctcatcttttaagttccaaacggttaagattttaatttatattttgtagctatttgtttcctaggggatgaatatgcaagtttactaagcagataatggtaaatataattatttgaactaatatgttaagccaagatcttttttttttttttaatttttttatttttattttttcgagacagagtcttgcactttcgcccaggctggagcacagtggcgcaatcacggctcgctgcaagctccgcttcctgggttcacgctattctcctacctcagcctccctagtagcggggactataggtgcccgccaccacgccctcacgcccagctaattttttatatttttaatagagatggggtttcactgtgttagccaggatggtcttgatctcctgacctcatgatccgcccgccttggccttccaaagcg

SEQ ID NO: 64883 - DNA, 1944 bp, Homo sapiens
attttttttgtagagacaggaattcaccatgttgcccagcctggtctggaactcctgggctcaagcgattcacccacctcagtgtccccaagtgttgggattacagacaggcacgagccaccacgcctggtccacgcatgtttatttgaaagtattttgacacattgcagccccaagtatttcagcattctcttataaataagagcaaaatgttgttacataaccaccataccatttccccacccaagaaaatagtatttctaaaatctagttctttaaatttccccatttgtcccaagaatgtgattttttttttaaccagaatcaatctagatttacatattgaatcatttacttctgtctcttaagtagtctcaccattcttctcccctggggctgttgtctattcgaagtgtcaaggacacttaacactgcttttctgggtgtatttgttttttgttgtttgtttgcttgcttgcttttggtttgggggttgatgatgtcatttaacttgtcccttcatctgtatttcctgaaaactttacagttaggtctatactcagccttgatatttgggttaagtatttttggatagaatacttaacattatatcattacattagcaggtacttctgctgggttctgttaggatggttaagtttgatcacttggtttagggtgatctcattgttaagggtcatgttcccctttgcagttaataatctgtgagttgataaccgttttctttaaaatcaccttatacctagttatcaattgataaatcttgactaaatcagctcttacattggaagtagcaaatggtggttttgttttgtttttaaaacccacaattctgttggtctgtgtctgtttactggctcatactttctgcaaaaaagactttttttcttcctaaagattaagtatcgctatggattcatggatttctcttagtgtgttagtatcagtgatagccatttttcttttgcacactcaacttgtccaaacctttttggtggttcttatatcttttccttaagtctgaaaggcaatttagacatctgattatcaacaaggaagtcatcttcatatagccttttctttaactttttaataatacatttcaaacatgtaagaaaaacagtataatatatgaagtacctgtcatagagcttcaatttatggctaatcttgtttcctccatgacttcatttgcttctctcacccccattacttcgaagcaaatcctagatactgtattcagcttcaactaaaataaccattaaataacaccttaaggatggaaaatatgaatgagctgtaccttgcttgatatttaagacaatattgaaaatctggaggaaaagagagtatccaaaataacctgaaatcatggatgagaaaaataaactcaatgagactaaagaataataagaaaaaaattaaaaccattgaatcatggatttgctttggaaaaatgccaagggatggggtggacaaagagtcctacaagatgcaggtgtagatttagccttttagtagcattgaagttcaagtttgtagaataaacctgatactatcttaaatttattactaaaatatatggatagtcatttttctcttggtgctaagatttgtgatttgtgccccctaacagagggaaattattgcagacaagcaaaatcactgctaaaggtttattgctgtgatttttttttcaactctagtagggaagttcaattttgcatgtagagagctattggaattaccttatagtgttcaaggatctcttctgaagctccttgcttattgtttttgccagtttaatggtgaaaaaactatttgcatataggtttacccccctaacaaacatatgatttctgtgtggaattatggctgtattatttatttcatggttttgtttttttgtgtttgttttttgtt

SEQ ID NO: 64884 - DNA, 2127 bp, Homo sapiens
ctcgctgctttctgcacgctcggaataaccagagtcgcgaaattagccccgcccactgccccggaagttaatgcggaagccacacacctcctcctcggccggcaggggcgcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggtgaggaaggagagtggtggggcctcgtggcgacctcttctccacgtctgttcctccgactgctccagacatgttcggctgaggaaggaattgggtctagtgaacccgggggacagggtatatagaagagtggtgggaatggggagcaagatctaagatttaatttttttttttttacttctctctcttaggcatgaatacgagtaaatacttgatttagacaatagcggtaggctgcttcgtcctatttagattcatgggactactccagatgggatgctttcctttgatatcgttttggtattagagtggataggaattattttaacgtgcacccgacgttttagaaaaacttgacagtgtttcttttaccccgccaaatatactgtacccagaaataggttactagtttgagaaatatttgagacaaagctaatctggagaattaagacttaatgagagcgagtgaagaaagaagcaagttatgctgaggttttgggaattttgtggctttctttcgttttcttttcttttagccacatttcgttttcatttttccagctacataaacattgcaggtataagttgaaaatgagaagtctgttttggccactgtaaataaaagcatctgttttaatagtaaatatgagtgacaactaaatattttaaaattcacacttttaggttagatcagtgtgatttgtttcttttgctctttgtattcagaattttgtaggatagtatttaccttttagtgtgaaagaggaagctaaatagttatgaaaaatgccattaaatgtgtttttcgatctaagtcctggtgtgtttagataaatacagtttctaaaatggaggctaggtagcctgcagtctcaatttcctgaaatttcccattgccatagcaacgacatgcacttaggttttcgtttttcaggttccctagcttataacgtggaagatgttattggaggttggcagagatgaggcaaaataggagcgttctattgcatagtctgtaagactgtagatttcattatgtcggcagtttgattaaattgttttgtgtttgcccgaggactggtttcagtccagaaatcttcgcactatttacattttacatagtgttagcatgcccaagcatgcaaagtcttaaaattactgtatcaaaactgtttaccccttttctgatctagtatttgttatctgaaagtgaaggactaatgaactgaggtttcattgaaagttttcgaaattcattgttaattcttagaatttatctaaaattacaaagacacggaaatgttaccatgacctcttgaatgttttagaactgtggtgtttcagtgggacagatggtggtgaaaatttatagaaaaataatttctcccaaaggttttattgtgcaaagtttagaacatagagaaaagttgaaagaaaagtgcagtgaacacctgtaggacaactcttcgcctggaatcaacagctgaaagccttgccatatttgctttatctccccatgctgatagattgagaacagagtctttgtcactcacactagagtgctgtgacgccatcacagctcaccatagcttcgacctccctgcgctctgtgatcctgccacctcagcctcctccgtagctgggagtacaggcgcgcgccaccatgcccagctaattttttttttttttttttttttttttttgagatggagccttgctctgtcgcccagactggagtgcagtggcgcgatttcgccttactgcagcctccgcctcccggttcaagcgattctcctgcctcagccaccccagtagctgggattac

SEQ ID NO: 64885 - DNA, 2056 bp, Homo sapiens
cctaatactggggaaatccaaggcttgaacatactacttctgaatccaggtagtactcttttagtagcacacactagaaatgtatacacatgattggctgatcttgataaactttcagtgagaggggtcagaaacgggaaactctgatgcttacagaggccaggtggtggctgtaaatgtgtgtggcaggtctgggtagctaagtgcagagtaccaacctccttctgacactattcaacagcagcctgggattttatcgtttaattatttcatgccacaatcattgtgtatgcagtaagcagccactctagggaaaggggtactagctaaaaagacacattcttgaaaaaaaaaagacaactaaacatagcgattttattctttgcagattctaaggggaagtcaggcacgtgacggtggatgagtctcccacaaaggatatgtgcatgataatggcagagacagctggattacaggttcgtcttaatgctctgtaccctcagtgtgtaaacagtgttcatacttattttcagagatagaaaggaaggggggtgctaaggaaactaggtcagatcataaccagtcttgggtgggatgaggttggggaggaaccccaggaaacagagctggtggtgacagctgcgaggagtggaagaatgagtgctgaatcctttgggagctggctgaaagcaagaaagagacgctgagggaggttagaatagaggaatagagctgggacttcttaacagccttccccatggggttctgggatggcacccaatggtaacattttaaagcaattaaattggagaaatgatgaaattgtacctgattgaataaaagtagttatataaaagtcacaatattgtagctggtataaatgtttaggtcatttagtttaatttgcccaaattgactctccacagacagccacattttgcataaaatcatcttccacttttgagggtacatttgcaaccaagtaagaaatttcaactagaatagctcaactattattttctctacttaagaggcagtttgtcctaaatgtattttcttcctctgctacatatctaaaatttttgctttcatcttaatcatgcccacaataagcttctaaaaataaagcaataaaaagtcttagggaggaaaagacagaaggttataaaaattgttagctttataaataaacaaacgagactagtaacagaaaaagtttagaattttacatttcaatactttaaacctattttacagggttttatttgcttcatgaattctactataaactctaggaaaataagaatatatgcccaccgaagttattttacttcatatctcaccatttggaaacaaaagttttgttatttttaaacgcagccaagaaagaactttagataatgaatgatgtcagaatcagttcttttattgcggaaacatattgatttaatctatcgtatatctaacaaattcaaagaaatgatagtgacataatatcaggtaaaaatttctagtaggaaagaaaatctttgtatttttcatcagcaaaaaaaatacagtggacctctaatagttaattacatataagtagatttgcctaataagtcctcagcttctgagttatctggaaggttttatacaaattccttaggtcttgggagcccgaggctggaggatcactggaggtcaggaaatcgtgaccagcctggccaatatggtgaaatcccgtatctacgaaaaacacaaaaattagctgggcatggtggcaggcgcctgtaatcccagctactcgggaggctgaggcaggagaatcgcttgaacccaggaggtggaggttgcagtgagtcgagatcgagccactgcactccagcctgggtgacagagtgagacttcatctcaaaaaaaaaaaaaaaaaaaaaaaaattccttaggtcactccaaagcacagtaagatttattaagtgattctaattttctaaacagaagttaaatacattgtaatgtgttaccgaattatgtaatatatacggagctggcttaaaaaaatgtttctggc

SEQ ID NO: 64886 - DNA, 1072 bp, Homo sapiens
gccggacgcgggggccgtagcctccgggaagccgcgcctggccggggcccgggggcctcggccccccctccccctgccaaggttgcgcaacggctcttcccagcaaccgaagttttgtttagtcccacggggagcctctcttccccctccgcagtcctaggccgtaactacggagatccctttcctttcattaaggggaacaaacaaacgcgcaggcacgcagcttgagcaccccagccgatggccgcgtcccgggctttgtggccccgtccccagcgtcgcggagcagcgggtttgcagggtgtcaactctggggacgtgcgtgcgtgtgtgtgattgttggggaggagaaatgtgatccgcggctccgcgtccccagcggcggcgggaggaaggcgtggcggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatgtggctctcggggaatcctgttgttcccgtctcatctctgcttgaggaattgcgctgaagagtgtgtgcgtaaattaccttggacttgttacagagtagtcgtaacacgttcaggccttgaaccgtgttttcacaacctcttactgccctgttagggaatttgtttttccacctgtcagttggctgcttctaattataataaggggcttctattagcaacagcaaaaaatttcagtttatcgtccagtttagagggaaagcgcatggttggctctattgtaaactttgttttgatgtctgtctggtacagggccggaaaagttagctggcaaaccagtctgcgtgtgcttttgcgtactttctagtagtttggagatctgctgacactttttccctttttgctattttaggtatttgcttttagctgtagcttctgaagtgggagtacttatattcattcaaaccatctcagttaatttcaaagttttagttgctgggctctttaaaatttttaaagaggtt

SEQ ID NO: 64887 - DNA, 1028 bp, Homo sapiens
agtcaatgaaatatttcttggtgtatttatggctgcattcataaagtgtagaggacttttatttctgaactataatgcttaacctgtttgagatttttcttttttgaaatttacttatttaaaatttatgttaaggcagagatgtgttgaaatatttgtgatgtttgggcatgtctttttttttttgtacttatggaaaaatttgttccttaatccccccctctgcctcccgccccccgccccaaggggatctcttttctaagaaaaaagtatttgtggagaaccttagattaaaactgttgtaaaaaagtaagatgagtttgaaatctagaacagaactggccattaaatgtttcaactttatatttgggcattgctgactacagtagctaaacatacatattaggcaagcagatcataacatgataagtcagccttacttagtttattgtcaaaatatattttccattgaactagtcattaccttgcttataaactggtcattggcttttgggcatgggattttagagtcacattaaaatggatggtttatatgagatacttcttcttgtaaacatgtttgaaaagaagctgtagatcatactcttaactttttggataccataaaatagggtgtaaattacagacgtaggttgctgttgcaagtatggcgtgggcacataggtttttatgtttaatgcaagatatggagagcctccctgcaccccctgcaacttaaaaaagcagcagctatcaaattaattttttgattgaacttttgtttttaatatttgatgcatgaacctgaaagcatatggaaaggaggaaagggaaaatgtaaatttcagaatgccgcaatattatttttcagacctgattcacatccatttcatggaatgcttgtttgcatgttattttttatttgaatgctagtacgacttatcctggtaacttttgaagttaactttattttaccaggtaagagagttaacttattaaatgttattttcatagcaacagtttaccaa

SEQ ID NO: 64888 - DNA, 1048 bp, Homo sapiens
ggctggtgagatagaatttctttttattttgagtaattgtttatgctggaacaccttttcccatccaagtactgatgaggtctgaccctgcttagcctccaagatcaggcaagttccaagatcagaaacttttccatttctaatctagttggaaaaaaaacagtttagatttgataggcattgaaatcaatagagtatgaggcgagctcctcaccctaaacattttgtagcttttataaattatatttgatttaatatggattaccaagaaaattgtcttaaggatgctagaaaataaaaacttggctgtatttggctagacagttattttactgtggaaattttagaaagtatttgatttgctaaaaacaaaaaatgtttatttcaaattctttaacttccccctacttggttgtatattatttataagcatacaaaatattttagagtttttaaaaacaaaatagtgaacttgaaaacatttgcaggatataactttgcttattaaatatttcctaccctataaattggcatataaaggcctaaaagtgccaattttaaaatctgtttcaactttttaaaagcatatttcaattacatgttatctctttaataatacagagagtctggtaggtttggtaaactatacaactttagatatataatgctacagttttaaatagttaatgagatagattagagtgataacattgaaaactgaacctgactttctagacatttcttccaaagaatgacttaaattaatacttctgaaggctctaggtatgtaatttattacactttctattgagtttaaatagggtgtagtgacataaaatcacaatgaaaattacaggttatgctgctatataacctatagctatgatgctgtgctatattctcaaagccaaataagaatgttttgggccaacttctaataagacattttcaatggagacagtaagatgtctctgcagtatattggttgtagttttgtattttaaagttaggtaagaataatattgggttcaaaaatagtggatttgta

SEQ ID NO: 64889 - DNA, 1064 bp, Homo sapiens
tattgaacaccaactctatatccttggcactttgctttagatctagtgtgaaagacagatatatacactgacaattacaatataatgaaatgttgtaatcgcaaaatgagaagaatttaggaactactgtgagagcactgaatgctaacccctgcctagagggtgagtttatatgtttcaggaaaggcttcagcaagaagatattattttactttgattgaaatctgaaagagtttttaaagtgttcaatagtagatgtgagtctgggtgcagtggctcatgcctataatcccagcattttgggagcctgagatgagaggatcactcaggccaggagttggaggctgcagtgagctatgattgtgccactgcactgcagactaggcgagaccttgttaaaagaagaaagggtagatgtgcagaaaaacattaagagaacataatgcaaagttcctgtatctggcttctcagcttatttttacacttgatcatttgtattaggattttaccattagggaaattccaagataattttgtgcaagtagaaaacatggagtattacttaaagtgatgattctgtcaaatggtggttttgacgtacacgtttatatattgttgtggcagaccaagtagatggaaggcagatctaacacctgtgtaattatcagtttttctagctatggtactgaggattcattcttatgtgtgtatatgttttgagttcctatagataggtcagcagttgctaggttgatttcatattttataaattctaatttggtaaaataaggtcataggggagaatattaaatatgccagaataaaactggatcctctttcatatctatgttatatctgaatcaaataatgtttataaaatcattatacatttaatggttgtgtggtaagaatgttggctatttcagcctcaataaactcacatcctttttggatgcaggcataaaataaatagaatgtcatttagtccttgagaaccttagaatgattttaaatctgtttttcaaatatgatttgaaatttgatttgaaaatatgatttgaaaa

SEQ ID NO: 64890 - DNA, 1023 bp, Homo sapiens
aagccaacatatttatcagttaatgacaagtgctatagagaacagtcaagcaagataaaggaagaaaggcaagtgccatgtgttggtgagggtttactcttctatttaagatggtcagggaaggcctttctagtaatatgactgttaagcagtaacacaaagtaagaggaagggatcaagtcttgtattctctctgcctggaactctcttctcccagatatttttaaatgcagaggtcttgaggcaggaactatggtttgaaacagtaaggagactaatgtggctggaccagagcaagcaagtgggagaatggtaggaagtttcagatgtagctaagggctgccccttgtaggccattgtgaggaattgagataggaagctatcagggttttgaggagaagagtgacatggtctaatttatgtattaaatggatcactcaagctgctagattgagaatagatggcagagggtaaggacagaagcaaagaagaacaggaagctcttgtaataacagatggaggtgatggggggttggattagagtggtaacagtaaaggtggttacattgtgaggaatttgacttttactgtgataggaagccagctgggattttgaggagtggagtgacatggtctgatttgtgtactaaatggatcactcagactgctagaatgagaagagatggtagaggataaggacagaagcaagaatagttaggaagttcttgcagtaatccagatgagaggtgatggtggtttggatcaggatggtagcagtaaaggtagttacattctgttaatagatacaccatattttgaagatagagtcaatggaatttgctgatgtgggaagtgagaaaaagaggagttaaatttgattctcacaggttgtgggcctgagaaactgaaaggacagaattgtcgtttactgacatgggtaggactgtgagagaagtgagtttgggggaatcaggagtttttctgaacacattcagtttgagatgcctaataaacattcaaaaa

SEQ ID NO: 64891 - DNA, 1035 bp, Homo sapiens
atcttacatgcttagatggtagacttgaatgccaaggggcccaaaacatgttactcagtttttaaatggctacagagtccatgctgtttttaagtttttcaaatgaaactgattctattttcaacctttcaggaactaaattgcatttgtcgttatcaaaattttaatttacctattcgttctttagtaaaaaagtttttgctttgaaaggaaaaatcctagccaacagatttccctatatttcattagaaatggatatttgtttaatttttaaaaacttcttttatgctttgaatcctatttggtacctcaacacattttgaggatttgttaatattatttgttcttctttgttttaagataattgtagttccctctcctctcctgtgttgtgatttttgttttattttttaacggtggaatttatactactctctgtgacttatttttacttgatggcttgaaattttgattttcttaggtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccagtatgttactttaagatcttttaaagtggttctaaaaaaaaataagtctgtagaaaatgactgcatcagagaaattacttttcttcattaaacacaagtaacctgagtcaaaagaggctaagctaacttgaccaagttcacatacaccagtaagtgtcagggaactagaacccaagtctgaattgcagtccagtgttccttctccaaaatgcgatactaaaaataagactgagtggttttgtttttattatacatgactttcttaccttaataaccaggcatatataaaaggaaatgctaacagttttctctttaaagtcacatttcagttttcctacactgtaggttctatcatattttgagtcgtgc

SEQ ID NO: 64892 - DNA, 1050 bp, Homo sapiens
aggtaagaatgtgtagtaattaataacttagggtctttttttaatgattgcgcattttacttttgatatatacagaagtttggtgtcagttgttagaatgtacagtgctgtgaggtcttactatacctgtttttaccaaatctcttaaaattccaaggtaataattggaacatatctactccgattcactttttgccattcctctcttcattctctcaatacctttcacctgcccttctatgccacaactctaccaaaagtagaggtcagtagaatcggtttttaaattttaatttcggcagcttgtttttgttctcattttctggacacattttaatagtagaattatgatcttaagaaatgtgtttgaattctatttatacagcgtgtatatttcatttagaagactgctctatataatgtgctcgttgtttcaggcattgaccacatctgctcattcagttgtgcaccatggaatacctctgcaggcaggaactgctcagtttggttgtggtgatgcttttcagcagacattgattatctgtcccccagctattcaaggtattattttatttaaattttgctttgaatctaggcatgctttattttaaaataagtttaggaatctgttcattaaatatattgtataatttttgctgcatttagtgctacatttgaatttaagctgttcaggccaagtgtggtgtttcacgcctgtaatcccagcactttgggaggctgaggtaggcggatcacttgaggccaggagtttgagaccagcctggccaacatggtgaaacctcagctttcctaaaaatacaaaaaattagctgggtatggtggtgcgtgcctgtagtcccagctactcgggaggctgaagctgggaaatggaggttgaagctggaaagtggaggttgcagagagccgagattgcgccactgcgctctagcctgggcgacagagtgagactctgtctcaaaaaaaaaaaaaaaaaaaaaaaaatttaagctgttcaataagccttcagaccagtgacactcatttcttgac

SEQ ID NO: 64893 - DNA, 1326 bp, Homo sapiens
tttatcatcaaattggtaaataggttagttttgcctttcctttggaggttgaaatgagtgtgccatcccggaattttcatccattatgtgaaccattatgtccattaaattatgaagttgtgatgtatttctgttttggtgacaggagcataagattctatcacagttttaaagaagaagataactaagcatagctaaaagtttgtatgaaaagaagaaccttcacctgctaggttgtcagcatactaagccagattcttctttccatgttctttatcatggtgactgaactatttaaaaaggaaaataaagcttcaatagcaaacttcggagatgagaagtttcaagaaaattaaatcgttcaactttgtagtatgcattttgaaacagaaagggaagctttatgataatttttggaatgatgtatatcacaaagtagacaagaagtacctcattttgctactagattgctctgttagtgttatgaaaattttatgcagagaatggtatcataactccacaatcagggctgggtgtggtggctcatgcctgtgataccagaaatttgggaggccgaggtaggaggatctcttgagcccaggagtgcaagaccagcctgagcaacatagaccctgtctctaccaaaaattaaagagattagctgggcatggtatatgcctgtggtcccagctgctcaagaggttgaggtgggaggatccacttgagtccaggaggttgaggccacagtatggatcatgccactgtgctccagtctgggcaacagagcgaggccctgtctcaaaaaaaaaaaaaatctgtcagaatctaagcaattcttgacatttaaaataattgtataagttaaataagaggaagattttttcttttatttgataactattctgtttcacaggtattcctgcaacacatggtaaacccaccagttattcaataagggtagataatacagttccacttgtaactcaggccccagctgtgcagccactacagatccgaccaggagttctttctcaggttggtaataattcattctttgccatatatcagcttgtgcttttgggaaatagtgaaaatgacctggatagggatttaatccattttgtaggttatggactttaatgtttataattgttagctgttacttttagatagttttgagtttaagatatggtaaagttcaattacttataacttgttattttctattgttttgctttgctgcaagcagacgtggtctggtagaacacagcagatgctggtgcctgcctggcaacaggtgacacccctggctcctgctactactac

SEQ ID NO: 64894 - DNA, 3260 bp, Homo sapiens
gcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttct

SEQ ID NO: 64895 - DNA, 1058 bp, Homo sapiens
agcctctctctctctcttttttttttttttgtatatttttgtgtttttttgtattttttactacttatttttgtttttctttttgtatttcaattttttttactacttttttttcacttcaaaattttttaaaaatagatttctttattttctggaatttttctagccatggtaaccccaggcctttttaatcagaatcttcattttagcaacatccccatgtaacttatgtgtacattcgagtttgtgaaacttgggcctaatggacagctttacctggatgctccttttagcacttgtttttttcccccaagcctaattttcctgtatctatatttcctgtattcccagatacctatcttccttcctactttccttccttctcccctacctcccctccctttccttcccctccccttctcccttcccttctcccttcccttcccttcccttctcttccctttccctcctcctcttcctctttctcctggtatcattggttactccctgtcaaatccttcaacactgttcctgtctccttaccatcctcattgtgctgcctcagttcagacctggaacttatccaaactaatacttttatctgacttcctggctttgagtccacccccactcctccaaccttcctcattactttccaggtggtctttttaaaattcaattttgaccaagacagtagcagtggaggtgccaaggagatgcttggagcaatagaaggggcaagtaaacataacctaagtgaaagcagagctcttcttatcaaattcagcttcaagacgagtcctggaccagtttcctcaaagcttctcatgaaaattctgaagttgcctttggatgccagcctgctttcaaattttcactgtcactgtcaagatgatgtccaatctcttggaggacttttcggaggacttttcttttctttacttttttagagacagggtcttgctgtattgcccaggctgggcttgaactcctggcttcaactaatcccacctgggcctcccagtgctggaattccaggctcgagccactgtgcctgg

SEQ ID NO: 64896 - DNA, 1005 bp, Homo sapiens
tggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgac

SEQ ID NO: 64897 - DNA, 1303 bp, Homo sapiens
ggaagtgtctggagctctctgttcggggacctcagaccaataccttcctctccctgctcacttgtagcagttccttgtatactggagccctgtctaacctgagtctataaatcacccttcctactcagaaacccctgaaaatggggaaccaagcaagccgctggcatgtgctggagcccaggtctcctgggaaggtccacatgggggatggtgtcccgtagcaggctgtaggtttcagagcccagcgggtggtggggagccctcaatttgtaaggaaaggccagatgacaattgtctttcttcctggttcctcacatatcataaaaccacctctttctcatctccaccacccccatctccaggcttgactcactgattgttttcttttttggacaatgtcagaccctgcccttttcctggaacttctcagtcctccactggcctgcgtcagcaaattcctaagtagcagatgaccttcaagatgtgtgagaaggaagggacaggaatgattgtcaggattgtcagttccccagggaactctgcatttctgacttagggagggtagatgactcacccttccaagaacccatctgtctgtccgggcctgtggggctctggagaatagaatatggagtaccctggtttacaggcactgccacctccttatttcaggatgggttcagggatgtaggattggagttgggagatttcttagttctgctatggatgctttgtacttaggcaagttcaaaacctccctaagctttggcttctttactgggtaaagtagggttggaggcatttcaggctttccttcttctcacctgatgctatcactacacatctaggcattcacgtaatggaaacttacaaagttgctcaatacctctcttcatgtccccaaagagagcaagcaagtgtccccattatacttcttacagtgaggagccagagcttccaggtatgctaagccattgctccctgttccactgctgaatgcatgctggtgccttccagagtcacccctttggtctgattcacttagtgctgtggctccgagaagtggccctctctttcagccagcagcttggggtggggccagtagagtgggaaccacagtggctatatgagtcaatttgctcatattgtcatttgactcactgaccctgatggggaagatagtgttattcccacagtgtggtagtacacactggggcttatagggactgagcctactcaagggtatatggtgctgtgggtcagagctggggcatggcccagggattcagtgtgccttgactcc

SEQ ID NO: 64898 - DNA, 1571 bp, Homo sapiens
agatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagcatttgcttttaaggtagaagatgggatggattcttgctgacctgctgcaaaagtagcaggtccactcaaagtcatctcctagctttgactgtactgtcttgtgtgccccaccatccattttcccccaagaacagttattttatagagaaaactgtaagaaaacaagtggcattcaaggctaagcagctgccattagggaacatgaagacaaacttatcctttcattttcacacatgtcaaggtgttctgaaatagactaagtcatttttcatgtttacttttcatttaatagagtataatcaggctatcaaatcctattatggctatccttttttttttttttttttgagacggagtctcactctgtggcccaggctagagtgcggtagtgtgatctcgacttac

SEQ ID NO: 64899 - DNA, 2347 bp, Homo sapiens
atggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaaaatttaatgtgtggatgtgtacttttggcagtctctctgggatcatttcttaagtcaactaggtatattttttaaaatctcgtttttagggttaccttatgacaagtgtaacagtaactccaaccttagagactataacatgattaaagaaagttatgaagctccagttatacaatggggataaaatatgaattatatacccagaatgcaattgagttgtaggtgttgaatctttggaaaatgccctctagcttctggaatgaccctgatggatgggtttaagtttggaaagatggacatgatattaatctgatccagagctgacacattttcaactccagtttgaaaagagaaggatgataatgagactttgggccattacctgtgtggcatatctagtgaaaagaatctacagtgtgcgtttggaagtgaagatttagatttcttcccagtggaggaatgccagaaactgtatttccagtactgggaatttgctgctttgcataacagaattccttttttgactggcccagtatctgtatgagtttggaataatcttttccctaaatgtttgatatgattcatcactgaagttatctggggctagagttctgtttgtgggaaaattttgaaatttgaatttaatttctttaatattcatattttctatttcttcttgtttcagttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgattttttttttttttggtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttgacctgccttgtggaaaatgttttctctcaaggatgagaaataaaatgagaattctgga

SEQ ID NO: 64900 - DNA, 1024 bp, Homo sapiens
accccaggcatccaagtttttgaaactttggacaaggtttaagctgctttacatttatactgtctggttgcatagggtaagctaaaggttgtatcaagataacagcatcagagaatttacttctttaaacattaaattggccacacatacatggctagcaaaacaccagcaaatcaatatatcatggcaggatagattgttgaaaacagtaaaactgtatttctttttaaaacattgccatttagacatttaattaattttcaatttaaatcagaatcttttttccaatcaaaagagtttgaattaaatatttagaaattatagtgctttgggtattcctgatttagaattgtcatgttaattagtacttataaagttgtgagtgggaaattattattcatcagaaagatgaagcacagctctttggcactgccgtgtattacatgtttgagtctgtatgctcctcaggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagtaagtagaacgtgtgtttaaatatggcattaagatgtgttctgatggttgtataaatgcatgcattaggtattttcaggattgtagaatgggtatagaatattatgcattttagttatagacctctctaactagagttaatattctgacataatggcatggaacccaagagaaaacttgacagttggacataaaaaactggtgtatatacagaggaaaagctgcaatttgtcttaaggtattttaaggaaaattaatgaggagctttttgttgaagtaattaattgtaatatgtgtttcagactttccaaaaatttagcctttgaacatcctttgattcatgctttgagt

SEQ ID NO: 64901 - DNA, 1074 bp, Homo sapiens
tcagtcagaatcctagcccaaaaaccttgggttttaccaggtccctctctcctttgtggaccctgaactctgtttgttttgccctctagccctgtggtactgcctaaagctttgctcagcttcttggccactcaacctcatatttgctttcagaattgacagcaattcttgtctaaagacaaggtggcttccgatgcctggcccacctctcagtctctctcttctcctggacccctctcccctaccgttgtgactcttcgaaagtcttcaagccaattttttgttttcactattcagcaagaggtttagtccaacaacctggtgggctgctgctgaatgtcgatctcatctcttggtatttgtcattatttcccacttctcaaagctagaatatgtggcaagtttacaaatatgcaaaatagagttcaagttaatggcctcctcacacatgaaccataccttatgtcctatatttcccattaagagtcaatgttaaaactcttaaataacatcagtttagagaacttccaggggttttgctgtttttttttttattttaaataaagcagtatgaatattttagatttaggaaatttagaggtttgtgttataatgtgaaaacattattgtggatctcattggtgcccactttccatgttttactaagtgccagtgttttccctgttgggaggaaactaagaaatttgctttctcagtgcttcaaattagttttcaattcatttccttctatttcagccatatattttggacagaattcactcattccaagattgtttcattagttagcagatagattgcatttcttcttagatttaaggctgtttcttcacaattcactcttttttgtgcctttatagagggtgctcgagaggaagacctcgatgctgtggaagcgcagattggctgcaagcttcctgacgattatcgatgttcataccgaattcacaatggacagaagttagtggttcctgggtaagatattcaatgttttggttatttttaatgatgcaagttattttttagaatgaaagtaaataaattgtatttgtagtt

SEQ ID NO: 64902 - DNA, 1060 bp, Homo sapiens
agtctctgattcaattgcaaggttatagaggttgcagataaaaaggaaaatcagaaagcagataggcattggacttggagaaatttttatggagcatcttgaaattaagatatattgttgtcacatattttcaaatctcatatttaccttaagttttggcttagaattttagagttggaaggcaacttagagactgtttagacgaggggttggcaaactttttctttaaaggaccagacagtaaaattttaggctttgtgggacacatggtctctgtcacaactcttcaactccgctgttgttgtggaaaagcagccaaagatgatgcataaataaatgagtgttgctgtattccaataaaactttattcattcaaggaggcagcaggccaggatttggagtgtgggctataatatgcccatcctgatttatgctagtaagttgaagaaacatacccggagagtttaagtgactcatgcaaggtatcaaactagtgaccaagatacaactctaatctaggcttcttggctcctcataactttttcactgtttccttctatgagtaggttaaggggaaaagaaagtaaataaatatttactgagtatgagtaaagcactttattaatcctcactgtaattctctaaggtaggtggtattatccccttcttgaggatgaagaaacaggattaaagaggtgaaatagcttgctagaaatcatgcagtcagtgtgtatcagtccattcttgcattgctataaagaaatgtctgactctgggtaatttataagacaagaggtttaattggttcacgattctgcaggctgtacaaaaagcatggtggcatctgcttctggggaggcctcagggagcttttactcatggggaaagcaaagtatgagcaggcgtgtcacatggcaaaagcaagatcaataggaagagggggaggtacggcacacttttaaatagccagatctcatgagaagtcactcactatcttgaggacagcaccaagggaaggatgctaaaccattcatgagaaaaaatccaccccatgatccaa

SEQ ID NO: 64903 - DNA, 1054 bp, Homo sapiens
atagacagattgtagattgattgctacttacctgctttaccctccaagtttttttcagatttctacactgaaaggcattgtatagatgttcggttttgctaagctaaaattggaatcagttcttctcaaatattttcttccctttagaactaaagactcttttgaaacagtattccttttgcattttgtgtttcctctctaatttcccatgcaaatattactttcatacaaatcacggttgcatgacgaggtgcttgaaactgaattgctaaaaggtagaagaaagaatgatttggcagaaagagtagggctttgaaggaaagtacccttgattaatattctgaatagctccttttcttagaagaaacgaataatactatttacttggtatgtagggtcgaatatttcaagaggaaactaaatctgaaaatagatatttggtgatgataaggtaagggcttacagtagctattattaattaaacacaaagctaggcactggctaagtatttcttgagtattactccatttaattgcaaaagtcctatgggataaataattactattctcattttataggtggattacccaaggcatgaaaaactaagtaagttgtggccaggcgcggtggctcacgcctataatcccagcactttgggaggccgaggcgggtggatcacgaggtcaggagatcgagaccatcctggctaacacagtgaaacctcgtctctactaaaaatacaaaaaattagccaggcgtggtggcatgcgcctgtagtcccagctactcaggaggctgaggcaggagaatggcgtgaacccggcaagcggagcttgcggtgagccgagatcgcgccactgcactccagcctgggcgacagagcaagactccatctcaaaaaaacaaaacaaaacaaaaaaaaaactaagttgtttaaccatcacaaaggaaaggcaaaaccaggatttggatatagagcagactccagggctatgatcttaacattggctgaagggagacaggacctatcctattatgtttggaatgtcttaga

SEQ ID NO: 64904 - DNA, 2293 bp, Homo sapiens
tcctttttggactatcgggatctaatcaagtaatgggacgacacgcatggcaggggtgggggcatggggagaggaggcggtgaggcagggggaaagggggtcggggccgctgacaggacccgagcttccgcgacaccagaaggtgacgccagggccgccctcatcctgcggagccaccggggaccggggcgagacgggggcggaaagggcctcgccctgagtcttcctcctgtcctgggcccaggtatgagaagcgacgagatatctctctcccaggcctcggtgaggcccacttgcaagagaaggaggtagtggccctcgtgccgcaccgccgcgctccgcggacccccgctggccccgcaggtgcccgcccggttggggtcagtccctgctgctgtgtaaaagcccctgtcccggccaggcgctcttctctgctgggtccggggcctgcggagtctggcgccggggtgggcaggtgggtgagcgagaggagaagataggcaaccccttactcccctggcgcgacttccccagcgccagaatcgctgtccgggctcactttcggacttcagtgcgtgagaattgttttgctgtcagcattgctccttacggttcgatgttggattttatgttttggtactgacttccggtgatgccataccggtgactatcttttctcctggacaccttgggtttcccacattactagcatctgttccagaaataaacaccggttgctgataagggtggttcaatgcccagtttcttcagaacttgggactgtctggggtggtggaagaaatggcgctgccagcccgccccccagctgtcaggattgtttacacccttgacagggggtggcatggctgtgagtttcctgtgctaccgtatatatttgcagaggatgcaaagtcgccctcttaggataggtgggcgagatttgttttgtgtttggattaaccattagattctagccatttgatgattgtgccctgtgttattagaggtctttttataaatacagatttcttggagctacagatagttgttggcctagctaagtggtgatagagagatacctcaagtttttggtcactacctgtactggtcgctacctgtacctgctagcaattttatttttctagaaaatacttacaatttaactaacagtctccaacttttgattgctgccagagtaatctttccaagacacatctggttgtcattctccttaaaacctgtgacacccctatgtttatagactataacctaaacttctggggcattgaaagctcttatcatctggcttgtatatctaaggtcctccaggacttatttctccaccactatcacatttgcaccatccattctaaccaaatcagacctctgccagcatacaacacacttgcactttctttttttttttttttcctgtggctcaagctctcgaccttgcctggaatgccttgcctacctcttctcaacttggcaaggtggagaagatgccctctctaccttcttcctgcagaattgatttgccatgtcaggtagatggcgtgcttcttgattgtaagggctgccttgcttatcttcctattcaaagatttttttttccccgagggcttgctatgtgccagtctgttaagtgttgagggtacagtagtgaacaacgcagataaggcaactcttatggagcttacagtccagtgggcaagcgcataattgcaagaggtactaagtgctgtgaaggaaatagattgctctgttaaggaataggaagtgagaagtgatcaaatcggaaggagctgccatatatgaagcagggcatatgcagttctggcagagggaaaagtatgttcagagattgacgggactgctgaacggtactgttcaacagcatggcctggtggaagatacagaaggctggcgttgctggaggtagggagtgactcacagacagtgatgagatgagggtggtgagatcatgcaggaccttgggaaccaaggtgaggaagtaagagtttactttaaatgctttaggtagtaatcacaattttaaacagaagtgacatgatccctctgtaaatgtctgtggaaataaattgagttgaataccatttgaattttatctacagaaaagtatccagtgtattgcagcttttttcctgcaccatacagcccaattttgtcaagggtctagtctagtgataagctctgaagtttttggtattatttgctgaactggattgggttggattggattagtacactggaatcatgtagcatcagttgc

SEQ ID NO: 64905 - DNA, 1050 bp, Homo sapiens
ctgccttaggggccattccccaggcctgagctccccgggaatcagaacccacgtctctctctgtgcacttggcaggcagtctctaatcctgctgggtgctgccgtatcacccactctgcccaagggctttttgtttgtttatttgtttgtttgttgagacagtttcactctgtcacccaggctggagtacagtggtgcgatcttggctcactgcaacctccacgtccggggttcaagcgattcttgtgcctcagcctccctagtagctgggattacaggtgtgtgctaccatgcccggctaatttttgtattattagtagagacagggtttcaccatgttggctgggctggtctccaactcctgatctcaagtgacccgcccaccttggcctctcaaagtgctgggattataggtgttagccactacacccggactgcccaagggtttttatccaggacagcccctcatgagcttcactgaatcatgcatatttcagcctcagtcaggcttctgggaggaaaacacccatctgtgctcctgggtgggaatagcatttgcctagacaaaggactctgccctattactggaacccttgagtgggccctgcaactgccttgaggtgtgaatggggctgggctgaagcagggtggggttggcctgccttggaccctgccttgcagaggttggaaccaaagcagtgtggctggcagcatgtgtgagctcagagtcagaagtcttgggctcatacctgccacttactagttgtgtgctcttaggaaagtcacttttcctctcagagcctcagtttcttcatctggtaaatggcgataaaaatacctctctcagagcactgtggtcaggatgaaattagatctgtatgcaaaacacttagtgtagtcactagcacgtagaaaatgctcaatgctcaatatatggtagcaaaaggaggtaagtttgccaaagagagcacgaaaccccactgacaggctctcagccccagacagggcagatctcgcactgccccagaaatgcttctgggacccaatgtg

SEQ ID NO: 64906 - DNA, 1831 bp, Homo sapiens
tggtataaagattttttcacccaaaggagcttcacttgtttcagtttctggaattgcctttgaagctgactccttggttttgggatgctcaccacaatggatatcttattcatttatatacaaggctagtaatattcacccattaatcttgaagaaagctgtacagctcaccttaagtttgcatgctcatgctacacactgagatttttgtattctgctcagtaacgcaaattgagctttcctttagccagcctgcacgcctttgaagaaggtgaagaaatggctttcttaaattttagtgatttagattagaccgtttagcaactatagggaagcacagtaaactatcgtgattgcctcattgcatggtgaggtctgtgtttaactctatgagaattcaagggtgataactgttcctgcttggggcaaacacttctatgttgagcaaggggtgaatgctagatgtttttctgaccagttacccccacaggtcattgctgagggacgtggtgatggcagcagtgaatcactagttcctaggactgactaggtagctgggtttcaggggtaatgacgtgcaacaggcccaacagacatcaccgagaatgggcacctgtgagattctaagaacctcaggacaaaaagacttcctgcaagtccaagtcctgactatgacgagatatgacctatgttatactccaaactagtgaaatggaatatttccatccttttaagacttatgcttttttattattagcttttttttttttttgagacgaagtctcgctcttgttgcccaggctggagtgcaatgggtgcgatcttggctcactgcaacatctgcctcccaggttcaagtgattctcctgcctcagcttcctgagtagttggcatcacaggcacctgccaccatgcccggctaatttttgtagttttagtagagacagggtttcaccatgttggccaggctggtctctaactcctgacctcaggtgatccgcccatttcggcctcccaaagtgctgggattacaggtgtgaaccaccacacctggcctaaaattgttttatttcaataaagcaccaatagaattccatttgcagtggtatagtgtgtatacctttgtaattaacaacaccaagtagatagataggcttccttcacactgtaaaacattatttattttgaaattattaaagagtcacaggaaattgcaaaaatagtacagagagatcccttgtattctttattgtttgtttgtttcccatgtaccctttactcagtttatctcatggtaacatcttacataactatattggtatttttcaaattttctataagattttataatagaaaaagaaagtctttttccagttattgaaggtttttgttttaaacttttgttctgaattaggtctctatccttgctatacatacttcatctaatctaactctctgcgtatcaccagaggtgatattcgaaatatttaaagatattgaaaaattagttctgctttaagtatgtccagttggaatacagcctggttccaagaactaaaacagagccctgggcattcatgcttcagctcttcagtctctagatcatgaagatatctgggaaagggaggtagggaaggtggctcttgatcaacagtatggacatgtttcagcatctggaccatcatgcagctgtgctggagagcaccagctcatacccagcccatattttcctgtaatgcattcatcccattgctttgaattcattggattatccttatttgcctcctaaatatattatcagctctttgaaagcaaaggcatatgcttaatt

SEQ ID NO: 64907 - DNA, 3492 bp, Homo sapiens
gggaagagggccgctgcgcccgggtgtcctttatctccggacccgctggagcttccgaggggcttgcccccaagtccccccaccccaccccggtcatttcccatgcccttctctgcccccaagccccgacctctctctttcctcccttctccggaagccggcaaaagccggccctccccggtagggaccgttgcagtggccgttggcggccggcgcggcgatgccccgcctccggcgcgagcctcggagcccccgggctggtaggccgagccggcggctccgcgggggaggggcgggtcggggggcggtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctctaaaaaaaaaaaaaatcgagccacacccacgattttttggattcaatatttagtccttgtagatcaaactactgaggtatatcttcatctgcaagtcagccttttgttttatgctttcatcgcaggacagtgtaaactcttgtttagaggggcgtgtgtatgtatgtagagaaaaggtctgggcagagtgaataattaaaatgagtaagatcagaggtggaaggggagaaacaaattagtcgtttgtaaaaacgaggtaattacgtctgtgactatcatgttaacttgaattttaccttataaagtaaaatgaagccttgataacttctacttgtctgcctctaggaaaacatatttataacatcttgaatttccaggaaatcattttgcagtgtttatgtggccagacacctaatagtgttacttgaggtgctgatatagtaactggctaaaacttgggctgtgggaaataagttgaagaaaactggtgatgtttaggtcttattaattttacttatatattttacattttgggagagttttaaaacatttagatttgatacttccctgtttcatcttcggtattgaaggttggaagttttacttgaatttcatggacttgggatttcttttttttcccaatcctttattttgataaatgtatgttttattataggtaattggaatagtaaatgtagttacatcaagaaagtaacaaaagtattttaagtgtaaggtagctacattcaaatgttgaatggaataagcatgcccaaggccagtatcttctgagtctgacacatgatttagtttaccctgttgggtatcttcttaaatttttttttttttgagacggagtttcgatctttttgcccaggctggagtacaatggcgcgatctcagctcactgcaacctccacctcccgggttcaagcgattctcctccctcagcctcccaagtagctgggagtacaggtgcctgccaccacgcccagctaattttttgtatttttagtagagacagggtttcaccctgttggccaggattgtctcgatctcttgacctcctgatccgcccgccttggtcttccaaagtgctgttacaggagtgagcccctgtgcccggcctctttttaaaattttaatgcagtaagcaagcctgctgatctggctgctacttgagtttttgattctttagaatttcttggaaatgtttttttctaggacagtaattgaacataaaatattaatgattgtgaacattaataatgtgttaatactaattatgaacattaatgattagtgatataaagtgtagagacattaatgactgaaagataactcctcagagaagttaatataaaggtaggtgctgattggcagccaatttagttgtgaggtggctgttagaatctagtgttcaagtacttctgaaaaaaaaatataaatctagtttataagcccctcctgaggacttgaaccatgactggtcattaaatgtgtataggtgtatgtgaattactatactctgtcataccctaccctcaagtgattttgttattttatttttattttttgagatgaatctctgttgcccaggctggagtgcccaggctggagtgcggtaggatgatcttggcttcctgcaacctccacctcccgggttcaagtgatcctcccgcttcagcctcctaagtagctgtgattacaagtgtgcgccaccaccccaggcaatttttttttctttgagaagtctcgctcttgtccgccaggctggagtgcgacgatgtgatctcggt

SEQ ID NO: 64908 - DNA, 2360 bp, Homo sapiens
gctgggattacaggtgtgagccaccatgccgggcctcccctaaagtcataaaggagaaaataatgtaattattacataggttattaactaggctaatacatactgaaagattgccgtgttaataatggagattcaacaaactgcacaaagtaacttttttttctgtcttctcagtgttttaagtggtagatagcagcaaaaaggtcaagttacagttaagtcttgagactttgataagccacagactgaactctacctacatgttaagtagttaagttggcagtattgatgttgacttaattgctattaaaactatatcttttgccctttgaaaaacccagggcatttggatttgccctaaatttaagcacatctggtttttagtttaaatcctttttatatttagatgatttacttgtgagaagacttaactgtttttaagtataagtgagcatttctaatgcactaaaataggattgctttacaaatcagttttgaattcctctttagaaacccttgtggagtaaagtgaggtactatttacaattagatttgttttgacttcagtccatttagcaacttacatttgagctttatttcaatcttgacctattcttatcggagccttctggaccaaaatgctttttttatggattttaaaatcaaatatcctggcaaaaatgactatggatatgtagtattgcttaaattaaaacagagaattgaaataattttattgtactttaaaaaacaaagttgtttatttcctaataatttgagccattaaagaaaaagctaagcatctgctcattgagaatgcatgctcttaatgttgatgaaatatgatcgtgttatgtaatgcaactaaaaggcttggtgggtttttaaattcaggcttataaagagtacatgaatgtttagcaaagagaagaaatacagctgtgataatcaagtgtaaaatccatttgcaaatcttacaggtaatattgaattgaatgattaactgcctagttttctttatcagttcattggtgctgaactgggccctaggctatgcaagatatttcaaaaccaagtcttaattttaactgaagagagacctcatttgatattattagatgtaatcagttgtgatatagaataaaggatgttttaatagatgacatttaaaattgttatattctttgtgaatataataggtttagactctagtgactttggtaggtgaaagattaactaatgatcacttgcgtaaaatgcaaaaatagcctgacagctttttaaccactaagtgaccaaaactgatagccagaagtgtagtgtttttaatactttttcctgaaggctttctgcacttcatctttgcagttagtagtattctttaaaaagaatgctgttgttgtgagggtaacatttctttctagaacgttgcagtgtgtctgtgcttagaattttcattgcagctgttgtgcagaacttatgtgttcagtgttttaaaataaaaacattcttaactattttataagtaaaatctttccttgaggctattacctgaagccttctttgacatttaagatctcttgatgtgtttgcttttccatgggttgcaagaactattcttctgcaatgcagagggcaagattattttgcattcaccttgtcatagaaaaaagctgtaatgcttaatttgtttccctttgcttgactgtgtgtgtttgtatgtgtagcactgggaagtatttaaagctgtgaattcccccaagtgataatgggtacctttttctagggtgagagtcgaagcctaagtattacattgagaatgtattgttttaacgtggccaaattagtgtactctaggatactacccatgtggcagatatttgagaatgcattttgtgtgacttacagattaagcatacaatttgccaaaattttatgtaattaatttcctagtttacatttagggctagatgaagactagtactgtttcatcttttagaaaaactaacacttttcctttagtaaaagtgttaatttttgcaatacttttgcaaaaggttaaacttatagcaattttgtcatagctataatcttacactgttataaaatttagaggatttttaatttttatttattatcattatttgagacagttttgctctcgttgcccaggctggagtgtaatggcatgacctcggctcactacaacctccccctcccaggttcaagctattctcctgccttagcctcctgagtagctgggattacaggcgcccgccaccacgcccggctaattttttatatttttagtagagatgggatttcaccatgttggccaggctggtctcaaaacgcctgac

SEQ ID NO: 64909 - DNA, 2047 bp, Homo sapiens
gttagcattcttatgccattcttagcgttcagaaatccagcattcctgacaggtgttcattcagcctctgctttaaccagtcttccagggcctggtagagtgctcgtttctcaatgaaaatttgtttcattggtgtgccactctttaagttcttggtggtagaagtatatccttaccggccgggcacaatggctcatgcctgtaatcctaacacttttgggaggctgaggcgggcagatcacctgatgtcaggagttggagatcagcctggccaacatggtgaaaccccgtctctactaaaaatacaaaaattagccgtgcgtagtggcttatgcctgtaatcccagttacctgggagtctgaggcaggagaatcgctggaacctgggaggcagaggctgcatgagccaagatcgcaccactacactccagcatgggtgacacagcgagagtctgtctcaaaaaaaaaaaaaaaaaagtatatccttaccaccactgtttaatagtctttgttttctggaacagcatagactcccgctacatgagcatgctttcaacatttgaagaaagctgccatggatcagctatggattgtagtgtatgttctttctaccctgcttttaaaaattgaggaaacttttgcttactatcttttttgtcttctggggatttcactagctaacaatactcagttgaatttgtggagggcaaataggagacagtcagctgcctaccattgtgggcaaagtcaaaactcgtaattgtctaagtgaagaacagagaatgtggggattggggacttgaaataatacctggaaaaactggtaaagattggaccgggcgcggtggctcacgcctgtaatcccagcactttgggaggccgaggcgggcggatcacgaggtcaggagatcaagaccatcttggctaacacagtgaaaccccgtctctactaaaaataaaaaaaattagccgggcgtggtggtgggcgcctgtagtcccagctactcgggaggctgaggcaggagaatggcgtgaacctaggaggcagagcttgcagtgagctgagatcacgccactgcactccagcctgggcgacagagcaaaactccgtctcaaaaaaaaaaaaaaaaaaggaaaactgctaaagattatggaaagttgagaggaaaagaaatattttgtttttgcaaaagttggtacagtactctagaagtgatttatttggcctggatacataaagtatagctaggtgctcttaactactttggttattttaggcttcatttttaagtattccctctcagtttagacatctccttatttgagaataggagttacgaagttttcctggaaagccaagttagtttttttcagatgtttcctcctaatcttccttctgactatttaaaattgtctagttgaagaatttttagggttttttggagtttatcatctctctttgctatttatttttaattgcataattaaaaatttcttcttaaattttttatttgtggaatttgttggctataacaataaagaagcaaagcccaggaggacatctatcatggatatccctcttctggcaccctaatggcacctactgaacttaatttaaaaaatccatttcaagaaagtaactttggtggtgatgaaaaacttcttgggaagaatggaagatctagatgtattgcaattcagcacaacataataatctgattggagaaaggaagaaaacagcagcagcagaggcagagctggaatgtagcaacagctggaatccagaatgacattctaagggggagggttgttaaggcacaaatgatttttctgggatttaagaccttacttaggtaagttatttaactgtgtctttcaatttacagttaggtgaaatatgattgatagtaatgcctccctgataggtttagctaccttttaaatttgaatgtctgttacatagtgaatactgtcaactattaaaagcagtaaagaaacaggatatagagcgagactggatagcacttgttgggataattatttccca

SEQ ID NO: 64910 - DNA, 1103 bp, Homo sapiens
aatacacttaggatactcagctgaaaaggaactctaaattgaatttcaagttagaaaggatctaagagggcaggtgtgtgttatcaacattgtaacgtagtaggctttctgatgaagatagtttttttttgagatggagtttcgcccttgttgcccaggctggagtgcaatggtgtgatctcagctcaccgctgcctcaccctccctagtagctgtgtttacaggcatgtgccaccatgcctggctaattttgtatttttagtagagacggggtttctccatgttggtcaggctggtcttgaactcctgacctcaggtgatccacctgtctcggcctcccagagtgctgggattacaggtgtgagccaccgcgcctggcctgaagatacatttttatgctaggaaaatggtttcattctctaggaaaaatacttaatatcttattttatttgtttcatgagtagctgaccaatttattgttacctcttctgctgctgttagccatgttccagcccaggaaagaataaagctgtgtctgtctggagccctttattactcctatcttaccattctgttcttagtataatgttggatctgtcaatgtgacaagctattccttgtatattcgcttagttcatgctgtaaattttaacaccagtggacaaattttctagttggactttaatgtaaaccatttgaataggaagtgacaataggaatgaagccacttaagatggcatcatttttctcttgagtagtctgtgctttcaaagattaggcaaattgtatttggagaagtgcagataccatatccttttccttatcatggaaggccacttaaggagtaagctgagattgcaagctatagtaatctttatagctatagtaatagctactttcattttgaaaagtaaaaaattagaccaattgtcgtaagaggctttctgtttatagtgtacattttggtatttaccacttagtttaacttctgaggtgtcagctaagaatgcaagatttaacaaaagtactacttacaaatggcagtggtatgcctttgttttttctctctcacctctccttctcaaaggtggtaacccctaagt

SEQ ID NO: 64911 - DNA, 1042 bp, Homo sapiens
taaactggtctagaaatccagccacagttcaagttttctgggttgtttaaagtttcaactttaaagtttattaaacaacttacttccaaattaaagctgctgtataatggtttttttttttttttttttttttgagatggagtctcgctctgttgcccaggctggagtgcaggggcgctatctcggctcactgcaagctccacctcccgggttctcacctttctcctgcctcagcctcctgagtagctgggactacaggtccccgccaccacgcccgactaatttttttttgtatttttagtagagacagggtttcaccttgttagccaggatggtctcgatctcccgacctcgtgatctgcccgcctcagcctcccaaagtgctgggattacaggcgtgagccactgcacccggccccgtataatggtttttaaggtcactaatcataccatatgtttgattcagaataatttatttccaggttctactgggctattacaagttaattacaatgtatttgaacgagatgagtgtttctcaaacttaagcatgcatcagaatcacccagaagactcaataccaactacaaattgctgggttcccccagccaccactgagtttctgattcagtaggtctggggtagtgcctgagaatttgtgtttctaacaaggtgccagttgatgctgatgttgctggtttggggcctacagttttaaaaatcactgacgtaaaccaacatagggtctctgctctgcagagatctgattatatataatagtgaaacaaagtccttcccagctcagattccatggtgataaagttctttgtatacctcaatagctgagagatcaggaaatcctatattttactgataagggaaaaactagtgccttttaattaagtttttattgtcatcctgcagttttcttaataagttttggtatttcctcttatgagtgctgtttcttagaaactttgatcagacttaggatcctgctttcctgaagcttaggcaaggacaggggataggatatttataa

SEQ ID NO: 64912 - DNA, 1013 bp, Homo sapiens
agcaaatagaattttttattttaaaaatttttagcttcccaagcttatgagtcttcccttttcttcccttttaaaaaagagaatgaactatctgttgatcctcagagtattttgtgaggtaattggacacatcttctgcacctggggtcaggtctgtcatatcagtgtaaaaaaaaatttttttccctcaaatcagtagactgaaattttatacctgtttatttggaggcttatagatggtgtgaaatagttcatctaataataaaattgggtactattaaaagcctttaatgtcttagtgattatcttggttttatttacctccagtgttaggaaggaattgtggtagggttttcaatttggggtagaatggctaggcaagttgacatttgtttatggtacaaagaaaatagatcatttgacctaaaaaaaaaaaaaaaaaagaaaaaacaaaacttattaccattgcttttaaactggcttctgtggtttctgaatgccctttattagaatttaactttgtactttgtttcacaattttattattggtaagggggtaaggaactatgtatgttcataatttattgggattaagtgttgtcctgttaatttagatttatcctcattcactgtcctcttgacctttacaataataatagtttgtgactctgttgcattacctgaatatctgtggggtcttacttaatagtagcctgggaaacctgcaaagttttaatcttagcaagaaaatgggatcttaaaccagatgttagttttctgtcctcacccttgaactaacaaagcaaagctgttgacttgtgtattagtgaggtggtagctatcttgttcaagataaatggatgaagtacattaaagacaatatgcccatgagtttattcagaaaaaaaatactttttttccccttggggtggggagcagcatctcacgctgtcgcctaggctggagttttggcattatttcagctaactgcagccttcacctccagggttcaa

SEQ ID NO: 64913 - DNA, 1238 bp, Homo sapiens
gtgcctgtaatcccagctactttaggggctgatgcagtagaatagcttgaacgtgggaggcagaggttgcattgagacaagatcgtgccattgcacgctagcctgggtgacgagcgaaactctgtctcaaaaaaaaaaaatttatgtacttaaactggaatatatcttaaaagtttatttaagtcaaaatttgagacaaacttagaggattgtgagggttttgtcaagcatgcttaagctggtatataccttcaaaacggaatgtaattcttttttttcttttaacatagggtaagcttgatgattaccaggaacgaatgaacaaaggggaaaggcttaatcaagatcagctggtaaagatgttatattttttattttagacctaatgctcactattttaaagacaaaaattaattctgtggttttttgtctttccagtaaagtttgggttctttgtcattttaggatgccgtttctaagtaccaggaagtcacaaataatttggagtttgcaaaagaattacagaggagtttcatggcactaagtcaagatgtaagtaaaagaaagtatacatatttatgaaatacttttgttgtttctttgggttttagtccttccattactattgataagctctctgcaaggtgagacagttgtatccaattatatctaagatgccttcacattctgtaaagtaaaatgtaacacctgaaagatgtcttttaaaaatactaagtttgaaattgggggcggtggcatgtgcttgtagccctggctcctcaataggttgaggccaagagttcatggctgtggtgcatatgattgttcctgtgaatagccaccgcacttcagcctgggcaacgtgataaaaccccatctctaaaaaaaaaaaaaaacattaaatttaaaaatttttttaaaaggaccaagtttgagatttgacaaccatgtatagtagctatgctaaaggtctcattggtttaaaatgttagctctgcaaatacataaaaatcagatagtcattagaaatacataaatgttttttatttatcatgttccttatgtctaatgactcacaatttaaactgtcagaaaataaagaggctcgtttatataattggtaattattctctgctttaggaaccttaaggggtatggcaaactgatgtgctcctatatcagcactcgatccaacttaatagtgggtttttgatgtgacaaaaacctttgggaataag

SEQ ID NO: 64914 - DNA, 1028 bp, Homo sapiens
tttatataaagaacagaaatttgtttctcacacttctggatgctgggaagtccaagatcaaggtaccagcatcttgttgcattactgtgtcctcacctggtggtagaaggcttaagggcaagagagagtgatcatactcctgcaagctctttttatagtagtattaattcattctaaatagctcccaaaaggcccaccctcccaacactattgcgttgggagggttaagtttctaacacttgaattttagggggatgcattcagaccatagcaccaaaggagagatttattccacttagcttaatgaaccctgcccaatttctttttcttgcttttttaaaatagaagcaggattgctatacagtttaatgtaacatctattttggaagttactatcactgtgtaatgaaaatacctgtatccttttttgcttctcttgtaacactggtattttcaggacctttctctgagctttaacttcattagcagagctgttatttatctttgatcctttggtatactgtacacaattattaaacatgctttttgtttagcattcaagaacttctttagcctggctccagcctaccttttcacctttttccttcttgaactgttcatttcatacagaatagctttctttcttatcttcttttgctttgttaacttcctttcatattcctgtccctcttcctgtgtttcctgcctccacctacctataaagaccttcctgggcagggtgtggttgctcacgcctgtaaccccagcactttggaaggccgaggtgggtggatcacctgaggtcagaagttcgagaccagcctggccaacatagtgaaaccctgtctctgctaaaaatacaaaaattagccgggcttggcagcacacacctgtaatcccaggaggctgaggcagcagaattacttgaattcgagaagtagaggtgtcagtgagccaagatcgtgccactgcactcctgggcaacagagtgagactccatctcaaaaaacaaacaaaaaacaccttcc

SEQ ID NO: 64915 - DNA, 1468 bp, Homo sapiens
ttattgttgctgtggttgggtttcttttttaattggcctaggcctttacatttctgtataatttctaaattcattaaatttttactttttatatgcataatgaaaaacttcagatatatatacctaactaaagaaaacaatacaatgaaactctttgtacctgtacccagcttgtatatttatcatctcatggtcaatcgtatttcatataaatccacattcatttccttgctccctttgccctctagattattttcaaacaagccccaaacacattgtttcatcagtaatagttcagtagtaaaataccttctagggaaagagctgttctgaatttttaacaattgcttaaaatagattatgtttaaaactatttgtaagtcaggaatcatccttttgtgtattgaggtcatatctcactcattgagtaaaacatgttttatttaagctggacctgaaatggattgaactaagttttatataactaattttggtgttttacttttatattgttttgcagattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggtattagtggtatttgataatagaaacttctgagtatttaagttgacaactgaaaggttattaattagctatttactattaaaaggttgaatgaacagtatgaacatgcctccattcacctgtgggacctgctggaagggaaggaaaaacctgtatgtggaaccacctgtgagtatcactgtgataactttgattttataactaggaatctttaaaaactaattttcttatgtttatagttcacttggaagaaaaaaattagtttttttttttttttggagacagagtctactctgttgcccaggttggagtgtagtagtgtgatctcagctcacagcaacctccgcctcccaggtttaagtgatttctatcacctcatcctcccaagtagctgggattacaggcatgcgccaccacgcctggctattttttgtatttttagtagagacagggtttcgccatgtaggccaggctggtctcgaactccttaccacaaatgattcacctgcctgggcctcccagagtgctgggattacaggtgtgagccactgcgcccagctagttttcctatttaaaattaatattaattgaataaaatttagaaatgtatacatagcattcatctgctatttactgtttggtttatttcttttttgtttctttgtatgtttaatctgtaatgtggaaatcagaacaccagcaacaaaca

SEQ ID NO: 64916 - DNA, 2505 bp, Homo sapiens
cgggcatggtggctcatgcctgttaatcccagccctttgggaagccaaggtgggcatatcgcctgaggtcagaccttcactaggcaacatggtaaaaccttgcctctactgaaaatacaaaaattggctggacgtggtggtacacgcctgtaatctcagctacttgggtggctgaggaacaagaattgcttgaatctgggaggcagaggttgcagtgagctgagataacgccactgcactccagcctgggtttcagagcaagactgtatctcaaaaacaaacaaacaaaaaccccgtaaagtttaatataactacattcttcttgttccctatcattctgtaatacatttctgttcttggtgaaatgtaatctttttatgtgtatatgtgttttagtaacagttattttttaatcacaatattttatagaatgttggatcttcttcaagccaggcatcctcagataagtcttacattataattcatgttctttttcttagataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctggtgagtattaggtggatatcaactttagtttagggtcctggttttatttgattttgctacaaatttaaactatacacttacttagttttcatatatgtacactagattttatttttaaagagactttaagcatgacaaagtttttttttttttttttttttttttttttttttttggagacagagtctcgctctgttgcccaggctggagtgcagtggcgtgatctcggctcactgcaagctccgcctcctgggttcacgccattctcctgcctcagcctcctgagcagctgtgactacaggcgcccgccaccacgcccggctatttttttgaatttttagtaaagacggggtttcactgtgttggccaggatggtctcgatcccttgacctcgtgatccacccgcctcggcctcccaaagtgctgagattacaggcgtgagccactgcgcccggccttgacaaaatgttaagacagattatcaagagtaattcctaccagtattcattatatttgtcttagtagtcatttgtcttactagtcttgatcactattataaactgatagatagttcttttgcagtagtattgatgggcaggagtatgggtgagggccagctgttacaaggattttcaaataggtttctgtctgacatgcccagatttgctatttactatgccagtgcattggaggaatagtatgagttgcttttgttttgttttaatcatggggagattatagctccataatcttgaactataaattcctccaaggcaaggggtcttttccagttaattttatcatgtagcacaacactaattatatagctagacacttaactgtgaatacttttatgataactcttatgttgatgagtaaaattctgaatacaaggaaacattggagcataagttttgttagaatcagagtgcctgaatttaaatcttcgcttcaacacttactagctctgtaactttgggcaagttaatgaaactcttgtacctcaggttccccgtttagaaaatatgtcaagtgtgtatacagtgcctgacacgtggtaagcacttagtaactggtagctagtaggttgaaactagaagtgaagattgtacattggtggagttaatagttggagattaatataaggcaatctttttccccctcttaccactttactaagtaaagtaagatttttaatctgtatgctgcttcatactactacttatgagacgggagagggcttttaatatagtagctctttatttgcattatacattatctgaaatagctactgttgaacctaaagtaattctggaataaatggtaaagaaaactttctaaaatataaaacactgttaattaactttataaataagtttgtaagtaaattcagattatgtgatggcaaactatttacttatttggaatttaagttgaattcttttttttttttttgagacagtctctgtttgtcactcaggctggagtgcagtggtgtgatcctgactcactgcaacctctgcctcccgggttcaagcgattatcctgtctcaggctcctgagtagtggggactacaggcgcatcaccacaccaggctaatttttgtattttcagtagagatggggtttcaccatgttggtcaggctggtctcgaactcctgacctcaggttatccacccgccttggcctcccaaagtgctgggattacaggcatgagccactgtgcccagcctttttttttttttgagtcagagtctagttctgtcgcccacgctggagtgtagtcgcatgatcttggctcactgcagtttccacctccaagggtcaagcaattctcctgctttagcctctcgagtagctgggatt

SEQ ID NO: 64917 - DNA, 1451 bp, Homo sapiens
tgagccagcgcgcctggcctagttgaattcttaactttaaaaaagatttattacactttatggcatcatttctaaaaatagactttatttttattttttatttttattttttgagatggagttttgctcttgtttcccaggttggagcacaatggcctgatctcggctcactgcaacctccatctcccaggttcaagcgattctcctgcctcagcctcctgagtagctgggattgcaggcgtccgccaccatgcccggctaattttttgcatttttagtagagttggggtttcaccaggttggctaggttggtctcgaactcctgacctgaggtgatccacctgtcttggccttccaaagtgctgggattacagacatgagccactgtgcctggccgactttattttttagagcagttttaggctcacagcaaaactgaacagaaggtgtagagatttcccatttactttctaccctcacagatgcacagcctccctcattgtcagcatccccccaaccagagtggtacatttgttaacaatggataaacccaaactgacacattattatcacccaaagtccatagtttacatatgggtttactcttattgttaataattctctgggtttggacaaatgcataatgacgtgtatctaccaatatcacacagagtagagtagtatcactgacctaaaaatccttttgttttgcaccattttttaacctcttagaacctgagccagcagaagagtacactgagcaaagtgaagttgaatcaacagaggtatgattttaatttaatgctgcctttactttgctgcctttcaaacaaatgtctcaaacatttactttgctttgcagtatgtaaatagacagttcatggcagaaacacagttcaccagtggtgaaaaggagcaggtagatgagtggacagttgaaacggttgaggtaagagttctctgtattgcaaagttgttgtctttgtcttcagttagtaatttttatctctactgagaacaaattaagattgttttttgcattattagtacatttattataataacagactcattacaccagactgttacttccaaaaaatgaatgtttatccctgtggatgtttaataggatccctgctttgctgaaccaatctaaaaaaattattttatacaaagttatctgtggattaatctgttaccatgatttgtctcttactgaaattaggttgctctgtaaaaatctgggctcccacactgatagctgtgttttggggtatcatcttgcactcctcctttaccctaatgctgtttggtcaccaggctgtagacttcctctagcgttttctaatgctgtctctcaactgataatgatgatttttttcgggtcctcatgtctagttcagtgactctcttcatattactcctctctgactgcctccagaccatcctat

SEQ ID NO: 64918 - DNA, 1034 bp, Homo sapiens
taagtaaatcaacatgaaatgctacatagtggtcttatggaactgaaacactgtagaagtgatgacatttttcagaatgttaaatttggcataaatgtaattcatttgggtaactgcattaaagcccgttctgtttatagtatagatggtttatgtagtgtgggggacccatcatggtggtagtgagtggagcttttttgctctcctattccttctaatccttttttttctaccttaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggtatgttcattttagtcagactctgtaacagaaagtttaagtgtttatattatttgactttattctatcctaacttaacctgtaggattcaatgctggattttgaaaatcagacacttgatcctgccattgtatctgcacagcctatgaatccaacacaaaacatggacatgccccagctggtttgccctccaggttagtagtggtacatttttatgtgagagagaaatataaggccagtactttcaggttttaaaaagattgtgaaaataaattttgtttattttaatgactgtttaattttgactcttaggtcttttaatttgatagaaagaatgttattgttcctatgatttgaattaaaaatgtagtttataactgtttatttttaaacttttcattggcatgtagatatagaaaaatatacgcaagtttaatgagtttttataaactgaaaacacctgcagctagattaagaaatgaaacattaccagtaccccagaaacctacgttgtttcctttcaatcactagttaccctcacccctagcgatagcaaccacttccgtacttgtaactgtaatagaccagttttgtctgtttttgtaactttaacaagtgaaattttgcttggcttttaaaa

SEQ ID NO: 64919 - DNA, 2493 bp, Homo sapiens
tattaatttctcccttctttagcagttgtatctatttcttagccttatgcgtcttagaggtaacttgtttttttaacagtcaattttgtaagcaggaagaagcttttatttctttacttatgtctaggttcctttggtatcatccacaagtgaggggtacacagcatctcaacccttgtaccagccttctcatgctacagagcaacgaccacagaaggaaccaattgatcagattcaggcaagttctgttaccgggtcacatacatttgatgaggcacttactcatgaattgaacagatgtacattaccattaatataatgattcttctttttggacctactttgctttcatgaaatatttgagtttgttaatacatataagtttgagattaatttaccactttagtacatctgttcactttttgtttggctaagtttagtttaccgctaaagtgcatctattcactttgtgtttaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtaagcaaattaactaacattaattgcctagtatgtaatatgaatcatggtagattttcttttcttttttaaaggtcttcatttaactgtgcttgagtctgcatctttcattaactgtagggtatatttaattgaacataaactgattattccagagattaactgatactaacggatattctagagataaattttagccttatgagtgatgtgcctgtatcatcttaatttgtagttttacccttttgatttgattaacaaaagcttaaacattcagagaaatagactaatataacatccatataatcattacctagatttaatagttgccctgtttgcttaatcttttattttactgaagtattttgaagtttcagatgttatgctttaccttgattcttgagcaagcacctttagagaatttctagaaaataataataatactataatctgtggggtgcagctaaatcggtgctgagaggaaagttcataagattaaatattaaaataacttttgattaatatgttaataaaaatgaaaaaacattcaaccctgttaaagttcatagaacaaacttctgtaagtggtactgcatccaggagtttgtcttatttatttattttttgagacaaagtcttgctccgtcgcccaggctggagtgtagtggcgtgatctcagctcactgcaatatccgcctcctgggttcaagcgattctcatgcctcagcctttggagtagctgacactccaggcataagccaccatgcccagctaatttttgtatttttagtagagacggggtttcaccatgttggccaggctggtcttgaacttttggcttcagatgatctgcctgcctcagcctcccaaagtgctgggattacaggtgtgagccactgtgccaggccagagtttgtcttttaaaaagatttctcatatatgtaaaagcatttccaaggctgctgattgcatgtctttttattttttttaattccctacttccatttcacagcatattatactcccctttaagtactatatggtatatatgtctttttccacattgaatcacttggagggatttttgtatgtgtgtgtgatgtttttgtgtttgagacctctgtgatgtctttatttatgtctgaggtaaaaccaccattgagtttggccatgttataaaccagagaataaaaggatgaactaatcatttactttatttactaacaggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacaggtacgaaatccagtgtcacctcattggctccttgctttccagcacagttattgacagtgttaggacagtttagacttcagagtggtggtgtccaagagtttctgttttagtagcagaccatatgaatttttcatttcagatcatgagttaaattgagtctgtacttgtatatgtgaattatgtgcaatttttggaggctttatagccattttccttttgtcactgaacttacataatatccctgttgcattgtataatttatatggaattaaatttgttacttgaattaccataaagtgtacttttttttttttttttgagatggggtctcactctgtcacccaggctggagcgcagtgccgtgatctcggcttactgcaacctctgcctcctggacacaagcaatcctccctacctcagcctcccaagtagcttgggaatacacgcatgtgccaccacgtccagctaattttttgtatttttggtaa

SEQ ID NO: 64920 - DNA, 1809 bp, Homo sapiens
tttaaattttgggaatataataaaaggcaatctatgtaaaaagatgacaccgatgtagttggtttactaagtaattcaagaggagcagtggctctctctttttctctaggtattccctagtgctttcatcgtaaaataggattctaacaactattaatgtatttggagtttcttaagggtgtaaaataggtcaagtaaagattttcaagagtcatacagctgcttttctctctgccccaaaaggggagatttgggttggccagcagcttctgacccttgttgttagtgtgtgggccttcctttgttctgttgccttcctcacctcccaaaggtacttttagcaccctatttttttctcctctttgaattataaacattgttctgtagtattgaatttttgaaaatttctagattctagaactctgtccattgtggatggagcttgtatatatgttagtgtgtaccttagtctagaaccttcaagtgggttgagtgccaatgtgagtaccatgtgattgttttctaaattggctatacttgccattttaaatactttgaaatggaatttggcattaagggctacaagtcgaaggcctctgctgattaaactatgtagttgatgacatattctaccatctagctgcttaaatatgagagagtggttttgtatgttttactaagtaaaaaaaaggatatttaaaagaataagaaaacttctaccactaaggagctttataatgaaaagaagtaattaaatggtacaaaatggtaatgtactaagagtaaatcttttgagttattttgggtctcttgtgctaaaaagtagatgcctttcagaagacgttaatatagcctttcaaataatttgtttggaaggatcaatcatgcaccctgctttcaaaggtttggaattgtggttggagaattttacccccaatagctgagtctaagggtaggagaaaggtaagagactttattcatgtgtagtttttcttatcattgtatgcaaatttaaggattaaactttaaggagactgtataagacacttcttaaactagaaagtgcgtgggagaacaaacggtaatgagctgtttatgtatatatctttttcttttttaaattatagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtatttggtataatttgttatttaaataacagatcatggaatttttgttcatttggttatgtcaaattaatgtctaccactatctcctggaggataagtattttccacattaccaaaacttacggggattgtttattatatttgtacagatgtgtgtttacatgcatagatgggttaaaagtttatcttctgaggggcagttagtacttacagaaatttataaacagattggatcaagataggaaattggagattaatttgattaactagcctggcttataatttctagttcttcccgtcttcattaataaaaaagtaaaaattccttgtgaagat

SEQ ID NO: 64921 - DNA, 4323 bp, Homo sapiens
tgtctaaaagattaaggaagaattctgtattgagtgttagactgaaagaatagatgggtaagcattttttaaaaagtaccttttcaatactaactagcttgtcttttaggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaatgaatgagtactggtggaatactccattagctttactcttcttttagctaagagaacatgagcaaatttgcgcatgacaacttccaggacaggggaaacttgaacactgaagaattgacctcttaagcctaataatgtggtgacaggctgcccacatgcttcttgacttcagatgaaaatctgcttgaaggcaaaacaaataatatttgaaagaaaaatcaaatgccatttttgtcttctaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggttattttaccatcacagtttaaatgtatatcttttatgtctctactcagaccatatttttaaaggggtgcctcattatggggcagagaacttttcaataagtctcattaagatctgaatcttggttctaagcattctgtataatatgtgattgcttgtcctagctgcagaaggccttttgtttggtcaaatgcatattttagcagagtttcaaggaaatgattgtcacacatgtcactgtagcctcttggtgtagcaagctcacatacaaaatacttttgtatatgc

SEQ ID NO: 64922 - DNA, 2795 bp, Homo sapiens
gctgtaggtgaagaagtgctactggtgtgaagagaggaaaaggtttataaaagcaatctgatagcctcatctaatacacttctcagcttctgctactaatatcctacttttaacaagctgttctgaagcttaatccagttacataagcagtacggctgttttgagtagaggcagtggaagatcagcagtttgttcctgatcatctagcaaaggcatttgtgtattaatgcttatttggaaataccaattttaagtactgtgtttaatagggagacacactgtattaagcaactaaactaaggctttattcagcaaattagggtatcctttgcccagcatcatgccaagcactaggcatttagtggtgacaaaaattactgtggtttctgctttcattgaactgtctaatcaaagactgatgacaccaaagtgtagcagatgccatgatggagcaatgtggttgatggcagatattaaagccatgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttgggaggccgaggcgggtggatcacgaggtcaggagtttgagaccagcctggccaatatggtgaaatcccgtctctattaaaaataaaaaagtagccaggcgttgtggcatgcgcctgtagtctcagctatttgagaggctgaggcagaagaatcgcttgaacccgggaagtgaaggttgcagtgagcagagatcgcgccactgcattccagcctgggcgacagagcgagacttcgtctcacaaaaaaaaaaaaaaaaaaaaaaaaaaaaaaaaaaaaaaaaaggctgtattgtttggggtggggttggtggctcacttaataaagttaccatttaaagaacattcaatgcaatgaacaacatatatggaccaagagatggtaaggaggcttgttggagtggcccatgtgagaaatggattccaacttaaggtgcggatggggtggtggtagtgaatggattctatggattccctatctcactggtcactactcagtatcctttgctgatttctccaggtcttggatgtcagacttcatctctagctgtgttcttccctgggtgatctgatccaatcccatgattttgaatatgatcagcattttagtcctgaatatttctaggccccaaacctctcaaaactcatattcaacatcttgatatgaatttctcaatattccaagtcaactccttgattacccaacaccagttgttcattcatccagttgctcagagcaaatgttttgggtgccatcttcaatgtacttttataacctgcatctaatccttaagtgagtccacgtggttctaacttgaatatccagagttatcttatacttctaactactaccacaactaccatcctagcacaggtgactacaatagcttataattgttctcctttttctacttttgccttcctgtgatttagtttttgcataacaggaagccttttaagagggcaaagcagattttctcatttccctgtcccccacaaactccagtggtttctcatcatgactagaattaaattctaaatctggtccttcacttgcccactgctttggccacactgactgctttgccaggactcccccatcttggagcttttgtatgtacatctttggcacggggaagtttttcactcatattctcagggctcattctttctaaatttcaggtccttgttccatccagtgtcaccccgtcagaggccttcagtgttcgtttctaaaatagtatccttagtcactttactcactggatacttctgcttaatagcatttaaaacttaacctagaattaaccacgaggggcaggaacattttggacactatcccttgtgagcagaatagtgcgtgggcatattcacattttgctgaatgaactaaaaaatttcatgatggatgttggattaaatgggtagtgctgctgatgacattaaaagtgtatctggggaaggggtttggattcagacatttgcggtatccaggaggaaacatcaagcagttgataatgttttttgaagttcagcgatctgccccaaagtcaagaatgcaacactatgtataggttgtccctgtagtcatgttcttggagttcactggaagcccagggggagtaatttcatttgacgaccatatacaggcctaatgggagcctgcaaagtacagcggccgcagtcatgggtagattacaggattcccatctgtaagatcagtactgtgggggtggagggccaagcgaaaccaataaaataggtctgttggccgagtttcctcaacttaacggggatcggttaaattgaacacaaatcgttggatccgtcgcgtttcgcgtaaccaggctgacgctgaaaaccctggacctacgtgggcaggccctggggtgcggacatctattttgcccttcttagccgaggtactttagctgggatatgaagagtgaagaggcaaaccgcagccaacaccca

SEQ ID NO: 64923 - DNA, 1266 bp, Homo sapiens
aggctctgcatccggacggatacctggcctacgccgtttgtcctccacccctcttttggggcgctccaagataacagaatcacctctccaatacgcagccgctctcggcgcgtgcttctcgagcgtcctcggggatttgcgtggctcgataaccacctctaagtagtgcctgtaactggggagtcggggtgaatgggtgggtgacaacagttgttttccgtggagcttgcccgcagtgcctggctgcaggtctgggcattatacttagggtaatctgattccagatccttccacgttcttaaatccttcactgtgcacattcctttatactctttattcagcagtcacattcaggacttggttttgtttgccagtgcacctaaaatggtgcctgccacatagatgttatgtgtagatagacgaatgagtgagcgaaaaataatcatctccttcaaggccttccccatccaggccttccatgacagcttcagcccatagtaatctcagcccttccttcatctgaccggtccctcagtatagctattttttttttttttacatctaattttacctgtgttcttgttcctcatctcattctcttaaataccttcttcaagaagaatgcaagcttgaagtcaagggccttgtggtactacttctggggctcccacagtagctagagcaaaaggcagcccccattaattagttgttgattgatttttgcgggatctttatgtggccggcaacacaaggtttacaagttgggaagattggcgaactgggaagagctcaggctttggagtcaggaagacttgagtgtgaattctgtctgtcgtttttctgcctcgggatatttgaattctttatactttctcctttacgtataaattggggtccttgacagtgacttagtgttttatagtaagacatatgctaaaatctgtttggattggaaggttagaagggacagttaaggtatggtaagtttcagtaaatgagctttatgtttataatgcagtaggtaccagagtttctaagtagcatgtcacttttacatctaagtagcatgttacttttacagtgatatttctgatggtttttttgatgtatttattgggatgatgcagtattttactgtaggtaatcacagaacttttttttttttttttttgagacggagtctcactctgtcgcctaggctggagtgcaatggcacaccatctcggctcactgcaacttccgcctaccggattcaagtgattctct

SEQ ID NO: 64924 - DNA, 1472 bp, Homo sapiens
gaccatcctggccaacatatgcgcctgtagtcccagctacctgggaggttgaggcaggaggattgcttgaacccaggaagcagaggttgcagtgagccgagatcatgccattgcactccagcctggcgacagagtgagactccgtctcaaaaacaaacaatgctttggatatttggatatctccttatgtattttagtcattcttctacttttttgaatatacaagtttctggcttttaaaaaatatttaatagaggtgaattacaggctttccaggctgagggaaggttttctcacctcccaagcctaaggtttcctgagtttaaaactagaggctgatgtcttcctgtggagctcgtagagggttaagtaagacaatacttatagatatgcctagcacagtcccaggccccacaaaaggcagccagctaatgttccttagacaatctagtgcgcatggccagttgtatttctttctcttttagtaataatttttcaccatgcatcggaaaaaggtggataaccgaatccggattctcattgagaatggagtagctgagcggcaaagatctctctttgttgtagttggggatcgaggaaaagatcaggtatggcctggtaaatgcttcctgaattactttttatcttgtccaaagaatcagcatgtttaagcactctgctgtttcaggacataatggcattaagatctctttggctggtaagatgcctagtgggaacctttctttatttcctggaagtggtgaattctctgtatttagattgattcgcagacaagctaataccttttgaagcctggggtggtgggttgaccacaaagtgaactgtatgtgacctggcttctagtccaaacctggtcattgctcgccttagaaccttgggcacttcccttccctggccctcagtttagtttccacatccgtcaaatgaggtcttaagcctggcggtctctaaagtctcttttgtgcctgaaattctgtgacttttttgtttggcaggtggtaatacttcatcacatgttatccaaagcaactgtgaaggctcggccttcagtgctgtggtgttataagaaagagctggggtttagcaggtaagctgggctcttcatgtgttttatccaacttacaattcctgctcattagttaaatgccaggaaatgattccttcacatattttttaagggtctttagtggaggtgctatctctgaggacaaatggagctgatatcctttcttcattcctgaaaataagtttcaaatcattttcatgctttttaagtcaccaatccaatgccttgccttctgcatatggttttccttcctgcttttctaggctgattaagcccatctcattgcaagttccttcaaactgtctttcctacctcaaatttattccacttttcactctctctctttttctccccttctttcatggagggggtatatgcctcatcc

SEQ ID NO: 64925 - DNA, 1329 bp, Homo sapiens
accagttcactgctgtatttgacagttggctatttgaagctgtggtagtcaagacttttagtcatagataacatactttcaacacaaatacaatttggcacaaagggatttcattgaggtatatgggatatttcctggaatccaaggggataagatttcagctctgctcacgggtgatctagagtcacagtactaatgctcccagctcagtttgtcatctcagtgtatctgctctatgcagaccaactttctcactgcagaccagctttctgttttctgttgtccccctagcagaaacaacacttgcgttttccttgtttcaggcccagccatgtggaaatcagactttttcccaaaattctggtggaaaaatgcccacacctggccagaggagggtggggttggtcatagcataatacaaagttggaagttctacctacaactttgtgtttggagaagtttggatggggtgggtagtgctgttccttggcagataaccaccatggcatcacctaagaaatagtctccttttttggcttcagtgtctttactcagaccaccttccggagctcttctctttctctggatctcgtctccttactctaaacctagctggcttgtgcgattctgtccttgagcctcttctaatttccaaatgtgctcatctccgatctgactctgaaagcctgtctccagctctggttgctttatgctgtgactaacctccctccttttctttgctcatgctgtctcctctgcttggaatgccacttccacctccccggtatcacctattgaaatcctgtttctcagggcctgcctcctccgtgaaacttttcctgagccccccagtcatacctggtggttcctctaccttcctctgcacttgtccttctcctataatgtttgccaatggatgcttttgctttagggtaaagtcacttacatactgtgacttacgttcatttttttttctttccctttttttttttttttttttttttttactttcaggtgataagcttatttagttaggagccctcttctatttatctttgtattttcatacttttaactgatttagcatgtttatcataggtactcagtatacattgagttggatgtgttgttaacaggctctaaaattattttaatttaaattagtaccagaggctaaacttgcccctgtcctgtggtcttaaagtgaagggattctgcctaaaggaaaccagacaatcataagagccttactgatgaaatgtgaaaagtgcagaaaacccaaagatgaaaataaaaaacatctcactgtctaggcattgtcagcatcta

SEQ ID NO: 64926 - DNA, 1053 bp, Homo sapiens
tcttatgtaagacctgcccttgaagacataatcccacattctcggggaggaagtcctctaggaaggatgaataaagtaacgtgccatcaccttgtctttcctaggatctctggggaacagcacagtgtagttgaagcattggcttatgactgagataatgaggccactcaggtttggtttcaagctctggctttggccaaatgtgagggttagctaccctattacccatcttttaaagcaaagtatttgctcaaggtcacagggcaaaatagcagagttcacacatagacttatcacttactccaagcccttaagcactctaatgcctctcatgcctctccactgccctccacctgaagtgggcctcacactttcaagttccctactagctctgaaagtctaagtgggtgatcactgagcctttcccctggttccagctctttagctgctctggttaactggctctcatgggattgggggtgtgtgattgcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggtgggtggcttcctctaacctgtgattgaagtcagagtcttgagggttgcttgggctgcctggctttccactgggaacagatgtacagtaaggagaggagagtcccatgttccctatgcccaagcattattagtggaagtcctggccactttccaaagtacactcggtcacctaccccatataaaaagagaattttaaatcagcacttgtctagagacaccagaactgaagtgatgagttattataacgggttctaactagctaaagctgataaagcaaatgccagagactttgagtgcctctaggaccctaggtccttattggcattcaccaaagactttttttgtccagtgagcaatgggacttgttttccaaccggatatagacc

SEQ ID NO: 64927 - DNA, 3624 bp, Homo sapiens
cctcccttccccattctcccaaaaaagacaagacaaaattaagcacaaatcctcacatttttgtgtgtttatcatatacacttacaactgtgcccattattatgtcaagttacataccttgcaaaatatgggttgtctcctatactgctggcttgcatctcaccttggaggccaagaaagagggcattatgcctcattttcacctttactcagggaaatgccctgggttatcactgattggtagggagtggtcttctacttgctgccatgatcaattgcctgaataatgactcctgtgagcagtagctcccccatgtagtatagttttgtcaaacaggtttgagctataaatgtcagaaaatgtaagatgtttctgaaattcaagtatgaatcagtgaaggttggaaaatttgtttccaaataggattttatcagagacatttttgacatataaaactaacaacgtctctaataagagacccgtttttggcatataaaaccaggtattcgtatattcgagggtttggccctcttctgtggtacccctgtgtgtgtatcctgggaagtcaaggtgggaacaggtatggtcttggctttgtgctctgaagtcttctttttgccttatcacctggcttttggttaagagtcccttgggttgggccaggcgcggtggctcatgcctgtaatcccagcactttgggaggctcaggtgggtggtgagccaagattgcgccactgcactccagcctgggcgacagagcaagactccatctcaaaaaaaaaaaaaaaaaaaaaaaagtcctttgggttgctatttgcatgaccagccctttctaacgcccccttcttccaggattttgaagccttaactccaaacttgctggccaggactgtagaaacagtggaaggtggtgggctagtggtcatcctcctacggaccatgaactcactcaagcaattgtacacagtgactatggtaagcatctgttttttaacttaattgtgagggttcaagtaaatctgtttttgctgtgttctgctttctttaaagaattcctgttgggcagctccagtgagtagtcagcacagcctctgggctaagagctctttgattttaactaatgaaaaagtcactacagttaaatctcagggtccatgagtatgcctaggaatctctgaatttcacctttgttttcaggcacttgcaaattctacaccagtgagattcagatatgatacagcttttatgtagttaaattttctggaatgatattgtacaaggagcaatgccagtgcctaaatttgtgtattgcaaaaaaaggaccatgtgcagactgctcactggcccttatcctaatggatgacgaaggaacatttgccagttgtactccagtttggcaagaatttcaactccagcagagattgtgttctcccaaagcaaaagacactgactgaggacatggtgaggaattagggatatgtctcacctgatgcagagctggtctcctcactttatcagcgttgccaagtcagtgttcagaggcaagttttaagtcatgcccatgtccagcagctcagtaatggtggtcggattggacttagggtttcctgagctgcatttatctgatgaaatggactttcctcaaatcttaggggctgtttcctgtcattacttctcccttcatcacttgcactacagcccttttggcctcctcaaatgtcctcagacatgcccagcacacactcctgcgagggcctcggcacttgctgttcccactggaatgtgcttcctctggacctctgcctggctcgcttcctcattgcattcaagcccctgctcagatatcacctcatccatgtggtctttcctcacaccctgtttacagtaggcagctccgcctgtcactccttaaccggctttatttttcttcaaagcacttgacaatgacctaaagttattattattatttgtctgtcctcctgtactagtctctaaatttcactggagggccgatcacagtggctcacgcctgtaatcctagcactttgggagcctgaggtgggcggatcacctgaggtcaggagtttgagaccagcctggccaacatggtgaaacctcgtctctaccaaaaatacaaaaaaaattaaccaggtgtggtggtgcacacctgtaattccagctactagggaggctgaggcaggagaattgcttgaactcaggaggcggaggttgcggtgagctgaggtcacgccactgcactccagcctgggcaacagagcaagactccgtctcaaaataaataaataagtaaataaatttgatgggaacagagagttagttttctttgctgttgcatttccagatcttagaagagttcctggcatttagtaagcattccttagatagttgagagtgaatgaatgactttgtgctcacatcagtttgttcttcctctccctctgacatagctacctacttacccttcaggcctcagcttatctcagagaggccctccctcactaccctacataagtgacccccacttgctatccgtgcagtctatatttcatatgtagcatttgtcaaaatttgtatttatctactaatttttcttcctccatccattatactccaagtgccatgagaacagaggtcatgctttgttcattagtgtatgcacagcatatctggcacacagcatgccaattttatgaaataaatgaatataacttaggatgctaggaaaaatgtggaaaagtgaaagattttaataagcaacgttgcattcagtgtctgatcccagtttcagcaaataccatttggcacagcagtgtgtgtgggagtgattttgtttccagcaagattgcccatgtctccttggatagagctttgtatttggaccctggtcctcagcactgtttgcatgcctttgttaatggatgttgtctttctttgttaggatgtgcattccaggtacagaactgaggcccatcaggatgtggtgggaagatttaatgaaaggtaattctatagttccccccaattgtggggcagccacattgggagggacatttttatcttggactcaactgaaaactttgcttttatattggggaaagtagtacaatattccaaaaatgatgagattcttgacagcagcagcagttgtgagactaactggaagcagtgaaacgtggtggaaagttggagccaggaaacctcaattttgtcttgctgctggccttgacagctcagttaaaccaggttactctctctggttcttagcttactcatcttttaaatgagtgatttttctggatcactgcttcccagaagatatttcatagagcagtagtctttccaaactttttattatgaatatgacgtactggcatagtaaaaatgattaagagaaatatgggaggtggggtgagatgtaattagaggcagaaaaaggcgacaaagtgtttcttctgagcaaaggaacacccataatttcaaatatggtgtacggtttgttatctgaaattaaatttgtatgtatttatttttattttatttatttatttttttgagatggagtcttgctgtgttgcccaggctggagtgtagtggtgcgattt

SEQ ID NO: 64928 - DNA, 1059 bp, Homo sapiens
gcatgtgcatgggcctgggggaggggtgtccctccggtgtcctaggcctggcagggaggctgaggggctgaagcagggtgagtaggggtggaggaggagatttttggaggatctttcaggccactggcagggctttcacacttactctataacagatgggagcagtggaggcttttatgcccatagtctcctttcagcacagctgccagaggcatccccaggcttctttttaagaggatcgtctggctgctgtgttgaatatagactggtggagtgagggtggcagcaggaagactgatcaggaggctgctgtcatgatggaagaaggatagggtggtggctttgagcagagcagtagaggaggatagtggtgtaagtaagaaatggtaggattttatatatgttttggaggtaacaggattcgctgacgaatcaagttatcagggaagaattgaggaggctttggcccaagcagttgaacagttagatggggaagactaggtggaggaggtttggggcaactttaggcgttcagtttaaagtttgagatctgtagtgtacaaatgggaatgtacaggaagcagttgcatgtgtataaaagtctggtgtgggccagccaggtgtggtggctcacgcctgtaatcccagcactttggaaggctgaggtgagcggatcacgaggtcaagagattgagatcatcctggccaacatggtgaaaccccgtctctactaaaaatacaaaaattagctgggcatggtggtgtgcgcctgtaatcctagctacttgggaggctgaggcaggagaatcacttgaacccaggaggtggaggttgaagtgagctgagatcatgccactgcactccagcctggtgacagagcgagactctgtctcaaaaaaaaaaaaaaaaaaaaaaaaggtctggtgtggaccaggtgccatggctcacccctgtaatcccagcactttgggaggctgaggcaggcggatcgcctgaggttaggagttcgagaccagcctgcccaacatggtgaaaccctgtctctactaaaaatataaa

SEQ ID NO: 64929 - DNA, 2864 bp, Homo sapiens
gggtagtgtgcagggttggggtcagaggactggtatctcacgttcctagttctgagttctgagtgggttcagtgtgtgatttctctaggtcttgatttcctgccaggaaacagcagcactgtttccccaacccaccctaaaggtgcatgtttacttgtgtgtacacacagacacatatataccagggcctttgtaatcactatttacagttgaacaaacatgcagaggcaaagaaatgggagtaagaaactttacaactcagggcatgagaatgtgtatgaccagccttgctgactgagaaaagtacaagtttgacattttaatgattttgattaaaagaagctttctttggcttctgaggagctggttttaggtgtgatgttagtttctgtttttttctactgggtttggaagatacatgcagctgccaatagagtatgttcttccaacttctcggccataataatgaacctagaacttactgtgtttgcctttgtgcattatcttccttggtgctctttagagctctgtgggcattttatagatgaatcaacctaggtttggggagttccagtgatttacccaagatcccccagcaagtcagtgctgatagagctggggcttgagcttagctcctgactccttgtccttcgttcttcctgctgctctagctgtaacagtcagcctcttagccattagcatctgctgttagcatcctttatactcagcaaggcaaagctaacttggaggttagctttggccttggcctgagcaccgattgagctccccagcttcaccatttgaaagcgtcagcacagctagtgatgagcatgaaactacttcttgtagcagtgcactggattgggaagcagtctgtctgttctgcacaccgagggcgttgtctccacagtgcttctaagcagcttgctttcacagatgttggtagctaaatgtctggagttgctttactttccttcccaaaaggtgtcctgactttttcccttgctgttacctctggttatcacctttgggacaggagcaaacaaaaatattttcttttttaaattgtttctttaagatgttcctaatttcttaaaaatccttcttttattttgttctgtaggtactccaatatctttgttacctccccaagccctgataacctccatactctgtttgaatttgtatttaaaggatttgatgctctgcaatatcaggtaggaaatttggattaagaatttttattttggacctggtgtggtggctcacgcctgtaatcccagcactttgggaggccgacgcgggcggatcacctgaggtcgggagttggagaccagcctgaccaacatagagaaaccccgtctctactaaaagtacaaaattagccgggtgtggtggcgcatgcctgtaatcccagctacttgggaggctgaggcaggagaatcgcttgaacccgggaggcggaggttgcagtgagctgagatcacgccactgcactccagcctgggctcgaaactccatctcaaaaaaaaaaaggatttttattttgatacagtgctgggtttaaatccaagtgaagtctttagaatacttgcttactttcataatatttagtttctgaaacttgtttctaaagtttgtcattggtttgactccccaccaggaacatctggattatgagattatccagtctctaaatcctgaatttaacaaagcagtgatcagagtgaatgtatttcgagaacacaggcagactattcaggtgaggcttgttctcagaccctgatgtgcagggccagtgtcttgctgtatttaactggctctaagatgtttcctgttatagacatgtatgtcttgtgtaattgcatgtcttttagacaatggtggtgttgtatgctaaacctgttccagattttcagactcttctaaagaaaaacattcagcaaactaacaaatatatgtagttagattgaaaagttgtgtttttgtcctttgaatatggaataagtggggtggaaagtacgctgattaactaaaagagaatctttcttctgacatcagctctaactttgcttagttattgcagtttttgaaatgttgcatctgtaactagaacaataaccttacagcttaaatgaaaaaaagaactttgcaaaatgtgctctgaatctttgtggtttagccagtggcctattttcttttttaaacagtgttttcccaaaagttctaaaaatctctagcactctgtaagcctgaatggtctgcacttgtccaaaggctgcagttttgctaaatctctaagagaggcatgaggtgatgggcttacagacggactgagactaatgggctcttactggaggaggttcattgattatttttggaattgggttgggaagtgagccaggtgaatttggcagtttataccctagcactttatgcctgtcaaagcatatgtatatgcatgtcaagaagttatacctttttatcagaggccagattataaacaatgttaagtgtttatgcctttcaccttaattttttcttactagcctctttctagaatctcttcattctgtacatttctgctcacttttgctcgattcccccagctgggaggaggaaaggctgctgttggtgagggtcaggctgcaggcaatgagaacacggagacctgttaaaactcaagaaaaatacacaaaccaaagaaggaaaacatttccctgaaataccctgcctcgggccttgctccttcttgaatttgtaatcaaatactctctcatattaccagagttcttttgtctccagtgtgagcacagaggaggtgaccttactttatgagactccatttgtgtacctttcaggcc

SEQ ID NO: 64930 - DNA, 1712 bp, Homo sapiens
gaggtggtggatttgttttattttccaaactggaaatgttctcagttcatttccttatgcaccgtacttctaaaagcagctccgttagttgaccatttaactttgttccagcttcactaaaactgcctaaagcctttatgctaaaggctttacttacatcctttttccagtccttattttttaagttcacatcacagtcctgtgaggtgtatagaataatcccctcttgaagatgaggcgaaaagagattcagctccttgcccaaagatactaagtagatgagccaggacgtgagcccaggcctgggtggccccaagctcagccaccgtgccaccctgcctcctttggacaggtgcctgctatgctggaagttcagagatgagcaaggctgtcctgggggaagcaggggtctggtgtttcagcaggtggaggaaagcagctctctgtcccctcctagacagtggatttgggaccttgtgcctgattccttttgcctttgtttctagctatgagggcactggccggtcactgtccctcaagctaattcagcagctccgtcaacagagcgcccagagccaggtcagcaccactgctgagaataagaccacgacgacagccagattggcatcaggtaccccagaacctgacccgggtcccgcggttcacagcaaggcccttcagtcttactgatcctcgcttcccctgtgacatcatgggaagcaccaaaccttcccaccatcaggctgagaggttgagtccccaagaggagaagtagcttttttcggaggaacagcagtccagtgaccagatgggagccagactagggccttctgatggtggggcccttgtgtgtccttgtctcagggcatggttgcattgagatccctttggggttggtatcgtggcaagttgaatatccaccaaaaacaattttaaaccacccagtttaaattcttaccacacgtctctggccaccatgggacaaatataaagtgaaacatttttccttgcttttttagacaatacatatttaatcattgtttcttcttttgtgtgtgtgattgtggggagcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtatcctcctctgggtttcactggccctgtgaaaaggagaggggcggtgaaagaattcaaaggacttgagtcctttgtttcataggatgctgctctagagaaaggggaaagttgaacattttcaatttcctttttctcttccttttttttttttctttcttttttttttttttgagatggagtctcgctctgtcaccaggctagagtgcagtggcacaatctcagctcactgcaacctctgcctcccgggttcaagtgattctcctgcctcagcctcttgagtagctgggattacaggtgccagccaccacgtctggctaatttttgtatttttagtagagacagggtttcaccatgttggtcaggctggtctcaaactcctgaccttgtgatctgcctgcctcagcctcccaaagtgctgggattaccggtgtgagccaacgcgcctggccctcttcttccttcttttatgtgtttctgcttagga

SEQ ID NO: 64931 - DNA, 1711 bp, Homo sapiens
agcagggagcttcagcatttggcagtccccttttacttgatttgcatattttattacccaatggcttaggtgactgttccattgggacattgatgagttccactgatcttgctgtgtgtaggtatagagcatgtagctccatgcagtaacgggacagggtggaaagctgtgtccatttttaaaggagtgctttcatttcttgcctgcctactaaactgataggatgaggtgacattgcagttgtggcccggtggtgcagtttgacctgagaccagctttatagctctgggctacttttatggaacagtgaatttgagggtttagaatatctgagactcttaaaaacaaaagggttggttaaaaaggatactttttgaatgtctagatagtatttttatgaacagcttttaatggaaggcttgaagagttggtgttagaagtggtgacagtttttcctgaaatagcagcctcttatctgtaaaaagttcacttcctagctgtgaaataagtagtgctaaataaattctcttcttctgtccagcctcagtgctcggggtgagaggacagtaggcatttgaggctaagttccacttaacctgttatgaagagtctcaggcttgccaaaatactagaaaggtgctttgctggacttctgctcctcacttggctttggagaaggccatactgcagtcatcctgtggttctgaatcgaaccttttgcgtaaagggcaagaggaagagtgcttctcactgacccgtgtttggcttccacagaactctcccaatgatctccagatgctctccgatgcacctgctcaccatctcttctgccttctgcctcccgtgccccccacccagaatgcccttccagaagtgcttgctgttatccaggtataggagcagaggcgtccttgtggcagtgatttggggaaccactgaggcatcaggaattagtggcttaataactgcattgtgggagttttgaaactgtggagtcctggtctggaaccaaggggctgggtctgctgagacaggtgactagggtgcactggaagaggttagcgccactagacacccaaagctccactgttgacggacggggaaaagccagaaccgaccgctctcttattttgactcacagcttcttccacaaacagacttgtttgttttctccctttattacaaaagcaatacatggtgcattttgaattagaggctacagattggggaacaaatttttaatgcctagcatggatgtatttatgcatttctatatcacttttccttttcatatacatagtaatctgcttttatttttaggcagtgtataaaacactcataatctacataagttttaaagctgtgtagtatttcattatatacatgtaccatgatttgttcaaccattcacctgttagacattttagttattttgaacttgtgctgttctgtacagagcctcatgagcatcctgtgtcttgatggccttcacacacgcacagcatacatagagactctcttctaatgtggcttttactttttgggtcaggaggctgtcagtcttctgccctgtaacatggggcctggtaattaagctcctgttaagaatggatgtgtcaggccaggcgccatggctcacgcctgtaatcccagcactttgggaggccgaggcgggcggatcacaaggtcagaagatcaagaccatcctggc

SEQ ID NO: 64932 - DNA, 1001 bp, Homo sapiens
ctcaaaagagcggggggaatggatgtgtcagtgtcagggttaaacctgaacatgggggtggaaacaactggcctagttcgagaaacaagctatattctgtgagtgggctctgtatcagagttggcctttctgcctgcactgtcctgcttcccccacaggtgtgccttgaaggggagatttctcgccagtccatcttgaacagtctgtctcgaggcaagaaggcttcaggggacctgattccatggacagtgtcagaacaggtgacgggctttccctggtgtgtctgagggaagctggtggtgtccaaagatgtctgtgttgctaagttactggtttgtgtctcccacacagttccaagatccagactttggtggtctgtctggtggaagggtcgttcgcattgctgttcacccagattatcaaggggtaatgtgtcctcaggctcccctgaagccgtgttgctggcggtgctttagggtgggggtacttggtggctggaataagaagctggtcaagcagaagcaagtgaagtgtaggcacttccctgctctggagaattgagccagggttcggggtgggtgggtggacaggatgatggcatatgctcactcttcctttgtgagaacgaggacttgtgaaccagacctgcataacaaaattaccttcttagaacacctcactgagtaattggctgtagaaacttccttttcaggcaatggtacagaaactgcctctcatttgggcttgcccatctggagaccagaaagcacagccatccttaccctcaagtggctgttcttgatgagctagaccagtgttaagaactcgggtcacactactttcagtcttaagtgtctctgctttgacctcactcagggttttcattggttctcttgccccgtgctgtttgacagggagggaaggttctctagaagcaatgcaggggagtcactgtggcttagactgagagcagctctcttccctcggcctcttccccttca

SEQ ID NO: 64933 - DNA, 1069 bp, Homo sapiens
tttgtcacttcctaaggctgtcaggtgatagaacctggacttcatgctggatcacaggagcctgcctgtccctttgtaaatctgttgggcatttttttttttttttgagatggagtcttgctctgtctcccaggctggagtgtaatggcgtgatctcagctcactgcaacctctgcctcccaggttcaagcaattttcctgcctcagccacctgagtagctgggactacaagcacacaccaccgtgcctagctaatttttgtatttccagtagcgatggggttttgccatgttggctaggctggtctcaaactcctgacctcaggtgatccacccgcctcagtctcccaaagtgctgggattacaggcatgagccaccactcccggcctctgtcagtcgtttctaaactctttggctgtcttcctgcattctagaggtctgaagcagtgtgattctatgcatgttgaggtgttttgagaatgattgcttgactccggtgttctcatagtttgaaaaccacagcaataaaccaagaaacctctcccagtttttgttgtgctaagtccagagtgcgctgcggcagggtgcttgacgatgtctctctccctctgctgaatggactgtgttctctccttggcatcttcccaggctgtcagcttgttggaagaggtcatcactccccggaaggacctgcctcctttactcctcaaattgaatgagaggcctgccgaacgcctggattacctgggtgtttcctatggcttgacccccaggctcctcaagtaagtgcctgccctccttccacggcatcactccttggcattgagaaagaagagttctgtgggctgtgtgtctctgttggtagctggtatcggtgctagcctgctatttgtggcgtgctcttcctggctcttgcccttgtgtgtctatcagccactccccagaggccacacacagtgacctactgtctttgtatctttgcaggttctggaaacgagctggatttgttcctgtttatctgagacagaccccggtgagtgaggcatccagcagaggagaagtttaggtt

SEQ ID NO: 64934 - DNA, 2864 bp, Homo sapiens
atagcatgcatatatgtgtatatgtgtgtgtatatacttttttgccaattatattttgatggagaaatccgtatatcttgagctgggcagagcttacacactttctgtgacaccaaatgaagtgacaaagcagggaaagagtgtagttgtgttcccctaaccctgggccacagggagcttttccttggtccatgtgttcagtatgggaactgagcaagggtcctgtggcagccgtcccctccccacacgtggcctggagccgccccttctatggcaggagcaggtttggtgcccctctgggccagggctgtgtggtatggctgccaggccctgttagatgctcctgtgtgttagggtgccgcctgggggctgtgtgctatctcatgagggcgccgggtgacctaacctgtctagctctctatcccatggacagccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggtatgctatctgttgcttgcgtggaggagaagcgaggattgtggagctgttcatttgctgggtgttgggttgggcacttggacataattgtgtgcctttaattcctcatacatctgataggtgggtagtggcatcctcattctacaggtcaggaaacctgggctctgaagtcgagtaatgtgtccagccatacaaagtgagagagctgcagcttccaccccactacgttgccttgacacttaactccaccttagcagaggttcaggaacatcccaaacttttaatgtagttgtgaagcaggtatttgtcaggataaaagttactttggggattttaggaagacagcatttcttggtggtctcagtaacaggatgaaagagaagatgccaatatacacagtgctagtctacctttgtaccaatagctttggtcaagagagtactctggttcttggcgccattttaatgggcaagggcgtgtcctagaggcccacccagcagattttccatcctttaggctcttctcttggggattggcctgcagcataagtctgtggaccagctggaaaaggagattgagctgccctcgggccagttgatgggacttttcaaccggatcatccgcaaagttgtgaaggtaacctcagcctgagggcaggggcttgatgtctctcaaatagtgcaacaaacccactccctgctcccgagatgaacacatgttagcatttagctgtgtttgctgcatctcgtcacacacacacacacacacacacacaaatccaggacttcagaacacatgttagcatttagctgtgtttgctgcatctcatcacacatcacacacacacacacacacacacacacacacacacacacacacgtgcgcgcgcaaatacaggacttcagctctaaagaatctgtgaagttctgtgtcctctcccagaggcatccctattaggaatttggtacatatccagtctgtgttcttcagctcttcccgctaatatccacattcctaaactgtagagtgttgctttgtgtcttcaaaatgcacacctttctataagacaccaagtgtctgggtcacgggtgactgggtccctgctgctccttcatcttctgcttctctgttggttgtcttttgtagctatttaatgaagttcaggaaaaggccattgaggagcagatggtggcagcgaaggatgtggtcatggagcccacgatgaagaccctcagtgacgacctagtatgtccctgctcatggcctcgggagtcccagcatttccatcagttgccttaggctgtgaattcagactgtcttccccttcccctttagaaagagtcctctgcactaattgagctaagtgctattctgtaggtttaattggacaaacggacccagcattgtctgagcacacacaggcctagagttgtgcctcccactgattgtgtgtgtgtgttgtgaatgtaggattccagcatctgttggaaatgttttgtcttttttggtgacttcttaaatgcatagtttataacagagctaccttaaaataatcaaagctgcctacaaggtttttgcaggtagatggaagagaaggaaatgttttctcatcattgtgccattccaccccagcttcaccttttcctgtgtttggttcaatccttgactctgacttagtctctttatgggtccttaaccacaggatgaagcagcaaaggaatttcaggagaaacacaagaaggaagtagggaagctgaagagcatggacctctctgagtaaggcttgtgggaagcagagggtttgccttggcttctggggccctaagaatctgcctacacgtttcttctaatcatatcccacgtgccctggaaagtgtctttcatgggatcagttttagggatgctaacagttctatttgaccttctaattgcctgtttgtataattttggaagagttgggttccggagactagtgccgccactttgacttacacattgcactctctgatccccaaggctccaggtcacacctcgggtccttccaggagtgggggtgccgattggatgagcaggccctttaatggttacttactctatttggcttttacgtgtgactttgtttgaagaaaggattctactgctaaaaccaaccaaacaagcaaaacaccccttgctctaaaaccgtctgggaatcctagtcccttttgtgcttcagctgtagtggtgctgcctctccctccactgcctggattgatgtg

SEQ ID NO: 64935 - DNA, 1025 bp, Homo sapiens
tgctgggtatgtgaggtggaggtggccaggagtccttggacagagaatcgagctctagtttttgccctcagctttgcaatatcaaaaccttgatttgccaggactgctaaatctgaaagagaagggagggaggggagaggcacagttcaagggcttgtggacaaatgcttggaggtgggagtgagtgagaagattgtgggggtgacaggaagcttctttggtggatgttaatgagagtcatgtgggaagagccaggcaggctgccttctgtgcaggactgtcctcactgacccctgccagcaggcctggtgaccctcgctcctgtggagcttctatccatagagctaagcaccatgtctcttggccctcctgcatgcttgtcccctctgtcctttctgctgttcaaatgctgacacagctcagcctggctttcatgacaggaagtgtctgataagaatgttgtcactgtcgttattttctcttaagcagtcccctcttctttctagcaggctttgatagttcccttcttttttttagatacataatccgtggggacgatgaagagtggaatgaagttttgaacaaagctgggccgaacgcctcgatcatcagcctgaaaaggtgagggcccagggtctgatgtgcatctggcggaagaggcattctggcctctctgcttctctttaactttgactagaaaataggaggttggagcaaaagctttgacagaaaagtcatggttcttccctttgagagtcccctggccattacccttgcagtgcatgtcccacagaccaggagggccatctcttaggcatggatctcttcactctttgtatttgtcagccatgccagggcactgggcctgtcatggagaagggcttgagggaacagtccagaagctgccactggctgagacttgcttatgggctttcatcattcagccctcaggatgacagcataagggggctgttttattactgtcattgctttaagatgaagtaacaaggctctcaggggttaag

SEQ ID NO: 64936 - DNA, 1047 bp, Homo sapiens
atggcagggttttccttggagtctcatgccttgtattaaggactgtcttcagggtcattgggatgaatatgtctagtttccagagtcactgcagtggtgagagtggtggtggggaatccttgtggtgccttaggtctgtcttgggagaggggagcagagtgtactgcaccctgaggagaacccggatttcaggtgttaagatcgagatttgttcttccacagactaagagctggctcagggcaggagctggtctgtatggtgtgtccccagccccagcacaatgcctgccccctaataggtttgcagagaacattaatgtccaattgggtggcctacatcaagtttcagacggtggaaaccctttttgacaaagcaaagcaagcttaaagcagtctcagatgttcagatctgtacatatttcattctttctatttttgatttttctctagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggt

SEQ ID NO: 64937 - DNA, 1013 bp, Homo sapiens
tcaggacatgagcctaggggtctttcgtttcttgggactgaagtttcctggccacagacctctgttaggtctgtaggaaattttgctggaggcagggagggggcatgaaaataatttttatttattttctcaggtgggtgcctgaacctgcctttcaaagagggttttcttagaccgtggccagaagcagagtcacatgctcaaatggtcagagctggatgggactgtgcaagttgtccaggcatatcatcctacaggtaaggaagcttttgtttagtgtctctaccctcaaagtctccccggctggctctgctttggggtgcaaggtgagggctctggaggtagactgctctgccctgacgctcaccgtggccttgggcaggttacttcatcctacctgcccttcaggtccatttctgcaaaatttgagtggtaggaatagcacctccgtcacgggactgtggtgagaagtgggtggggtagaatgggaaacgtttagaacagtgcctggcacatagcaagtgcctctgggttctgggcactcatcagatctaactagaggagccgctcaagttcagttacatgccagctctaagaatactcaataaggactagctgtggtgttcttttgaaaacagacagggtcttgctctgttgcccaagctggagtgcggtggctcaatcatagctcattgcagctttgaactcttgggctgaagccattctcccacctcagccttccaagcagctgggaaggtgctcaccaccacacctgcctaattttaaaaattatgtacagatggagtctcaatatgttgcccaggttggtctggaactctggcctcaagtgatccgcctgggcctcccagagtatagggattagaggcatgagccaccacacttggccaggactggccatgttataaaaccacaacctaagctagaaaaggagtctcccttggccagcgaagagcatgcattttgcagtcagacttgtctggctctgtataata

SEQ ID NO: 64938 - DNA, 1043 bp, Homo sapiens
tctttgggatcttgaggatggtgcacacatcagtcattctcagccttgctccttcaggccctctcaccctggagttctcacacagccacgctgttgcagatgggagtttttaaaggggttttccagaatggccagacatgcaggtccagctcatctcagcctgcccagcagactccatggaattatcaggaaggaaacagtagcctggaacccacagcccatggaaggcatgttcctgagaaagtccatgaattacttctctttttaccttcccacagatcccaggctggggaggtgggtggaccaaggagtaaggcctgaagggatcagtttgggggccttgtttgtacatgtgggcaccagcccctccccagaggcagagggctaatctagatttctgtatattgaaagaggcagagggctaatctagatttctgtatattgaaagtattaatcagttttcattcaggaagcagcattctgggtattgtaagcaggagatgatttaatgcagggagttgggggttcacagaatcattggaggagctcgtggagcagggtgtaggctgagcatccaggaatgacgaactcgcccattaggggagctgctccctgagacagcgcctggaactgtgagtttgaacaacacctctggagctgcagttcaggagtaaagctggaatcaagaaggcgttgcagccaggcacggtgcctcatgcctgtaatcccagcattttgggggccgaggttggcagatcgcttgagcttaggagtcgagaccagcctgggcaacatggtgaaaccccatctctgctaaaaatataaaaaattagccaggcatggtggtgcatgtctgtggtgccagcaatttgggaggctgaggtgggaggttaaaaaaaagaaaaaaagactttgctattgcttttatcatttcaccatcactaccactactctgaagcctcagataggtggaaactggactggaatgttctgtaggaaaaaaaaaccctcagttttcatgacctggtttgctagcaaaaaca

SEQ ID NO: 64939 - DNA, 1036 bp, Homo sapiens
tatcttttcatgtctgtcatgaagcctagaaaatacaaagtggcagggagcaaaaatcaccctaggagaaggttccaagcaagccgctttctttgccataagtgggttgccacgcagtgtaagtttttagacgtcacagtcagagttctctgcagccatttgtctttctggtctgagagaaactgaccatagcagggcttggatcgaagaagccggggacctccatctccagctgccttcgtggtttttctgaacttttgggttatctgcttctgtttggatgggagattccatttctttcttgattttcttgtctacatgaagcaggaagtgtgctgccaaagggttctccaccaataacaataaaacaacaataaaaataattaaagataatgacttctaccttgttgagcctttgaaatgttatttcaacaaggtttctctttgatgctatcacagactctttgatttctcctccttgtggtcctgtggttctgccaaaagttatgacatttagacctggagaaacgggagccaggtttcaacttattagcagccaacttagctgtacaactggctgctgtgaggcgggttggctggtggttgtgaggccagtttctaccacccatggagcccaagggcagggttgggatctggcatttcagggtgcagactcctcctgtcctgggaaatgtggggcagagtttgacggcaggcagtagtcctggaaggaagagtccacaggaggcggcccgtaggatagaggaataataataataggacattaattataacagtgctatgttcagccctaccaaatacttactctgtgccaagcaggatgttaagtgctttacatttattgtttctttgagccctcaaaatcagtagggtagatactattgttcccattttacagatgagaaaactgaggctctgataactacgtaagggatttctctttctctgtaaggaatcgccaggggtggggcttaagctgacctccgggggagcctccctgagttctcaggcctaa

SEQ ID NO: 64940 - DNA, 1057 bp, Homo sapiens
gcgacagagcgagactccatctaaaatatatatatatatttgccagaggtcaacaggctagtctctagtccttgtgcagaagcaagatttgaaatgggttgcttgttctcacacgtctctttgctggtcagtgtagagataaagaaccctctccccacctacagtgttcttaagaagccatggttatcttgggtgtgatgatctttggaaggtagaaagttccactggcaggcatttcctcctggagtcctcagcctccttatcaggctcccagattcggactgtcagtgaggtgggcagggctgtggaggggagaggtcctgtcacaagagacacccagcttcctcccagctttggtttacctcaggcccggcctgaggtgaagtcctcattaggttacctcccgcctagctgtgactgggttaagttgttggacttctctaaggttcagctccctgttctggaaaatgaagacaaggactgtgcctgtcctgtagactttgaggattagctgaggcaatgcccgcatgagccacttagcttgatgccacataagtgcccaggagacatcatcctgtggtgattagttagatctgtcatacacccttacaccaggaagaccccacctggtcattcttttccccacaatcctcttctcccctaggataccaatgcctcttcttccctcagagttaatgcagttacaactattctagaactttctgacagcattcctactccttcagccacccccctccatcgccgggcaaaaatgccatggtccagcagccactcagctcagtggggtggtacatacaggggcgcgtgacaaggatgaggtaagtgctggatcaccaacctccctgcccctcctgtggctgcgtgtcagatactgtgtgccaagctcccttcagccactatctcatgtaaagctcagaccccacgatttccggagtcctagagtagtctgggtgtcctcgtggtgggaactggctgtcctcctggccccttgctcccaccctcctgccttcttggttcagtgataaggccttagatc

SEQ ID NO: 64941 - DNA, 1083 bp, Homo sapiens
tgttatttcagtggaggtgcagaaaattatatgacaaaaccgggtttgtttctctgctagaaacccaaggctgaaatactgcagtattccttcaagactgactcagaagacgaaagggagcctttcccagaattagggggcattcaccagggaccagaagggaggggggagaaagacaacattgcactggtcactagtggctgggccagtggtttattttctgtctgtgttttattaagtttatgttttccatctgactgttcctcgtgtgatttatttgtctctaggtgccccccgccccaccccccacaagtagatgataaaaccgacggcagtgtggacaacacagttgctgagactctttggttggattttacgcaggaacagaaataggtgttgggctagtgccagggtgttttgtgaggacttaatctccacctagtgggttctgcaccattttggactgaatgctgatgtcctgaaaactgggctgggtagtgatgcccgaaaggaaatgatcaggagttgggttttacttaagaagacatttggaatgtccttgaggccattgtgggatcacatttctccccctctatttttatggctcctcggataagaccggtagaggaggggaaaaaaaatgtatttaatttctgggcgggcctggtggctcacgcctgtaatcccagcactttgggaggccgaggcgtgcggatcacttgagctcagcagttcaagaccagcctgggcaacatggtgaaaccctgtctctacaaaaatataaaaattagccaagtgtggtggcacgtacctgtagtcccagctacttgggaggctgagacacaagaattgcttgaagttgaagttgaacttgagttgaagttgaaatcgcttgaggttgcagtgaactgagattgtgccactacactccagcctgcgcaacagagcgagactgtgtctcaaaaaaaaaaaaagaagtttttaatttctgactcacttttctaatttttagaaatataacttagaaccatggagcagcttaaaggattttgaatcctgagcaccttgtcctttttgatctga

SEQ ID NO: 64942 - DNA, 1905 bp, Homo sapiens
ctgtgacccctgagttgtcaattcaaagccctcccacactggtaatacccaaatgccatttctattttctgagagctcaatgagtaggtggattaaatgtgaaaaggtttctgttcaggtatttgacagtggccttgattggagcctctctaccgtctagcaatggccctgttgtgtgacttccaggacgacagctgtcttctcgggccatgacctcttccacctgtgggatcacaggactgtgtccagctgacccaatgagaatggtataagtgctttatctcatagggagttctgagtcaaaaattttggtgttcttgacatgaaagattggcagagtgtattattattccttagtgttctgtgcataattaacaaccacccttaactagacctggtagcccagggaaactggtcagaccagctagtgaaagcaggtggaaaatgatctcgagggaagcacggagtcgggatccacattgagtggaggtgacttgtagtggattagggtgctcataaaaaccgtggttgcagttggtaccagtgtcatctgtggatatttctaggcaggatatcaagggtcagcttgctactttagccccctcttaaggcaggatacaaaaaaaaaagagagccctgtattcaggggaggcatgtgacatgccatggtcccccatttcccctgccctaaacatctctggagaaagtcaagtgtgtgtggcttctacagcagggctggatgtttttccctggggtaggaggggcatttacctgcttttcttcagccattattaatagggctcattccaggaggggaggagaatggtgcctgtaactcagactccccagcacagcctcggcctgcaggcttcagccctgttggagtcagggcttgcgtaaggaatgctgtcatggatccaagccagatagattacaaatgatggaatctgatgtttcctgttgggtttggggaagggattcaatgtggtgtgggcttaggtccccacagtttacctcagaaatagtcaagatgcagggagctgaatgaggactctcgaggcagctttgccagcctggagcccaggtgagtcactaccacctcagaaacatccttcagaggccaggattcaggccccaggcgggagtcggagcatccaggctgctggtccggttctctccactgacgtcatcacccccgcttagtctggaatggctggcaacctctgcctgaggatgagagctggctggaagtggaaaagcaggaaatgtttccagattggaaactcaaggcacgtttgcgcaatactgcactcggccaagactgtgtggctgacctgcatgcctaatgggatcccaggtctgaaacagggttctgcagaaccattggtctgacctcatacctcccacctagacacaatgatatcttcttggccaagaaaaaatgacctgtatttttcttttcttttttaatgttatccagctgaggtgtgcctttaaaaaaaagaaaaaaatatatacatacacacacacgcgtgtgtgtgtgtgtgtgtgtatattccaatccactacttaacgcagggatgcaaagatcatattaaaacggctataaccagaaataagacaactgaaagaatcatagtattaataaagggcaaactgagagtccaggtgagaggaactgcagtctctggtgatggagtgcagcctggtggtttagagctccaaaatggaggcccgtcagcctgggtttgaatcctggctctgtggcttactagctgtgaccttggcttctgtcatcttctgttcttttacttattgtaagaaagggtgatagtgccacatcatgaattagtctaagactcgagtgcacttccacgcaaagtaagtccttagtaactggtagct

SEQ ID NO: 64943 - DNA, 1056 bp, Homo sapiens
ttgataagaacattaaatcatccaaatcctttagggttacacgggggtcatttgctcattaatcaccagtggcctgagaagctaaaggtttcccaaagctgagccatctctgccctacaggatgatgtgacgtggcccattgtctcagttcagctgagcatccctgggctgagcccagttcttctatctgagacatggattgggccttacagcccagagtgaggtctctgcaccagcagcatcggcattacctgggggctcgttagaaatgcagactctcaaaagccccaccatagacctcctgtatcagagccctgtttggacaagatcccagggattcatgtgcatggcacagtttgagatgctctgcattatcaatccaggtagggaagccctcctttagatttaccaagaagctggagaactcagcaacttacttccataaaactggctagtgaagcattctctcttccttctggctttagaaaggatcttattaggagataagaaagccagttggaagcctggttgctgagagtaaggaaccaaatgtggcccctgggactaagtttcctggcagctgtgtctccttattcttggggaaatattttgcagttgaaagaccacctacaaaaaatagtatcctcaacggtcaccttgtgatgctaccctctatgctggctggcatttagttataatattctgtcctgacccatgctctaatttgcctttgattaaatttggaactttgaagcttagatttatgagatggtattttttctcaatatatactttgatacttgctaaatggatatatgctacttctttaatcaagacttttttacaggctgggtgtggtggctcacacctataatcccagaattctaggaggccaaggtaggcggatcacttgaggtcaggagttcgagatcagcctggccaacatggtgaaaccccatctctactaaaagtacaaaaattagctgagcatggtggcacgtgcctgtaatcccagctactccagaggctgagacatgagaatcacttgaacccagg

SEQ ID NO: 64944 - DNA, 1366 bp, Homo sapiens
gcctctccaccctggggcctcttcttcatctgctccagttccctaggtgaccccatctggctctgagagtcacttcgcaagtactaccagccaggacgctgccctcagccaggacgctgccctcagccccaactctcctccagcctcctcgtgtcccatcaggtgtcccctgcccagaactgcagtcctagtctcacctcccctgcttctctccctgggccccccctcgacatcagtaaatggcatgatttatagttactctgctgaaaacctagcagctatcctcgattcttctttctcacacaccatacccagtctgtgagccagcctgtcaactctgccctcaaaaaacactgtttccactgctgttgctctagtctgaggcacagccctcactcttccactgcatccatgacctcctaacctgtctccttgaccccactcttgctcctcaaaaccagagccaggttttaaaagttcaactcttaccatgccactggtttgttaaacttagaataaaatccaaggcccttccacagtggaccaagtcatttgtgatttggcccctaccttcctcagtgactcctttattaccaccctctgggggtttgtacctgctgttaccttcacccagtggccccatcacaggctccctgacttagtgcaagtctctgcttcattgccacctcctccaggcagccctccctgacctccctatgagggagctccactcccctgtccctctccgttcgctttcctggcttgacttttcttcctatcaacaactgctatctgccatacctgtattttcttattgtccatcttccacccactagaatataaggtccttaaggcaggactttggtctgtttcatatcaactaagtaccttgccacataagaagtatttcataagtatttgttacatggacaaaccagtaggcaaaggtaagatgactgactggattcggaccacagtagagaccagtggtcctggccagccttcacatggtctgtgaaggctgccatcttcacagaccatgactaaaagaacccgaggaaaactagctgttttcaggccaaggccaacatcttaacactttgcaaagtaggaaagatcatctttgtgccataaggcatgtagcttctgcagctgttttagaagtttccaagtgagtctttgctaaatcactcccagtcctctcagagaacactgcggcttttccttccctcattactggggagggagcagggtataggatgaacagaaggaatttagccttggatccaggggacttaggccagtgtctcaagcagaatgaaatacactatatgcttgacttaaggtctatttagatttgctcctc

SEQ ID NO: 64945 - DNA, 1453 bp, Homo sapiens
cctctggtgttgagcacggtaatgcccgttcatatcttgatataacctctgacctgcacccttgtgtcataacacattttgcaataggagtccttctggaagtcattggcataagggattgttagtgatgtattaactctaagtggatgtgactgctaaccactgaacccagctgactgtatccccaactcaatttccttcaacaaggtccccaaaatgcccacccaatgcatgggaacatgtggtcagttgcagtggaaagagacaatggtatcaactgacagtggctaatcttactttggcaaaaaaacacacgtccatgtgaacacattgccaggccccctccagaagttttggaagcaacctgtataagtagaggctgcctgaagtttacgcttctttggcttcgtagtaaatctgcctctgctgaaatctcagcctatcagaccatagaggcattcaggattgcagcacattcatgccttgtaagtgccaaaacattgtcattgcaataaaattttaattcttcgagaccaaagcatttgaaaagcatttcacacagtttcctgttttctttgcttttctttctttctcttttctttttttttttttttttttgagacagtttcctctcattgcccaagctggagtgcaatggcatgatctcagctcactgcaacttccacctcttgggttcaagcaattctcctgccttaacctcctgagtagctgggaatacaggcgcctgccacccacgcccagctaatttttgtatttttagtgcagacagggtttcaccatgttggccaggctggtcttgaactcctgacctcaggtgatccacccgcctcggcttctcaaagtactgggattacaggtgtgagccattgcacctggccagtttcctgttttcttaaacagtgagtgagctgcatagatgtgactatgttcttgatgactcaagatccatgagtattcttacagtgcttgtgccctcagggagtgaccccaagatgtgatcgaatgttggtcccaatattaaatggccccacactgcagtcttaagtttttatgcctgctttttgtgttgtaaatgtttaagcccttctaatgctgttagctgtcatttcttgctgctttaaacaagctgtggcctgagaaataaaatcagccatcttctttcagtcagtaggctgttttgaggacttgttatgtgtcaggtgatgggctggaaatttacatatagtagcaatgactaataatcacaaacatccattgcatgcttgccctgtatcctgtattccaagctcatcacatgtgtccacacatgtaatcctcacagtaacctaggaggtcggagctactgttgttatccccgttttgcagatgaggaggcccagacacagagaagtgaagtaacttgcccaaagggtcctgattccaaaaaatccac

SEQ ID NO: 64946 - DNA, 1130 bp, Homo sapiens
cctgacaagccagggtgtgcatgaggtctgtcagggtcccctggaacgagatgcagcatcctggagccagtgaaagctagagctctgaggagccgcctcttctcccaaggccaagaaggtcagaaactgaaggcagtggaaggggtcaggctgtgcatacagcccctttgacatggagaaacggcatctctctgtggtttcctcaggaccagcacaagtctgactggtatcctccatcaggaccttggctgaagagagggaccaccggggaaattgcttcccttccaaaaacagcacaaatgcacacatttgctctcacagctgtttttgagtgtgtcgtgtggggagctgtgcaagggactaaggatatgagatgcaggtgaccatcagtggattaatgaaggagacgcacattaaagagcataacctccatgcagtccacccacggaggagagccatgttccttcttaaacaggggtccgtgacccagttgggtaggaggacttgactagcagagggagggtgctggggggtgagggaggtgcaaggaaagggaacagcatgtgtgaggggccctgaggctgaaaagaacaggaacttaaaggctggagggatgcagcggaggttgatgtggtcagaactgtgctctgaaaggagggcttgctctggctggagggataggtgtgtgaggaggaaacccacaagggcaccatggagtacttcaggggagaggcaaggcaagcttggggacgtgagggtggcggtagagagaagcagcagtgacagatttggaagttgattcgaaactcagagggttgcagggaggggtaggtgaatcgggactcacatttctggcactcacagcagggtagatgctggagctttaattgagagagggagagacacaggacaggggccaagtttagggtatctgtggaataataaagtggtaaagtgaaaatgggataatggatctgaagataaggatttgaaagtcatctgcatatggatgagggattacttctcgagcccttcctgggctctcagtgctttcctccctgagctcctgtcattgatgagcaggagacatacatactgtgctcctcccccttttagatgcagggcgattg

SEQ ID NO: 64947 - DNA, 1021 bp, Homo sapiens
cctgggtcatctgttgtagagtctgaggtggtgtctactccagcgctgttcctattactctgtggggctgacaagatgttatcccccagctccaggggccttggccatcatccttgctaagacagtgccagtctctggctccaggatttcagtctggaaagaggtgcctttgacattacagctgactcaggctaataactgggcagttcctttgaaaggcatgcaagcttccttccttagccctgagatgacacttcttggtatttctccatcaaaacatcttgtttctccaaacaggggggtttatagattacttagactagtggttaagctgcccaaggatgacctgagagcaacatgctggatccttatcacattatgggtcacctcccaactcagaacattgagttctgactccccagctggcattaaatggaaaataatcctctggactcttggactctgtacttactggctgattcacagtctagtaaaaccaccttctttcaactgcctagaaatctaagttggaatttttattatgacgtcattgtgtatttagtagctgagactcaggtccatcctggccctgccacgagccaactgagtgtccttagaccagtcccttggtccctcagaccccaagcttcctccttgggaaagtgttgagaatgacttttctagatggtctctgggttgcctttaaaataagtcattccttggaatcatgtcttttgcagtaacatgggtggagctggaggccattatcctaactgaactcagaagcagaaaatcaaatatcacatgttctcataaatgggagctaaacaatgggtatgcatggacataaagatggaaaaaatagacactaggaaccaaaaaacgtggagccaggcacagtgactcatgcctataaatcccagcactttgggagtctgaggcagatggatcacctgaggtcaggagtttgagactggcctggccaatgtggcgaaagcttgtctctactaaaaatgcaaaa

SEQ ID NO: 64948 - DNA, 1370 bp, Homo sapiens
gatctgtaactgaacagggacagccagcggtccccaaaggggagcctctacttgcatgccaagcctcagaaggctttggcagctgggctgtgctatttaataacctcctggaggctgatccagtggtctggcagcattactgaccaatgctgaggtttatttgtaggcttgggttttgcatttcctgaagaggcaggagtggaccctaggaagaagtgttggaggggtagctcagtctaactggcacctgtttttttaacagcatgacttactgtgggaatgacaagtagatatcacctcatggaccaagcctgatcaatcatcactgtctggagcactgtggtgaattcaggctcagaagaaagaattcagaaatccattgatgatgcctatcatgggcccaggaataggggctggaaacttgtctggcagatatttaccactagtgtgagggttaaagtaagcctgggattttaattatagcacaataatatctgtcctcataggactgttgtgaggactaactaagaatttatgtaaagtagctgggcatggtggctcatgcctgtaatcccagcactttgggaggctgaggcaggcagatcacttgaggtcaggagttcaagaccagcctggccaacatggtgaaaccccgtctctactaaaaatacaaaaactaactgggtatggtggcaggcacctgtaatcccagctacttaggaggctgatgcagcattgtttgaaaccaggaggcagagattgcagtgaaccaagatcataccatggcactccagcctgggcaacagagtgacactccatctcaaaaaaaaaaaaaaaaaaaaaaaaagagggaatttacgttgatgtaaagtgctcattagcttagtcatttgttttgctttgtgttggtaagggcttttcaaaagaaagaaagttcagtttattcattcaaatatttgagtgccctccatacacctggtgctaatttggccctggagaaagattgtgcaagctatactaggtcactcttctcatggagattgttctacatggaagaaatagacaataattagtaaataaacaagtaggatgacttcacatagtgataactgtattgaagaacaacaaaaattaggctaatacgagacagaaggactatgaagggggaggaaacccctgtgacagggtgacatttgaacagagaacgagccgatagtgcaaagatcttggagagagaagaaaaaatgtgaaagactcaaggagaaacagccttaaggcatagtgaacttacagaaggcaggccagagacaccatgccctagttgctaaatgctttcattataaaaatttaaaaacattaaaaaagtatac

SEQ ID NO: 64949 - DNA, 1046 bp, Homo sapiens
catctgtctgactttgactgccaatccagcctggacagcaggaccagtccaagcacaaaccaaatctttattctggagttggacagagtcagagttgcttagggctgatgaggccaccttaatctcaatattttcacacactgtgctagatgacacatttcagagtacaggcagaatgagggttggaaatgttaaacagccagcgaggagttgggtctgggagtgagacagcagacaaagtgcattctaaccatgtacacgcagctgccgggggattgtttaaaccagattctgccaaggtcatagcagcagaaaacataatccagaactctttctcccaggcaggatcatttggtttctaaagtttttttctctgtaagtttctcttgggagaaacgtatctgggagagggggaagagtggaaatacgggaattttattttaaatccttaacaacatgcatatagagtcccacttataggatgatgctatagagttgacattttacccccaaggaaggagtatgtaatcctgggctgaggatgactttttccaacaaggtccctgactcctgtcacttttggggttgctttccttcaaaagctaattgagagtggaaaggaactggggtgagtgaagataaccaaatgtgcctgaggcctgagagtgagagccaggccacgtttcccctgctactgggccctcaagtggctaggggggtggattcctagggtgggacacagaggatcttcctgaattgctcccactcctttcccctagaaatatcatcttctttgatgctttatataaaaactaggattgcaatgtccctctttatccttagtaatcttctttgctgtgaagtctactttatctgatattagagccactccagctttcttttgatacgtttgcgtaatgtttttccatacatttaattttaactagcctatatcgtattccaagtgagtttcttgtatacagcaaatagtcatgttttgttgtttatctgttctcataatccattatctcctaactggtatgttt

SEQ ID NO: 64950 - DNA, 1072 bp, Homo sapiens
agccattagagtgggtcagtggtgggtcgcttggggccagctttctgggttttcacaggtctaaaaatttcaaccattccccagcttctcagaagccctctgtttgcagaaacaagaagattcatggaaatggagattaaggccattggttcttgtggctctaacctctggacccttgacacaaggtcgggttttatcatttccaagctgcgtggcctcaggcaagtcacttagcccctctcaagttgtttcctcctcagcaaaatggtgttttaaaaaatacctcccagggatgatgtgactatttaaacaaaataacaaaatgtatataaaacagttagcataaggcttggcacacagtaagaacttagatgtgttacaatgttttacctgcattttcttctttgagccacacagtatcccgcagaggtagatactgttgctgatttcaagatgatggaaggggctttagggagtgctattgctaccatcactgccactgttcctactgttgatattcctaggcttgggttctgctttttcctctaaggctcatctttcctactgagcttgttgactggcttcttgtcataaatcagaggatgtttgtttgtttgaactaggaggtcttctgagctttcattcagggactgtttcttccaccatgggaggtgagctctttcagaggtgtttgcctaaagctggcctattggtatctacctggagagccgccacctggacagctactgccaggatctggggctccttggaacttgaggttaaagtttttagtgcttcacatgacctgtggtcctttggctgagtctaacagaggcttcactgagatcttagctgagggtggctttgggaggagtatctctgagaagagtaggaccaaaagagtcctctcttgagctgtagaaaggatccttctgaaaagatatttggtcacacctgggtcctgggttggttcgcaccttgactcccccagtcacttggctagatcatatagctaattatttaactttgcaatacctcaatcttctcatctgcgaaatggcgattatactaa

SEQ ID NO: 64951 - DNA, 1113 bp, Homo sapiens
catcgcaatgtcccccacctgtccagtgggtgcttgtaaagtattctaagtagtgttttctaccacactggtctttgaggagacaaatgatgatggcgggggtggggagtctgaggactgtgtaggggagaggccaggagttctgtttgggttacatccgtttgttcacccaacaaatatttattgaggactgtgtgctgggcactgttccaggagctggtgatgcaacaaatgaataaaaggggcctgaaggagggcagggtgcaggccctgtggataatgaggcagagtgaggggaatcacctgaggccagcctggctggagaagacagctctaggcagagggaatagcaagcattcctggtgggttcaaggagccaccaaggagaagctccttccgtgcggctggggcgagtgtagcaggagatgtggttggagaggaaatggtggggtggttagtggggtaggccattgggtaataattcattggcttttagttctgagtaagctgaaaagcattggagggactcaagcacagagtgacttgatctgatttgtatttccacaaggtcactctctctattgtgttggaaattgactttagtatcaagtgtggacgcagcgggaccagccactggcacttgccaacagcttggatgtgtgaggtatgagagaggaatcaaggatgacaccaagttgctatggtctgagccctggaaggagggagtggccattgactgaagtggggaaagctgtgtatggaagaagcaggactgcaccaaagatcctagtgcggttttagttgtctgtctcaaatcacatacagatatcaaataggttgggccgggcacagtgactcacacctgtaatcctagcaccttaggaggctgaggcaggtggatggcttgagtccaggagttcgagatcagaccgggcaacacggtgaaaccccgtttctacaaaaaaatacaaaaactagccaggtataatggtgcacatctgtggccccagctacttgggaggctgaggtgagaggattgcttgagcccaggaggcagaggttgcagtaagccggtatcacaccactgcatgcactccagcctgggcaacagag

SEQ ID NO: 64952 - DNA, 1058 bp, Homo sapiens
ttccctggggagcaaattcacccttggctgtgaaacacagctctataagataggactgaaaatagtacccaactcataggatggttgtgagaatttcataagagtccctgtgagggactttgtgttatgcctgacacataagatattctaattgtttttaacaaacttgtgttggatccactgattgtgttcatttttgccaaagtctctggtgcaaggagggtcacgacccaaatctcagggagatgggtattactcgcaaggctttccttggtggctaacagtttgtttgtggaggtaggaggaagttatggaatctggaaaagcacccttgcaccttgctcagttatggctcgattacccccaacaacaagtggtctggcagtgggcagagagattagatctcaccctctgagctcaagcccatctctgccaggatgacagcaagagtgcacattcaaagctccaggcccccagagagcaattctcctgtggatattggaccctgcttgtggcagccgccaaatcctcagccacagatcatagcaggtgttttgtgttttgctggcctgtcatgtaaacacactttgtggtcttcctgcttgttttaaaaaaggcctaagtgcttttgcagctttggttgtgtgcttggagctgcatgcaggattgggaggagatacataaggaacacagcccaagtactcctgaggaatgccatgccggcatcattaatcaactgctcactgagtgccagctacatccaaggcaatggagacagattagcaagggacaagaatcttgactgttttgagtttagaagtgtttagaatctagtagggaaagcaaagcatatatacagatagttacaaagaagtttatagtgaccaccttcaaacaaagaggggagcaatggcgatagactccactgtctagtcttcattgctggttccccattgcgggtgcttttcaggagctgtttcatttaatcctcccagctcctctggaaggtagatataacttccatcccatagttggggaccttaaagcttctggtgatt

SEQ ID NO: 64953 - DNA, 1059 bp, Homo sapiens
gcaggcgaggtgaccattcacttccacttagcaactggatgctcattttttatacatgaaaaccagggggtggccacattaaacaataaccaggctgatttattaagtccctttagacaaagtgaaatgaatgtttagtagaggggcaatgaattacttatgtctgaaagctggcttcagagggaagcatacactgcttaggaacaaaatggagtggtccaaacctttgttatattaaaattaccccaaggccagcaaggtaacggtttacacagctgaagaccaactggggaatgactgcgtatgggaaggagagtgctggttagaattcttgtcctgctggtcttccctttaaattataaatttattgttgatatgcctgctaattatacagcatgggcacatgcatttgactcagctatatagggcttttaaacttaatgtcttccaaccaagaatttaagggccgtaatccatctattcctgtccattactcagaatgcaggacaaatatggttttgctcagcacaagatggataataaaagttctgcagtgtttacaaaacatgatcccagctccgtagagcagcaggagttatatattgttgctcatttggtattgatgtccccaatcccatggcaaggccattaaatgatgatatcttcatgacttccttacgggaggtagagaaaccaatttaatagagcagtatttataaacaggtagtttgcacaaaatagaaacttttcgcatccactcatatccctccctactctcctctctcctctctctccctcctctcccccatcacttcccataggtgagtttgatgctgagcatcactactaggtttcttcttggtcattcttcttactaagcttttgtgagtgtctgtggcattttagaaaatcttcctcaatttctagattcttgattaagtgataggatattggtgagaatattcttgctccaaagaagtatccagggtgtacaaaaggattgctctatcctagtggtaacatgcacaagactttggattcaccatgagagtttgaagc

SEQ ID NO: 64954 - DNA, 1045 bp, Homo sapiens
tattgagtgcatgctagagaaaaatatgtttatggttctctcggccaatattaggaaagatttgagactagcaattcattccttcaatatttaaggatacttttttcttttttttttgagactaagtctggctctgtcgccaaggctagagtgtagtgtctcgatcttgtcttatgcaacctccgcctcccaggctcaagccattctctcacctcagtcttccgagtaggtgggactacaggcatgcaccaccatacctggctgatttttgtattttttgtacagatggggtttcaccatgttggccaggctggttttaaattcatgagctcaaacagtccatctgccttggcttcccaaagtgctgggattatagctatgagccaatgcacctagccatagttaaggatagtctataattacctctgttttacttaagtgaagtgatgggcaactctatactcttaatgataatggttggccaagttatcagtcacatgatgactacttagtctgtgcttgccctacagtagcaattgcagaatactttagctagaacttttttttttaagtttttagcactatagaagtagtgaaaaagcagatgttacattaacaaaacaagagaaattcatgtaaaaaggaaagcttatctgagtttttgcaagaatagacttaattttgccagtgacaattatgtgtttaaatattacattctgatttcatcacatgtatttcctgagaggacagtggaagtaaaagaagttctaatgctacagatttgagaatgttctgaaagcgtcgtacctttaagagttatctccagaacattcttgctgtcctagtgccacaaaccatgcttgtgttttttgatttgcctatctcagatactttgggattctgcagaaatgaaatacagtgattttgtattaattgggaaattcttaatatataattcaatttttaatcttttctatgcttctgattctgaaatatatcatttgccatctccttgtataaatattatgattgtccctgcttcaag

SEQ ID NO: 64955 - DNA, 1046 bp, Homo sapiens
tcttacttattctctaggcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaaaatttattatagaaaattgttgtttagtaatgatattgatgcagttaacacaattcttgcagtatttaacagtatgcaaaatggcaggccgggtattatttttccttattttgggagaaggttggagggaggcggggatggagaataggactgacgttttttagtgtgacgtattacctgccaatcatcgttcctggcactctacagaatgaattttaatttaaataggtctagtagacgttgccttcatattctgagctaccttaggctcagaaaaaaaaaatcacacaaagtcatatggtaagatgagtgtattggggttcctaaaggttccttaatgggaacaatttatttcatttttggtgtaatgtttcataacatattccttggagcagaggtgctttaacagtgtgtgcagaattccttctcttccctcctccaagtttgttgaaattaaacttttttccagctcctagagattcggtctggtctggtgtggggctcaggaatctgcattttacaaatgttggatgagttttgatgttttattttgacatttaatggaatgagctttgagactcactgccttagaaaatcatggaatattaaaagtttagtattggatataatctaggaagagtgctcttaatcttgtttatcaagcagatccttttgagaatctttgaaaatgttacagactctctgtacagaggaagtaccataaatggtcacacacaaaaatgtgcacgtagtggctcacgcctgtaatcccagcactttgggaggcgaagctggaagattgctagagcccaggagttggagaccagcccgggcaacaaagtgagaccc

SEQ ID NO: 64956 - DNA, 1103 bp, Homo sapiens
ctatcccctagacatataccatgaacaacttgtctaccccagtttgaataccatctgtcaggaagaaggcatggcatctcaaggaaagccaaattagttttctagtgctgctgcaacaaattaccagaaattagtggcttaaaacaacacaaattcacatctcatagttctagaggtccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacgtcactcttaatactcccctctgccttctgccacttacaaggacccttgtgattacattgggctcatctggatgatcctgaatattttccccatctcaaggttgagtagaaaccttaattccatctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcagcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactg

SEQ ID NO: 64957 - DNA, 1105 bp, Homo sapiens
gaaataaaagaaataaaaagcccttatagtaatatcactagctagaatgactactattgtcattttggagtatttcatttcaatctttgtatgtgtacaagctgggcaggtagtaattggatgatgccatatacaggtttgagcatctctaatctgaaaatctgacatccaaagctttttgagcactgacatgatgctcagaggtgatgctcaaaggaatgttcattgtagcatttgggattttggactttgagattagggatgctcaaccagtaagaataatgaatgcaaatattccaaaatctgaaaaaatctgaaattaagaactcttatagtcccaaacatttctgataaggcatactcaacctatatattgcttatgggttatcttttttatgtttgttagcatgccaagacctgtaaatgctgttttcacacaaactgttgtgcattcattttctgttgtggtccattgacattttcagtctatttttactccagtaccacaccaaaataactatttgaacaaagaagacttatatgacaaacgatcctttaaaacaaaaaatactataactgcctttattccaagtgttaatattactctgtgcctagtgctgatttttaaattacttttactttattctgccttatttcatccagcctgcagatggcagaattgtttcatttgaacagcaattttgaaggctccgttttatttagtgtgttctgacattggaatgagaagtgattaaatgaacagtctctctccctattagagaagaagcaaattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagaccttttagcattcatgaatcaa

SEQ ID NO: 64958 - DNA, 1020 bp, Homo sapiens
atatcttaaggccttcttaatttgacaagagaatggtagaatgtacagcttactggaataaggagggagtctgcatataagttcaaatgcaaattaattaatattaggtaaaggataaaattccattccaaggagtctagaaaagtctacactatcttagtagagttgacagcagccataaagggcagatattaattatgtgcaggcctgtcacttcaagtttatcttacgattgtgtaattactttcccatcagaaaaatacgtctggaaaagataccatatagtgttctaatcaaaagagggtatgctagaatgaaatatgtacttttattaacacattaatgcttatgaaatgatttttctagcatgaaagcctgaggatagattagttagaataactacaaaatatattgcacatttaactctccgtaataagcgagtgtaatctatcaagagatagtattgaataatggagatgtccaaaatatctttctttggtttttgtcaccttcatttcagagtaaagataatgatctactacagaatttttgtattatcataattcagataagcaatttcaattcatttcatgaagggtgactaaggaacgattatgttctttttatttttaaaatatgaaaatttttgaggttcttgatgtggtaacttgaaagataataataaatgcagaggtttcataatatagtccttaatgtcaagagtaatggaaatgtgaaggtctcttaggtgagagattatagcaggagatagaatcataaaataaatgtgaattgtgtcgtgacaactggaaccaaagcatacaaatattggagagagactttaagagaattaagttagtatttgtcgtaaattggaatctggctatagaagcattgaggtccatttagttgcttctttgaaatggaactctttgatatataaatgtaatatgtatatatttatgaaatattctgttcataatgcctggcttgaactttttgatagaaagaacacattgg

SEQ ID NO: 64959 - DNA, 1827 bp, Homo sapiens
ttacttgaacttatattgatgcctcatgaggtgcattatttgttgtggctcatctttcctttttttcaatttcaggtgatcccattaagatactaatgccatcactgtctcctacaatggaagaaggaaacattgtgaaatggctgaaaaaggaaggtgaggaggtaccttcctaatgtcctgtgtgctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctttatgttatgtgaaggataaattacaaatgaattatacacttaatgtataaaaatgaaactatgcaagtcttgaattcctctgaacccggaagtggaataaacaccctaactataactcaaaatccagattataatatgggaaataaaatttgatggtaaaagtactaacttttatatggctaaaaatacaagttaagtaaaaaaagaagtgacaaattggacaagagtatttgcgatttctatcacaaagggttaatatccctaaaaaatcgataagactgtcaactcaacaagaaagtgggcgatacatgaacagatagtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatttagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggggtgatcttcattgaaaaaaagcaaggtacagacaagtgagtatagtatatatcatttatcaaagaaagaggtggcagtgctaatatttaagaaattagaaaggataaaataaaactttaaaaacaacaatagttggttatctacagagtaatggagggaaccgtgtgggggagaaactggaagctggacttctgaatatatcttgttttgtctctttgacttt

SEQ ID NO: 64960 - DNA, 1093 bp, Homo sapiens
cctaagttcacagtaatactaaagaaaaaaaattaataataattggttagctttagagggtgctaagaaattaactcattttgaaaacgtaataaatggaaagactcaagcatttttctctacctcttctgctatatgaaccgtagctctgagtaaccaagtaattgatgagaagtttctcattattagcatatcacagttgttaaaagatagaagaatcatagaacatcactgtattgccattttgcaatctctggtaaaatagtatagccagtgatcattaatagctgctaacatcacaaaaagagagataaccagatattacatgtttcccactgtgaagtagtcttgccagaaaattgaaccaaatatgttcaagcctgtagctctatcattttccaggaaatacaggggaaaatataacgtgttcaatgacaccatgagaagtatatcagcaaaagctagactgaggaattctgtatgccagtttcttcaaccaataaatttcagggtggtagggaagagcccgggggaggaaggtgggggaacctatagcatacaagagatttgagaccagtgccaatgtatggacctaattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacag

SEQ ID NO: 64961 - DNA, 1042 bp, Homo sapiens
ttggaatttgaatactgatgaacacaaatgatgatatagcatcattttgtttttctgtggctagagtctgttttctaggcatctaagaggtatttaattgctgggtttactagttctatagtttttcccgtgattatagcagaaatctttgagggtgtgctttttttcccttttgaagtgcaatctgttttaaccactaaaacatttaaagaagtatgtaagatgatataatctgacactgtagctttctctatgacatacaaaggtcatttttggtctcttcctgcatatcttaccagcctaatctctcgtcacttctctcgcatactatttgccagtttctctgaagtttcctgttctctctgcctccagggctataagtgtattaccttctacctggatcactgcctgtttacagattgtctcctcctcacctcttcaggctcagaataggtggtcattgtattctaggaagccttttctcaccttacaaaaactgaattagatgcccctcctgaacattcccaaagcatcctgacctcaccttatcctgctgtattttccagtttacttgtcaatggatattaagcaagcttcttgaggtcaggaatcttaaatctttgctgttattactgtccactgctgtatcctcagtgcctacatatgtatatatattttatatgtaatatataaatatataatacaaatatgtgtgtgtgtgtgtatatatatataaaatatatttatataattattattattttttagacagagtttttgctcttgttgcccaggctggagtgaaatggcatgatcttgactcactgcaacccccttctcccaggttcaagtgattcttctgcctcaacctcccgagtagctgggaccacaggtgcctgccacctctcctggctaatttttgtatttttagtagggacggggtttcacaatgttggccaggctggtcttgaacccctggcctcaggtgatccacccacctcggcctcccaaagtgatgggattacaggtgtgagcctacacg

SEQ ID NO: 64962 - DNA, 1080 bp, Homo sapiens
ctgtttttctaatgctgtagattatatttctgtttttaaattttaaattaaattttgccaataaagtttagtattattcagtatttttctcctattataagttgatgcaaaagtaattggggtttttgaaagtaaggtggtaaaaataaaattacttttgcaccagctgaatatatcaaagttgttagcatgccttaccatctaaacatttccttacctatcttattattttttagagtttgagttttacactttttaaaccctcaaacattactttaaaaatactagtagttaacattttagtaattttcacaataacttgtttcttatagcccatgggttccatctgcttccacttttcttcttgatgaactgcatcttgtaagagctttttaaagagatctttaataggtggtaaaatttcctagcctttatatatctaaagaatacttctctttcattctcaaatgatggtttggcagcatacaaaattctagacagttatttttcctcagttttttgaagatattacttcattgttttctgacctctgttgcagctgctgagaagtgtactctcagtctttccattgaggtaatctgttttttttcccctttgatagatttttaaaagattatgtttttatcgttgatagaatgcggtttctttacattgtatctaatatggattcatgtttatatagtctaatactcttttttctgtttaagtttttatcaaggtataacttgcataaactttaggctcaattaaattttgtatacatgtatacccatgttaccaccacctagatcaagatttagaacattcttagcaagctacacagatccgtatgccccctgctagtcagtacacctatcctaaattcattcaaaactctttgatgatgagagtatacatctccagttctgggaaattctcagccactaattcttcaggtattgcttctccaccagtgcctccagtgtcttccctcagaactccattagcaaacattgcagcctcagtctttgtcacttaactgctcttttctgttttttcgttttgttttgttttttgttt

SEQ ID NO: 64963 - DNA, 1026 bp, Homo sapiens
tctttttatgctttatatgctttattcatttatactgtgtgctgccaacaggttttttgaacttgccctaagatgtgaacccagaagtactgttaattgtaaaacttttcttcagggaatatagtcaaaatgtttgaaaaagtaagggggatatggagtctggaattgatttgttcagaggtggatacacatttgttgctgatgtctttaaggttgatttcatttttacatgctcagtaatctttgtaatagcttttttattatcacaagtataatttatgtccattatagagcttttggaaattacagcaaagcatacacatacacacacacacacaaacacccacacataatgagaattacttgtatttccacaacccagaaatagctacggaatattttggtatttatttatgttttattcatacgtacatatatacatagtaatatttatattttaaaaaacaaaacaaacccagtcttgttttgtaggtgaagcggtgagtgctggagatgcattatgtgaaattgagactgacaaagctgtggttaccttagatgcaagtgatgatggaatcttggccaaaatcgtggtaagtttttattttaattttcttcaacaggatgaagatttcttgagtggaaagttcattgtagtaaaattaccttttatttttgcctccttatttttaatgtgtattgtctactacataatacatttttagttcaagtgtttaaaatgttttagagttaaggtctaatagcctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgtta

SEQ ID NO: 64964 - DNA, 1297 bp, Homo sapiens
ggaaacagatttttaaatatccattaatgattaatatactgcatacttgaataacctgctctttaaggacatgcagttggataagatactatgtatattgagtgtatagtccactctttgactatataatgtatatggactatgaaatatgtataattcaatcatatgtcttttaaaagtaggttattcaaggctgggtgtggtggcttacacctgtaatcctagcactttgggaggctgaggtgggaggattgcctgcacctaggcattcaaagaccagcctgggcaacatagtgagacctcatctctacaaaaaaattttaaaatcagctggatgtggtagtgtgtgcctgtagtccaactactcaggcggtggagattggggaatcacttgagactgggaggttgaggctgtagtgagctatgtgcactccagcctgggtaatagaggaagaccctatctcaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctgtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactgtgtttagagaatacactttgagacacacttcattttaaaacaatcttctcaaatttattgagatttattttatatttataacatggcctgtcttggtggatgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagt

SEQ ID NO: 64965 - DNA, 1025 bp, Homo sapiens
aacaaaagctgcttacagatggtgtatgtctatgtctgtcttctctctcctctctctctctgtgtatgtatgtacacacacatatattgctccttgtgtgtgtgtggtatgtgtgtgtgtacgtatatatacacacacaaacacacctgtgaaggaattgttcattatttggtaggtttctttcttatcatcttaaatatagtaacataagatatcccattcacaattgaaacatgaattttattacttttttctgtagttatatgctataaaaccaaagcgtctcagattttttatattcttcccttatactaagaattttaatagtgcttttcttgtgttaatctttaattaataagttaggtcattgagaatgaatttcttttcatttataaagttgcttgttttttgttttatttttctattccacttgtggtttaacggacaggttgctgtctttttgcagggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaaggttagtaaaattgaatttacttaatacaaaacacatgctaacttaactttcatgaaatcctttataaaattataaaattaaaagctacattgtgtagcttttaatttcaatttcataatgtacttgcactctactctgggtatatttgtgctagaggaaaaaaattagcaatggtttccttgaaaaagtgaattggttccacagtattaaataaatcacagatgcctttatgcagaaaaaagcattctgttctaccttgcttttatttcctctttgtcatatttgaataatgtacagttagttaacatttatttagcaggcaattactgagttcaattctctgttacatactgagctttaaaaatacaggttgagcaacccaaaaccaaaacttcaaagtgcttcaagatg

SEQ ID NO: 64966 - DNA, 1017 bp, Homo sapiens
tttggcttttgttatatcctgttttgttaagttaaaaagcagttaaattttttttcacctacaccccattagtaaaaagaaattttcgaacactttcccatatgtgtatatataactgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataagggga

SEQ ID NO: 64967 - DNA, 1043 bp, Homo sapiens
ctgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatata

SEQ ID NO: 64968 - DNA, 1064 bp, Homo sapiens
agaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaag

SEQ ID NO: 64969 - DNA, 1061 bp, Homo sapiens
ctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagacc

SEQ ID NO: 64970 - DNA, 1054 bp, Homo sapiens
agatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtataacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatga

SEQ ID NO: 64971 - DNA, 1055 bp, Homo sapiens
ctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagg

SEQ ID NO: 64972 - DNA, 1899 bp, Homo sapiens
gagcaggccgagccggcggaaagggtctttgctgctgcgcccgggcaggggctgccgcggccccaggtcccgcttcgagacgcggcgcggtccaggcgggaggcgactccctaggaagggacccggggcgggaggaggaagtgaggccgcgcggaaggaaggcggcgagccccggggccccgaggccttggccgcgtcacagcacccacatggcctctggagtgggcgcggccttcgaggaactgcctcacgacggcacgtgtgacgagtgcgagcccgacgaggctccgggggccgaggaagtgtgccgagaatgcggcttctgctactgccgccgccatgccgaggcgcacaggcagaagttcctcagtcaccatctggccgaatacgtccacggctcccaggcctggaccccgccagctgacggagagggggcggggaaggaagaagcggaggtcaaggtggagcaggagagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagagtaagtattgggccttcagagcataaacctaggggtcaggacacctgggtttcaactcaggtggcctggctgtgaccacattcgctttcactgtgtccctaagaagctagtctttccaactttttgggagcagttcttattcaccgtttttggttgaactcttttgagaatctgatgaaagttctggactctgacctgagaaaatacacacaaaatctagtatacaatttctagaaaattgcaagtttctggtctgtggatcccaggtaaagcatttcttgggagttttgaccccacttaggccaatttccacagcatcactattgttgaaactggtgctttgtgctagggctcttgataaggcaatctttttgcctacttgaaaacatgggaaataggattttgccacatgaatccaagcaagtgatacgtctgcattgaaaagactaacaaaatagttttaatagtaacttcatatgtgccccgagttcattttagattcttcgtgtttgaaacttagtagaaaaggagggtaagaagatggaggccaaattggggtgggagtggaagttcccatgtcctctgtctggatctttgtctgtcgtggaccttactggtcccccagaacagtggacacttcggaaatatttgttgaatgaatgaatttgcagacgatgcaccttttattcatattgtggatgtttactatcattgagagaaactgctggtgttaatcggggagggagggggaaattttgagtggagtgatcagttcattaagtaatctgtattagtgaacattgtcatattatgatgacttttgcttccctgaatagggaatagctggcattgggataacaaataccttgagagtgaagatcctctgtattaggttttcccttttttagtgcctatttataattgtaaaatgcacattcagaaagtgtgtaaaaacttacagtctaacaaataattataaaacaagtactgaggtagtctccatccagattaagaaatagaa

SEQ ID NO: 64973 - DNA, 1052 bp, Homo sapiens
aaaccaaaaccaaccaatcaaacaaaatttcccaaatataccaaaggctcaatccacaatttacggcaaataactctatgggcagtgactttgatgtatactataatgtgctagattatttttgttgaacatttatatattaaacccacttcagatgggtttagttagtttttggtaaggtaataattggtttttaacatcaataagaagattagcaaatacattcattatagtatgtccaaactataacatatagctggctttcattttagagaatgatattttattttcttaaactaattttattcatctgaataattttggagcacttattatggtgaactgtgtggtggatacgaagaagaataagcaaagtttctaacttcaggaagcttacagcctaataggaaagagaatcttttcacatgcttatttgtgtgtattagagaaaaggtacaaacagtatgctatggaagtggagagaaaagagaaattgatatcactggagggcatggagccaggaatagattcttagaggaaggagtctttgaggtaggccttgaaagatgggtagggtgttactaggtagatacaggctttgaggtatccttttgttcccattataacagcctgtgaacatttattgtagcactaaatactgtgtactatgtcatgttatttctttccatgtctttccctggtgggttataaattctttaaggctagaactatatgttattcatctttgtattcccagcacctagcacagtgcctgctggatggtagatgaacatgaagtatgtgataggaagtgtaataatcttgtctagttccagggcattaatgaagaactgagagagtattgcatagttgttgtagatcagtgtttacattgggattaatttgactgcatctaaaataatgaaataatttggaaaaatccaaaataaccactcccacatgatgtttatttctctgtcacataaaataactttgggtgtaggcagtctaaggttggcgtggcagaaccatgaagttaccagaaatctagg

SEQ ID NO: 64974 - DNA, 1039 bp, Homo sapiens
aagtgaaaggtttgagcggttgcatgagaggaatccctggaagtgtcagggttttctcttgatgcatcataaggtaaaggatatttgtaaggacccgacttgatcttgggtgtgtgtgtatacctgcacctcttttttacgttctttttattttgccctggatcatttactaccaacctattttattttcaagcccctttttagtctaccacaaccatatgctgtatatacttggagccagcttgaagaagggtgaacgtaattgcagaatgactgccaggtcaggaatgggggtaaaaaacaggccacttaaatatataatttctgcacaaagaagattttcctagaaataaattggcatcttccaagacaacccttaagtttttgtctgttctgttttcccacagagccccaccatcccctttttgagttggcctatttaagaagggcagaaatctcttaggctttgtgacctgtcatttcctgggcacagaggctttacatagaagcactgattgagtcatggaggactgagcactatctctgcctcacttcctctagaattccctaaagcatcacaaagcttgattagtccagacactgaagcctattggggaatgagttaatttttacctcttgagttttgctagagagcagtagaagatgtctaaattaatcatttttttaaaattataaaataatacatacttatagatttaaaaatacagatattcataaagaaaaagtaaaatctcccctaagttagccactgttaacagtttagtatgtaaccttctagacatttttctatgtagtaccttttcaaaattcttttacaaaattatacccatggttttacaattgctttttcctttatgtggaatatcttagatattcttctgtgtcaaaaatatagacttgattctgtttaatgagatgcctcattttattcaaaacatttgtcagacatcttcttttcttccagacccagaggttcttaaacttcagtgtacatgaaaatcacccagaagacgtatta

SEQ ID NO: 64975 - DNA, 1037 bp, Homo sapiens
atttgaaattcttattattgtgtcctattgtgtcccattattcacaaggatcaagccaggcatcatcttgatccttgccctgtgccaaaaaagaagtattcactggggcactgtttattcaaccagctgaagcagagaattgagatgcctcagctatcaagttgttacatatagaagtgttcctgtggttgatgagttactagaattattgacccatttctggacttttcatttaaaaagttgtaagtagggaattttggagatcatgagttatatttattttatccctgtatcttcagcccttattagcatggaacctggcacatagtaattgatatgtattatctattacagcaacctataaaagtaagtatttgtcttgttttatggatgagcattctgagacttcaaggggttaaatagcttgctagtaagtggtgggaccagggcttaactcgagatttgtctcacttcatgttcttcacccatacactgttattgaattcatgggtaaatagatgtatatatagcctggcatccctagcaatgtgacccttaactgattatttttttaatcacactcttcttctacctccctttactgggatcctgtgccatagcacagtcccccacagctccagagaaccaggactggagaatggccttttccaacagaaaatgtggggagatggcaaaaaagccataaccctcagagcatttagccctcgctaaatgaagaactgaggcaagtgcttccacagtttgacccgattagtgaaggacactaaatgggaaaaatacctgtgctccctcagtcttgctctaggaagaagtaaatgtggcccctttttatcctctctagacacttgggcaggagaaaaaggagaaacaagctctttccctccttcaccattcccctggctttatcaaaacaaaacagcttacccctctcatcctcccctacccaattataaaagaaatacagttgctccttgacttacaatgggattacatcccaataaacccattataagttg

SEQ ID NO: 64976 - DNA, 1072 bp, Homo sapiens
gtggcttctggggaggcctcagaaaacttacagtcattgtggaaggtgaagaggaagcaggcatgtcatacgtggctggagcaggaggaagagagagaggaaggaagtgctacccatttttaaaccagatcttgtgagaactccctcattatacagtaccaagagggatggtggtaaatcactcatgagaactccacccttatgatccagtcatctcccaccaggccccaccttcaacattgtggattacaattgaatgtgagatttgggtggggacacagatccaaaccatatccaaaagcatttgtttctgggagtcaaagctataagccaagaaaaagactatataagagaaagctgtgttccaagcaccaaggcagagggagtgaagagcacatataatcactaagtttgaaggggccagagctgggatttgagaccaagaatagaaagccaaggattcaaggccaagaggaaatgaaaagagacagaaagctgatcaagaacaagttggagttagaagcaagatgctaaccagtgtcctcaaatcactcaagagttctttgtgactttgaattttgttttagcaaattagtggtgcagggggcagtgggactaggttaaaaggtctaaatggggtgagcagggggtgctaaagtggagcctcgaagatgggtctaggtgtttagcagggagtatttggaagggaatacaaataaaagaaggggattttcatgtatatggggcaacatctctgcagccagactggtaaagggacacatgtgggatagcctctgaccttcagtcagaatgtattgcccactgttttttgcagggcccttagttaaagtgtcataatttttccttgaggtagtagtaagtcaagagacctattatctggtggagaaaataaaacttgactccagagtttggagcctgataactgcctaaatcatggcgtcattaaggggaatagaggaaacaagttgacatttgaaggggatctgtaggagaataatgttgggtcagaaggcagattgtataatcaaactatttgggtttaaaatctgct

SEQ ID NO: 64977 - DNA, 1229 bp, Homo sapiens
caattatttaggcctcctaggtctgtgcattcacttctctgctctgcttgtcagggcaaattatcaggtcatctccactgggcagtttgaacataggattatattagctcttgtcttagcctttagatgtctgttggtttgtctctgttacaataaatgtatagtccatgcattcaggttgggagaggggagggaaaagaaagaaatctgactctgtctgtaccaacagtgatttctaatactgtttctttctgtttgtctttcagggcgatgaggaaggacccaggtaagatcacattgttgcttgtcttttctcataattgaagtagagtgacatttgtggccttttagtgctccatgaaatatagacagccaaggaacagcacagaaaagggatctctatcttaagcctgggatttgaagatcttattttgtaagactcccgtctccctctcatctatgtcatttcctgcctgtaaccttcagataagtaactttgttgtattcttttgtacattcagaataccttgttaagaagaataggcactacatttaaatggtaatgtagtatcattatggtaatggtaatggtatcaggtggactgactagataaatttttgtagtctttcttgattggaattagattgatttttttaatgggctctagatctagtattctttatttttgacctataatatctttgtgtcagacacaagacacctatatgatgaatcctagggtacaggtatacaaaactttgtttaggaaaaaaaaaatgttctttgtgcttctgtattgccacagttgaatgcagtttagaagtgcattttattattgtctgagccttgcagtgaacctggactgtggtttacttacccttcctgtcattcttctcaagcagtgaaaacagactctgggaaaagctacagctgtgtcatcaacacaattgaggaatatttgtacaaagtaaaaggcaatgtccagatgggtcccatctgtcacatagaatcaagggttgttaaggctgggaagtatcagaatggtcatccaggccactgctattcaaactttatttttagcagaagcacccttttttgaaatggactttaagcagaacctcaatgtgtaaaaaacaatttttctctggtcaaagttggggcagcattcattgaactttctctattcttcaaaataaaccctgaggagcttctgcagtgacctagggtt

SEQ ID NO: 64978 - DNA, 1022 bp, Homo sapiens
tcgaggaagtgatgaacttgtttaggtacttaatcatcatagctattagtccatcaacccttcagagactgtgttaatgaaagtagccagcactcacatggatgattatctatctcatttaatcctcaaaacaatttaggaaaaacatgctattaatattctcataacagactcagagatgttcagtaccttgaccaaggtcatagagctagtaagttaatgtactgaatcttatcctattgggttgtatttttaaaatagaacctatactattctatagagaaatcgtggtcccaatctacaacaaaatcagacttaagcagatataaacaatttataataaaaaggaaaatattttttctagtaaaacaaggttagctgcaaaataaaatatcccgaatgaacaatgttggagaatatccttttcttttgagatctatcaggctcatagctcaagattagccctatgtcccaagccctgatcaggtgaataatgtgagtcatgattctttcctaacttggttctatggctcaggtggggtaaagctcagaagaagaggaggtttgttgacattaagcaatgcagaggctgtccaaaactcatctaaatgatctgttagaaccaaacttccatgatgtatgtatttttcatgggaaaaaatgccataatatacagcaagacttccctgtattccttggtgtgtgtatgtgtatgttagagagagagagagagacagaaacagatattttactttgaaacagtgagtctcagttggaggagaaacatggcattcattcagcagagtttttagagcacctgcttcattctagcattgtctttggtgctagggatataactgtagagaaaacattcaaagtcccagccttcaaagaacttatgctatagaatcttaagaaaaggtaaaggaaggtaagtgatgtgtaatttaaaagcacattttaaggagactcattaatccttctttcaaaatctgttatagaaaataaaacttacccagtcc

SEQ ID NO: 64979 - DNA, 1036 bp, Homo sapiens
atgtgctgttcatcaacaaataggagtgtaacctttcttttattagattaatacagggtcgtgatgcaaaaggctgttggaataattcttactcctttgttctaagaaaataaattaagtaccgtcttaaagtctagatatggaaattaaaatcattaaagacagaaaaacagtgtggccactcattccaaaatctccatgagccttctgtcatttctataaaattcattcctttgtacatttatgaaacaaatttgatcaagtgtctactatgtgctaggtagtgctagatgttggagctatagtagaaaccagaaccaaatgcagtccttgttttcatggcgcttaccacattgtgaatggtctctcctccacatttgaggggcatatatttattctgtgtctgctcaactcacattaaaggatcggcagcctactaaaacattcatgtcacttgtagctgtaaatggaaatctcccaatgcagagctttctagatatattagactaaacactattttagctctcagtttgctcttctaaactagggttccatggtccagtaagtttccaaaggccaccttcttggagctccacaagtttcatgatgcaataaagactttgagcagccttgtgataatgaaatatgtttagtttgtttaacctgacattcccacacttattgaccgtaagactcttaaccccatcacataaatgtaagtctttagaagtggtgttcctcaagatatactatgatgcatgctgctttttctccactagatgttgggacttgttgctaatgactgacatgcagaaagagggtataaagaaaatgtagagtcattatcttagttgaaatcatctcttcaccatactttgggacttctaggacatttctctgctattattcatgtaatttatttgtaccgcaattaaaagtgtagctatcaggggtatagaaaatgaaggtaatacatattcctgggaaaaggaggcccagagagggctgctcagatatttttaaaaattgccattaa

SEQ ID NO: 64980 - DNA, 1015 bp, Homo sapiens
cagagtgctcctacatgcccacattcagtgtccattccaaaacaaattctacttcttccatgtgtagcattttgcagataaactgagtagtgattattcatccagcacatagttcttacccctgtttctcacttgctttggcctcggcaggccgggatatatgagaaaaaccaagaatttggagtcactggatttattagttccatctcttactaattcagtgaccatgaataagctccaacatcttagaacctctcttccctgattcaaaaaatgaggttgacttgtgcctcaccagcctccctggatacttacaaggggcacatgataaatgtgtgtggaatgactttgtgaatagtaaagcactgtgcaaatgagttcaattattaacaaattatgttagagatggaaacaaaggttgatttttggcttgtctgacatttagcatgaagtactaaggaatagattctctgatatctgctcatccaagtcaagtcatggttttaggcaagattcgtaaacaacacgtttctggtgctctggctctcagactgtcatcaagcatgtgaagttccttgaatgaaagacgtaatggaaacaaatgggtgcatgctcctacatcaatgtgtgtgtgtcagtatggcctccaggcatgatagaggacctttcattttttagctgaaattattttaatcattatagtggtattaaatgggctgttatcggggtgcttcttttagttagatggtgatggtgaaagaaaaacatggaccacaaatgtgatttaactgaggatcatctttacttggtgtggataagaacaaagaaaagaccaaacttgtgaacatacaagatcaccttacctggccctcctctgtcagtcacaggttaggtatgcaatagataatcctcagtactactactctgttccaggatggagaattaaggagaggggaggttggaggtgctgccagctctttttctttgtcttttctgtggttgtattatgtctctg

SEQ ID NO: 64981 - DNA, 1051 bp, Homo sapiens
gtaatagcaccaaccataatgaatacattttgtatccatgcagatgtcactggtattttcagtgcttcattctaatttatgctggaaaatgaatacttaaagtattgcccaggctcccattactccagaggaaattagggacgccttgtgtgtgtgcatatgtttttgtgttcatgtagcagatagaatgttttggtcagaatgaattgtgtgcgtgaaatgagagcctagccccttcctggaagggcactttggaggtaattcactatgcctatcagtgaacctgtgcaagcaggtttctttgtgagtgggtgtttggggcacaaattatagtcagattttgttagaagtgaaagagggaaagccctactgattgagggatacacgttttggggtgccccaaggtcttctggccatcttatatacagccagcaaaggttgcagatgtacttggtggcagcagtcaccccatctatcagcctcacactgacgtggccttcaatgttgagggtgaacagtgagacagaggcctactggggagcagaatgtgctaggcttgtggttaattatgtgaactcacctttatggcaagtgttggttcatgacgtagaagataatagtcaaagactctgaaactatggataagggcaggagtactcagctatccaagaaatgacctctcttatgtttgaaacaatatgtaggccagaatgctccagacattcagcctgtctgtaggggattctcgaagtgatatactttcagatacatctgtgccaaaaatactatttctgaggcttgagatctgagcagctaaagggtaagataacttgtaagatccattattacgaatttttattcaagggttctgtgtattaaaagaaggagaagtggtggttttacagaatataagagtattctaagtttctttaaaatactacatttttataccatacctatttaaatcttttaaatattcagaagttgcctcttaataaaaattgtctacttcttttaggattactgactccataatttcaaggcaaatcaa

SEQ ID NO: 64982 - DNA, 1046 bp, Homo sapiens
acgtgtgtgtatctgcctcgctcgctcgctgtcacacacacacttgtgcatgcacacatacagcgtgaatctctattcagacagagattagagataagtgtcaagtatatttatttattgatcctttctctttttctctttggtaacttgtgagatacagcagctgaggcaacaggaaatttgaagtccagcattttattaaatcttatgtttaagatttctatggaaggaaactgcttgagagagatttggtttccattatacacatgccaaaagaagatgaggaaactgggtcaggtggatttcctgaaggtacaggaagcagggaaggcaagtccttgggctaatttctgcttctaactctccaccccctgaaattgcctgggccctagtagagggtataggaaaggttcctttcagacctcatcacaggagatcgccagtgatagaaaatccagcagcactggggggaggaaagggaagctggggaaggccaatgtaaaggcaaagaaaaggaaaaacttaactggccccagggcatttttctcttgaagttcaacaggaaactgagtaatgtagaagttattttaaagagatggaacagatagacccatacatgcatatatatgcacacactgtatcccatgccaggtcatctccctgcagacactttgaaattgccccgttattggcaagggtgtggggaaaatgggcattcctgtgccgatgtgagtaatgattgtaaatcaatataagatttctggagggtagtatcaaatgcctctaaaaccatatctcttgtgttctttgcagaatatctgattttaggtctggggaggaaatagctaagcctgaaggctgtgtagtgctagaaagtagggaagtgctcaaaaacaaaaacaaaacaaaaaaccagaaaaccgttattgatggggatatgtcaatggaacataggacccaactaacagagcactcaaaggccaaagctgagcagtttgagcaacaaaatagtaatattggattataacccaaagaataaaataaac

SEQ ID NO: 64983 - DNA, 1585 bp, Homo sapiens
ctattaaacttgcaaagtcagaatgcctgctacctgatttattaacttcccctttatgcccctaaagctctggggacagaagccaaaaagctaagctgcctatatatgcagcctaactaaaaaatggtcacagtgaaacactgtaaaatgattatgataaaatataatcattttatcagcaggtgtttagggtctgaatgtggagcttatggcatgcctctgacatttcagtttcacaggcaccacatcagacagtaagcccaactcagagaagggatacagcattctgcttactggaatgccttagtctcattctgtcaccccatcccctacccacaaccaagaaagtgttaaatttcacaccatcctcctggtcagaatttaggagctcccagttcctttagctaaacttttttgttttacatcccctaaaagaaattttaaaagtatgtgcctttttgcccgtttttaaattaattcctgaaatcatagtatcaagtgtaaatcgttgctaagggtgtgctcactgacatattgtgtagtttatatgagtttttatatatatttttgtcaaaactttggcactgtgaatttagcttattaaatttacaagcaaaggtgcactatataatctaattggcaaagccaattttggtggtcaaaccatccagccaaatcagacttgctttctgtcagattaagtctgatttcatttttttcaatacaaataaacattagcacacacctcatgataaccacctcacttttgaatttgaagtgttagatcgatggatagatagataaaacacacagccttgccaagagtttcctgcctgaatgaaaaaagagattgtctcctttactattgcttgcggttctctcataggactcctctaagggagacattctaaaattgttacatgctaagattcagaagggtgagtgagagtagcatttctgcggaagtgtgggagtatggtgatctgtaaagtgggagtggctgaaacaagaaccttacagagcacaggcatgtttctgagaaggtaagttttaggaagcagtatatatggaagttaaggatttggacattaattttcttaaaactacccaggcccaaatacttcctggaaagtaattacataccacaagggtatccataccccagttttaaggccaccacttttagatacagcagtaccctcaaactagatcagtgaccgagctaaggccggttaactaaacttcactccgtatttgttctccccagtgtttggcaggcatgacttttcttgagacctgccacctagaagggtcagagtgatactcagcctttctagttagtacctgtatttcattaggtctgggttgtcatttaaaaaactctccaagtgagcaaagcaggatactgttgctctccagatatttgaagggtatttggggataggaacacacttgttctggaatgtaatgtttcagctgccagagctaggaacatttgagggaaaggcaggaggaggcaggtttttattcaggataagaaggaaggtgggttgaggaagaagggtaacattttttatcatttgta

SEQ ID NO: 64984 - DNA, 3062 bp, Homo sapiens
ttcttatatgctgtagtcatgggtagagagaagagtaaatcgtaaacaaataaattatgtaatgtgataaggcctatgacagacataagatagagaatcaccagggagtcctacttagtagagtaccttctctgacgaggtggcatatgtccctatggcatgagttgaaatcttggattttttttccaagtgcagagtgccattgagagtgcagatggtagtagcttctccttgttttttctctcctaacagtagatggcttaaggcttagaggaaatcatacacctgatttttaccagcaatttattttgtcagttaagtttaaaagaattatgactctcacctgctcctttaaatagctgctcacgtactgtataccaggtactgtgcattttatatgtattctcttatttaatcctctagtaactcaagaaagtaagttttatcatcattccccctatggccagataaagaaatcagaatttagagaaacgaagtaacttgcctttggccatattgctcaatcatggtagttaagacttaattccaggtatgtctgacataaagtctgtgctatcaaccagtagactaggctgcctcccttcttgtgatatcttaactcacctggttctccttttcctttgtagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggct

SEQ ID NO: 64985 - DNA, 1079 bp, Homo sapiens
agctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccgcacacacacacacaatatttgagagctaaggaaaactcaaagcagccccttcattatcttgcgtactacttcaaagatttctgtcagccctaattacaagtgtcaccatatagttgg

SEQ ID NO: 64986 - DNA, 1080 bp, Homo sapiens
taaacgttatgtagatataataccagcgtgacagcttgtggttggtggtttctagaagaaataattcagaagcaaaagacacatgaagttatgtggcagttcctcactagggaatttggtctccagggccacttttgaccttaatccatgttggagccatcaatcaaagaattgcttgcatctaataatggtgtaatgccaatactaagccctggaacgaagataggattcatttctcatggattattgagcactctggggtaacctggccctgatctgatgacgctaagatttaaaaacccagatgcatgtgactagaactatcttttctcccatgatgcactgctttcaacactgcatgactgtaaaaacatgtgccacgctgattatatatagagatggtctaaatcagctgcatcccatttggtacccaggcaaggatttttccatacctatctttttgctggtggtaatgatgagttttgtcacttgctataacattctctgtccgtcttttttcttttatgtaaatacttttgtgacttcattgtaaccagcattttgtaatactcttaacagcagaggggattaaatcatgattcacttctgaacagtacaatcagcagtaggaaaacgaggagggagggagagggaaattgtccaccacttcccaatgataatgcctggctcggaccccagattcacatcatacttgaagttcataaattctgggcactgctcagcttgaggaggcaggcattgctccttcatatttcagggtgagacaaatgctctgttgaagccatgccactacaggatacattcacctctgcttgctttcctccctaagccagagtgtagttaaacatttatatgtcccaggccaggagatcaaattaagaggaggttagctactttccctggctcttaaaaacatttgagtccaagtatggttctctggcttgagggtggccatttgttgcctcactgtttttattaggacatctggagattagaggtgttaattggaagtaacttttctatatttggtttctctccacacattatgagaccttttag

SEQ ID NO: 64987 - DNA, 1053 bp, Homo sapiens
ggtgagtcggggggcggccggcgaacttcccgcggggcgcggggcgcggggcgcggggcgcagcggccgggtgcgatcgcgtcctctcccgggcgcgggccgctctccgggcgtgggtgagcgcggagggcggaccccggcgccgggctggcccggaccctgccgaggggccgccgcggggtgcgagccgtcctattgtgtgggcgtgcgcgccgggtcgtgttgtgctgtgtgcgcgggcggggctctgtgtgcagtccgggtctggggagcccggcggctgccccgattgggcgtagctcgagtgtggctgtgtgtgtgttgtgtgtgttgaggaacggaggcggggaaaggaaaggagaggagaggagagaactcttccctggtctcatcttcccagacgcctggtcgcgcgcggctgcgttagcctcctctgggcctcttcccgagtctctggcgtgcactccgtgcctcagtttccccacctgcaccgcggagggagtagcaaagctgcttcctttcattcctctctgggactgtttggtttgggtaaagtgagttgaagcaaggccggatctgggaattcatttttccccactgatcctgggaaccgaagctttatttaagacgtctgaccaccctacttgccccgcgatgggcgccctgaccggcgaggggccctgggagaggacacggggcttcatccggcggccctttgaacctggcatcaccaccgcgtgtgcatcccggggcctggaccgcagcaagcctctttcccttccagacagcgtgctgttcccaggaacttttctgctgatgtgggcatgatccgaattccagcctgggagcccttcctcctctgcccctgcccgccgcccacagctgtcagctgtccctcctggactgggcccgcccttggccccttgacgtttatttctgggcatctgatgcctagaatgtgggtgacagggcccagtgaactttcttcagcagaatcttgcctgcctggtgtttgtgccatccacatgtccaatagctgccctattttgccaa

SEQ ID NO: 64988 - DNA, 1020 bp, Homo sapiens
agggtaccacagtaaaggctgaagcctagattctaacttaagcttctctttgccccctacctgggcttttcccactctgtttccaggcttcctgcaccatgcttccatgcctttcctccacagtgctcttgcgaattgacacagtgagattgtttacatgaatgctccccctccccaaatctgttcactttgtggtcactgcccaggatctattcagcagagacatcagctttctttgcaggatactttggtgttcatggtaaatacataaaatacatctcaatccttatgtgaagatgaaactttttcagactaactctggtccttttgctgtgtgtgtgggtgagtgacaaacactaggcggggagatgataccagccagggttcgatttcttgacccgaattgtagttacatgggggttcgttttcattctttgagctctaaattcgtattcccctcttaaaatgtgtttattgtattttagaattaaaaaaataaggtactttccaccatggagatgccttggagtgatggaactgtttttagctatgggattgccccagggatggatctatttttggttgttgggttttcttgtttgttcttttcccctctttctgtcttcaaaatatttaggaaatgcttggaccattctaaccatgcagttttgttgttgttttgccagtgcctctacctgacaaccagggagatttttaagttggctgatcgtgtgtgtgtgtgtgtgtgtgtgtgtgtgtgtgcacatgcacacatgtgcatatgtatgtaactgccttcttctattgttgtgaaaaaatctactcacttggatgctaaggagtaccttgaagatgtttgctgggagagcagccaggtacttttgatatgccgtatttgctcgtcacatcattggcttgatgtttaatacatcttaatatagtacgtggacttttatgacagagtaactgcttggtcgggggagagcaaaagtttacttgagataggattcttagggcttt

SEQ ID NO: 64989 - DNA, 1837 bp, Homo sapiens
tggaaaagccttctgtagtgaggagctttagcttcctgagtgtgcaaatgtcattttctttgtctttggatagttagcaatttcttaatattttatttggttgttcgtcattgtgccatcatctctgccacacccaggcactgtgtctatttccaggggtaggcgaagccatgtaaaacttgttctttgcccttgaagacccaaatgacccactgatggaaatgggattgttgaccttcttcgttatctgggaagggtagaggctctctgccagtgtaatctcggaggcatttctagacaggagttgtactgatggatcttggaccttgatgggaacacagagccgtgaagatgtcacagtgcccaggcaaacatgggtactgcgtcttcagggatatttaatcaatgtgtcattcttgaacaggtttcagaggtgatgacacatgtcctagtttgcttctttagctttcaagataaaatactggtatacgtgtattggtgctctgtgacttttctagctctaggcttctgaggtttgagctagaaatgtcttctgtggcttttggacaatagccttctttaccttatggtcatacacagtatatatgtgtatgtgtgtatgtgtatgtgtatgtctgtgtataccctggttatatatatatactgtatatgtaaaacctttcttaccttctaaatcctgctagattgaaagctccttgagggactgggatcatatattaagtgtctgtgatactttttcttttgtggtgtctagaagagtgagagtggctcccattcattgaaggtttactctgtctggcagggtggcaagcactgtacgtgtcttattttgttataaacttcttgaattacaaacactgcaaaaataatacacgggggccaggagcagtgactcatgcctgtaatcccagcactttggggggccgaggtgggcggatcacgaagtcagaagatcgagaccatcctggctaacatggtgaaaccccgtctcttctaaaaatgcaaaacgttagccgggagtggtggcacgcacctgtaatcccagctacttgggaggctgaggcaggagaatcacttgaacctgggaagtggaggttgcagtgagccgagatcgtgccactgactccagcctgggtgacatagtgagactctgtctcaaaaaataaaaaattaaaaaaaaatacacagactgagtacgtgcttatgatacaaaattcatacaaattagaagtaatggcaataataaaacattaaaatcctccttcatcttcctttcccatttctctcccctcccttaagtaactactgtgaattgtctggtatatatcaatttagctttaacatggatttataattatatacaggtacacacacacagagacataatttaatgagctcctgcttgtctctatttgtagttttttggctggctttttaactcaagtactatatttcatcaattttattttgagccatgtgaatgcgtcacatctgtctcctgttgtttagacatttcagttagtcccaagcaatttggcagtttccctcaccttcccttgctttgctcggctcttgaacagacaccccttttgttgctatctcagaagcacagctgatacaccttcagttatttgtgttttcctcttttaattctcttaaagggctggctcttgctttgcaagaaaatatggaattatggtaatttcttgcagtgagagatatttgcttcactattatcaaattcatgctgtttccctgcctctttgtgtatacacaaatgtgtttaatttttcatttcaatgccacattttaacat

SEQ ID NO: 64990 - DNA, 1930 bp, Homo sapiens
tgcacataactggagggaagtgacgaaataggaacagctgtgaccaagtttacccaggcactgccagtgaccaataaatcacagcttccgcccaccctgtgcttttagaagatgcagttggccattaggtacatcctgatgtcagagatgttacaacatcaaataaaagtgtcttcttggccatctttctttcggctcttatatacctacccatgcttttaaaaacagctttctggtgtgtgtacatactataatttatttaatgctttccctgctggtggatcttatttcattttcagagtagtttattcaggtgggtagtatgctttaccgttttatagatgaggaaactaaaaggttcagtaactttcctaaaccttcgaccagtaagagatagtttcagaattggcacgtgggtctgcgtgacttagacttggtctcctaaccactggccctgctgctttggtatagaatagaaatccaagtctgtatgtgttgggagaagaattgcaccgtctaccttgtgctggagaattccagcattgcatagggatgtcaatattgacttcatgcttatcgtgttggatagaatgatttgttagagagccattggagtggggggcatctcaagttgattctactcaaatggcctgtctttggcagatagaaactgctgttctcctatgtggagaacgtatcagtataggtgttgaaattggcttttgcaaagactgaatttattaaacaaaaataagaataaacaagttatttcagcaccatgacacttgcctttgaatatattaatgatagagataattcttcccccctttatgggaatattttgttggaataccaaccaaaagcaatttcttttcagcacttccctcaaatagtgctgggtgccaaatagaagggcccactgttcaaaaagtctggaaatatattttctagacaaagatacagtactgatgataatgcctcgtatcaaaagagaaattaaagtatttttagaattactttctgaccctgagcttaagcttatatggtccatgtatgagagaacatttcctgaactagagattgatgttctttattgtggaagctgaaattttaatatgttgctccagaaagaaactagaaataattggccccatcttgttgcttcaaactaaggggctcttgtgcgaaagtaggcagtgatgtcttgtgagaaagtaatgccacaggcctgtaaagtgttagctacaggcagagcagagtgaaccccaggattttaaacttactcccaaggcctttccagagacctgagaaccggactctccttttgttgagtcattgtgatatcaagagacaggtgataaattgggtgaattcgctgttgcccaaatccaactgtgatttttgacagacaaatagcgcagtgtgcagacgatgttgtctctgtcctggcgagcggccacggggagggagggcaggccctttagcttactctggaacaggccttgggcatccgggtgctgcaaggatgtggaatttatgaataacttgatttagaagacttgcatacccaaggtgccagtgttccaggtggcagtgggacacttatgtgtttgttggcataaagaaatgaaagcataaagggtgtttaattttattgcattaaaaatcccttctcattattataagaccgagtgagtttggcttagcgaatgtcagaagtgtgtcctctttgatggcattactggaacattttccttcagctttagccttgaatcagagcagtgttctccaggcgtcgttaaactaattggacatggctgaaaaatgagccctagtcacacttgtagttccacagtccgttgaaaaaagcctcttgattgatttggaaagttctaaatttaacttgtttttttattataaaaataaaatt

SEQ ID NO: 64991 - DNA, 1113 bp, Homo sapiens
taaatagagtgaaaagttaaggaaataaaatccattatgtaaggactacttttatggtatcatataagtaatttcatagcattaagcattaaaatagataaacagggttactgcaaatgacaaaagattcattaaaaaacaaatatctgatcatcccacataaaaagacatgaagaattaggaacataatgaaaggatgttgaaggttcttcaagtataaaattagctggtgcttgccaaattttggaaggttaaaatatttagagaatacatagttctaatgttttaagtaaagtctgtgggaatggggaagtgctcatcaggtgctgaggactgggtggtgtgtgcagtgggaatggtgggtgggactgaccagttccttggggagcccccaggggcctttcctacacacctgctccctggatctacagaagtgctcactcatggaagctatggggataaaatccttcctgctaatgagatgagaaggttgattaactttgagttgggcttagtgagtctgacaccagtggctgcccaaggggagtctgctggtgggaatttacaagagcagcttcgggcctctcatatggatggaaagaggatgtaaaggttactgaggagaaggtgtatttttgttatatattattaagctttcatgttatttaaattattcgataacagagctgggtatggtggctcatgcctgtaattccagctactccggaggctgagacaggaggatcgcttgaggccaggagtggagaccagcctgtgcaacatagcaagacccccatctctaaaaataaaattcaaaataattattagaaaacattttcctggttgaatatagtgtattttctcttttaagattttacaatatggattgtgtagagctttgctactcttagtgtggttgacagaccaacagcatcagcatcacctgaatcagaatctgcattttaacaagatccccaagtgatacatgtgcatattaaagtttgagaggcattgatgtggtgattaagaatacaggctttagagtgagtcagtctgggttcagattccagttccttgccttgaccttggctaggtttcttaaactttttaaat

SEQ ID NO: 64992 - DNA, 1057 bp, Homo sapiens
tagccacacactggaagaggaaaactgttctgtgtggagtgcttactgtgtgctccgggtactgtccttagtgcttttaggtcattatttaatcctctcacaatcattcaagtaggtgtcacaggttaaattgtgtcccctgaaaaggtacactgaagccctaaaacctggtacttgtgaatgcaaaccaatttgcaaatggggtcttgacatatgtaattcgttaagacacagttctgttggactggagtgggccctaattcccatgactggtgtctttgtaataagagggggtacacagacactcacagagggaagatggccttgtgaagacagaggcagacactggagcatgtaggtgcagggcaaggaatgccaaggattgccagcaacctccagaagccaggcaaggaaggattctgccctggagttttcagaggaagcatggccctgccgacaccttgaacttctagcctctagaattgtgaaagaacatatttttgttgttttaagccactcagttcgtggcaattaattacagcagcccttggaattagtatagttagaactacttagaagaatattaaccccattttatagatgagtacatcaaggctgagaggtgttaagcatcttgccccaggtcactcagttcataagtggagacagacaaatcaggtcttgcataatgccgctgccaagtccatgcattcattttcatgatggagccagcaaggtggtaactttctaatgctgggtatctaggacatcttaatgagcagtttagtctcaaagggagattgcccagttgcagtttagatctgcttctaatcctggatttggccagaagattccttgattgactctgggggaacctttacctttatagagaggatacaggcctggtattttctgtccaggggatctaagcatggggtggagtatgccatctctccctggtgctcagccaggcctgtgggtcatcaaggacccagcccattctgcagagagtttagacagcttgcccaaagtctatctgtagttggaagaagcatga

SEQ ID NO: 64993 - DNA, 1920 bp, Homo sapiens
agctgtggagtgtttgagttgctgatggattagtgccaatctctctccctgaagaacaagagcatgcagaacaggcatctggaagaaggatggaaattctggcagctgtgttctctgcattttcgttttccccacatttccttaagtcaattttgttacctacagttcctggccaaaataatgcttccatttcctttcccaaaagtcattatagattgattgacctgtagggggtagagaactcagactctaattaaaagatgatgggttaaaggaagttaaaaaccaaaacgaaataacaaacagtataggcactggagtgcaactggtgtaatctttggtactgagctttgtaggacagagaggtataggatgatgccgtgattcatgagagaaggttggagaatggaaccttcaaatgggctgagccagagagctgcccaggaacaggagggagcactggggattttttttttttttttttagaagaagggtgtgaagccaaaaagagttgtcagttgtgtttggatgtgctgatggtggtagagacttctgagaacaggtgagtagagcattgtgtgcccaggctcaggagaatgttcatatagaagataccctgggcaggttggggaatcagttgaagagagggaccctttttgatatcaggtaagaggagttgggctggtgaggggtggaggggtctcattttcctaggagtgtagggtgctgaaaggaaggatagggcctagttcctgaagcagaaatgtgatgatctcagagttggggaccacatggatggggtggggtgatgttggcaggaaacctgcctggtaattctttaaacttgttgtgaatgaatggcgtcatggtagaatttgaacttggaagtgtacacagttagatccttatgtcccttcataattaagacaggcatagttgtagggattagttctgtgagtccagctcttcctgagatgcagaggggtcatatcttggtgggaaaggagggtaggaggcaatatgggactttatggatgttggagctggaaagtttctccccaaaacaggtgatgagagttggctaggtggcctccgaaggagatcgtgtacaggagaggtatggaggcccaggggcaatggatgagggatgctttctggaaacacagacatagacacagtcaggaaggggatgctagtatttcctgtgtaccctcatttcctcccctcctgtgacagtgcatgaatttgacttcattcatcatgaaacttactatgttccaggcatcgtgttagtcacttgggggtactgagttgaataacacaaagtctcttctctaggagcttagtctggtgggggtggggaaggacactatgaggtgtctgagacgatgttggaatgaataagtcttccattttcaaaagagtctattttagttgaattttattatatcgcaaggtggacggtgatttaaggtgtgtgtttgtgtgtgtgtgcgtgtgtgtacacacatgtccatgcatgcatgtgtctgtgtttagctgtgttgctttggctttttatttatcttggagttctagaaatatgcatgcttacaacatatttacaaatgtggttttttgggtgttactgatttattgaaattcaagctcgaattcaataactcaccttattagaatgaaaactgcattgctcaggcatgtgttatgcctattgagtggctttcagagcctgctggaggtaggtaattcagggtggcatggtgctagctccatgctatcagggacccagctccccctcttacttggtattcctgtgctaagtacctcatggcccaagatgactgcttgaataccagccatgtcatctgaattccagttggaggaaggcagaaggcaccaagaaggatgggctccgtcttc

SEQ ID NO: 64994 - DNA, 1013 bp, Homo sapiens
gggaaaaaggccctttcaggcctctttcataaaggtgctaatcccattcatgacctaaccacctcctgaaggccccatctcttaacactattacattgggaattagatttaaacataagaattttggaggtacacagacgctcagaccatagcagtgccttcagatggtgggcttagggaaaacagatggtggtttcaaacctgagcccctacatcagtggtcaccgtggcagactccaggatgtggatatggatttataatagggctgcagcttcctgtgtgggttccatgggatatgctccagagtgaggcacagtggggatcttcttactgattgacaatggcttgtgattctcccaagtgatgcaaggtaagccagcttatttaaaataaccaggatgtctaattcacatttttaggaggaagggaagtaacactgaaggctgtttcccattgcatcaaaggcaaaatccaaactgtagtcgtttgtgaatggaatccctgcctgtctccagcctcacactcactcgaggtgtgcctgcctgcagtgctgcactgctcccttcagccttcgtgcagggtcatccagggcagggcagcttcatccattctgtttgtgacattgtgtaacacgacccagtacggccatcagttaaatgtgtttgctgtcgtggtagctcttcttgatgtactaaactccttgattcaagatgggctgttcctcacacatctttgggaccccagctttgctttgcttgggacatgtgattctgacccagtaccccagacctgaaggcccctctatgtgtcagtcctgaaaggattcgctgttttcttagcctcatggtctctcctaagcaggaggcattgctttacctagagcagattattgagctggaaaagacagttaataggtaaattgatcaccagctgagtccaggatagtcagctcaatgaaacattaaaattttaaacacctgcattcagagttgtttctctaacattccaagtg

SEQ ID NO: 64995 - DNA, 1008 bp, Homo sapiens
tgcgaacaggtgctgataaatccttttctactcactccctgcccaacccagctgaagacttcttttataatattctccccgctagccagatgttttgaaatagcaaaattattaaataataatttgtattgttaaaacatgaatgaaatacagatatagctatgagagtttctacttagaggtcgttcttgttgccttgcagatgtgttttgatttcagccaagaacaaagatatttgatatgtcaattgcccagtgtttaggaaaaaggataattttggttactgcttttgaactagtggtgggaaccttggaaatcccccacagtctggggaccccagtttagaagctattattggggaccctcgggccactgctgaccccaggggaggcaagacttcctcgtttggattttggttttcagattggttgggggaaatctcacatacgggaagaagaagaaaaacaaatataagtaagtttccctttggggccatggtccacttacagctgtgacttggacctttcacttctatttcctaaatgctcacgtcattaggccatacttttgggaaacgtgagggcagtgggcagcgggcgggggttgggggtgggggggctgagtcagagggagggagggttttgtggtgacaaccagaactctgcaggcagagtaacttgggactataactttgctgtctgtttctcagctatgtgaccttggccatgtcacttaaccttcctggtctcagtgtcttcatttgcaaaatggaggcaataacgacctcagtgggtggctgtggggattaagtgggttaaggtttgtgaaaaacaaacaagaacaatgggggtgtccttggctgttagtattaagaacagaaaaataactcatgaatatctcagattctgatagctggtgcacacgctgatgaaaagatttgttttcagatcctcagatttttttaggagtacacttctttaatgttcatttagatggtcctgatgctgt

SEQ ID NO: 64996 - DNA, 1014 bp, Homo sapiens
aaatgactggtttttcaagatagtaggaaagcagtattggccacagagatccaggtggctgcatgaacaagaatgcaaccttgattttatggtctttatttcgttttccaaagtcaaggtccatgagttgattaaaaatatcacaaagtgatttaactattcctcagtaatcttgtagcctattgccatcaaactttgttgacagtgacttatggaaacacattggtatgtccacacacaaatttgtgtgctggtggttcatagcagcattcataatagcctgaaagtggcaacaacccacatgttccccagtggatgaatggataaataaaatgtagtgtatctatacaatgggatattattcagccatacaaaggaacaaagttctgatacatgctacagtatgattgaaccttggaaatattatgctaaatgaaaagaagccagttacaaaagaccacatattgtatcattcaatttataggaaatgtccagaataggcaaatacatggagatagaaagtagataggtggttgcctagggctgagtgggggtttgggaggaaatagggcatggctgctaatgggcatggggtttccttttggggtgatgaaatgttctaaaattgattgtggtgatggttgcacaactctgcatataccaaaagccatagcattgtatactttcaatgggtaaattgtatagtgtgtgagttttatctcttagtcatgctgttaaagatcacatttacattgcaaacaagaacatttatataaaggtgaatcaaaacatacccttcatatctgatatattctaatttattccagtcttttccatttttttctttaaaagtgtctggacatgagccatgatactgaatccataatccacacttttatggattcctttccattttacagatttaaaaaatggcgtcccagtgcttaagaagtgagtacagggttacacaatttataaatgactgagttgagacttcagactgggtctttcttc

SEQ ID NO: 64997 - DNA, 1050 bp, Homo sapiens
cctctggattcggagtagtaatagtaatagcactttaaagtaggctcattactagagcggttattgcttttgttcgaaatggcccatctaagtcaggccctattaaatagagcaatttaactgacacttagcgtctttagggagataaattatcctttggcctggtcacctccactttgaaatttgatcattggtatgagtcctgggagagtcgttcaggcagatgcatttgttcatgtaagcccacatttcagtcattcgttcaggacacatttaatgagggccaactctatacctgacactgtgtaaagccctggatgtgtgataacaatgaagaggacatgggctctgcttttaaggagctcacagcttttattcagtcacgaaacatcgattgggcacctactgtgtgcaaaaagccctgtgcttggtattgcacgggagacaggttagtggcagaatgtgtgtgttcatggggcctttatgatctgtgtagagaacagacttacaatcagttaactgggtgcagcctagaaccgaatgtatgttataaaagaggtgcaggaaagtgctgcgaccctgaggatgcagaggttccttcagttggttggactggagtagcctcatggtagtggtggcattactgatccttgaagaatgtcctctctgttgagagtcagccagattacccggagaaacggcgtttaaagcaggactgctccaggggcctggctgcagccacaagcctctccagaaccgagcctgcccctcctcatctctcctgctgcctgcagattcactccttcttggtgttcttggcttctcattggaggcggctgcgttctcatcctacccactactttctccaggcttcatgtccacgacctgcccaatcccaagtctccctcacgctcttccattcagctcctttggctaacccaaagtgcactaattctgaagacccaaagggaggggtgtatcacctctttgtcttttctggagctccacgtgtgtcactggcctcctggaaatctcctgttggatcaaagg

SEQ ID NO: 64998 - DNA, 1023 bp, Homo sapiens
atcattagggccatttttatgtgaggagggcatattatttgtcatttgtaaagaacacttggggacgcaaaccaggcagaatgggtaaacaaattgggtaaaatcctatattttttcaaaaagccatttgaatgtgcacctgaggcctgaaaatgtggattagatacagattgtgctttgatgagagtgcagttgtacctcaaggaaagcctcctccatcccaactccagggttcatggaagacggtagcattcctatttggtgttgggacctcttcaaggcttgagaaaatataaggaggaatttagaatctggggagagggatcctttctcccaggagtttgttggggtcaagaaatgtaactttaaatgctcctattgcaagattgggtttgtcgatacacaggcaattctttgggtgttccagtcctatggggtgagaaagaatgaatatatatattttttatctgtctctgtatgtgcctgtgtcaattcctagtaaatatttatgggctggcaagttgcaactgggaaaggcccatgtttaactggctaaatattaataagcatattcaagagaactgaggtctttgttttgtcttcttaagaaatgaatccgctcttattcactgtgtattcacaggaaactgtgctgttcagggaagaagtactgccttgttttccttgtaggctttccagcttggatttcgatttccactgaggccttatttttaaaaacatgtttttacagcagcattacaactgtggagattatagcagtctcctacagctttggttatgaaaataatatatatcgtctttttattccctttaattgaccattctcttaccttcctttgtctccacatggagacacggctagatatctccctcctttgtatttttttctctcttctccaacactctgagatcaaggcccaagtaagtacacaccttcacttttatcctggtttcctggtatccagtgaaatggatttcatactgctgaaatgtccatccttt

SEQ ID NO: 64999 - DNA, 1031 bp, Homo sapiens
ggatacagaaagaaacaaaggccaaagttagggtgctaatggtttgggattcaccatggggagaaggtgaatcaacctctctgtggatggaggactggaggcgtgactgagaggcggtctgccacccagtgcagagcagaaacagagggctgactcagagaggcgttgtcacctgctggatgcacttgggcctggctctcttcccctttaacatgtgtctgaccttgattccctgtgagctggctctgtgggcatgggtcatcacagaatgctgggtttgtctatgggcagctgtgtcagatgatgctgacagcacatgttatcacatgcaaagtccttgtgccccggagttctggaggcaagcttttacctgccaaagttgcagtatgaaggactggactacatttgaatttttactttgagccatgaagaattactggtttacactcaagctaatctggaggtaaaggttgcctcacagaaaatcctagggtccatagccttctcaggaaagaaaataataatatgaataaaaaataatatgaataaaaacatgaatttttggttcctatgcccgctcctaccttttaaaataagcaagttattatctgagcgtgaagagacatgttttagttctgtaatcttaaaatgcatgcaaatagggactgtccacaagatggaggaataatcctaatttgaaggaataatccacaaaatgtttatagtattttagcacagggaagcaactgtccatttttccctccttctttttctctctccatttcgatagacactctgttgtgggctctgggctacattagaacacattccctcctgtagtttaaaagttgttcatgagttgtcgggggaagaaaggcacccaacagaaatttgtggagcattatggtaaatgaagagatagaggtttgcataagttatgttgagaggtctgagtgggggcttgtacattgtcttgggggactagggagaaaacccctggagaggtgggctggccaggatacccagggcac

SEQ ID NO: 65000 - DNA, 1038 bp, Homo sapiens
tcataaatgtccagtaaatgcttatggaatgactcaggagggagctctggagttgtggtgtgctgaaggactggtctttttttttttttttcctgcttttccccaaaactcttttactcacatggctccttatctctcagccattgatcacaatggatcagactggtcagatcgatcagatcctggctcccttgaaaatctccccccagggtctactggtagatgaactcagcaccctgcccacctccaccgccacagcactggtgttctctctttgctttctagcctgagggttggctgttcgggttgggggctttggcactttatgaccatgttcagtggagttgaatctgaacttgcagcttggttctcagcttccagtaactcttgaaaggcaattccatgaccttgggaccctgctggaggttacaaatcccaagttcaagattcaatgtggccttttctacctgtgccacctcaggcaggttggttttataggtctgggctcctgtttcctagagtgaaatgatctcccggtattccttccaacttggcccaacttcaaggattctgtgattgtaagggctacagagtgtgaggcctggaaagatcttgcagttcctaatgttggagacattgggagtccagtgctcactcctgtctagaattttaatttttaaccactgctgatggccagaaaagaacatttggattttacaaccagtctttgatggagaaagaaaaaaagtcagtgaacacccattttgtgcctgacattcaagtatgtttgttccctgtatttctccatttagtcctctcagaatctctggaggtggactggggcagattattagtccatttcacagatgaggaaactgaaggtcagagaggttgagtcatctaccagaagtctcacctataccaaaccacacacctttcagttgaggggcgctgaggtccctgctgttgctgtgccgtctgacctgtcccctctctctgacagagagccagctgctccccgggaacaacttcaccaat

SEQ ID NO: 65001 - DNA, 1025 bp, Homo sapiens
aggagtgccaaggattggctttctcgtatgagtgagatgtccggttttttttctgcatcttggttcttggcaagccactgctagccaagggctgaattccaagggccttctgaaggagttgagcctcagaaaacataactggcactctgaagggtctagagaatatcgtggtttaaagctctgtccattaaacacttcagaatgaaaagacatgctctttcacagcgcttacggtgtgcgggaaatccaagacctatgtatattagcgttgcttcttttctcattgagtcattctgtttgtatttggtttttaaatgtctcacctaattcctggcatgatcctcacttcactaaatttctttagtcttaaatgcaaaaccattaatgctatggttaagaacaggggctttgggcccagacagtactgagttcttcccccagcttccatttatgacctgtgcagcccccgggcttaccatgcacctattttctcatctgtaaaatggagataatagcagtgcctatcccagagatgtgatatttcaggggtgatgttttaaacatctagtaagtgctgtgtgcaggccgtaagccagttagaaaggactggatttaaacaataggtactgtttcctggtgcagagaaggtgaagatcagctctgagtctgacatgagctaatatgaggcttgtagctggtgcctggtgtgagttaagcattcagtgaatgctagctgaccctattccctcaaacacatgtatactggtgacatttcctggccagagcaatgctgggagttattactcccctgttcccaacacctccatcctccgcttccccttcccacgcccggtcttttcttgctcttagtttgagagcctgtgccacagaaacaccttcatctgctaggccagtatctgcttttcactgtccagtcttggacacacattcatgagctcacatggaatagcttttagcttagagctccagggagccagccagatgcccaaactggtgcaaaaggg

SEQ ID NO: 65002 - DNA, 1060 bp, Homo sapiens
ggacctatgtcttaatggacctgcagtgggcgcccacccccagagtggctgccatccgctgttctcagctctgctggagccctgcacaattaaacacctaagtggattttaatgacgatattttgcttcagcgctcaggcttctcagcctccatgagtatgtagtcttttccaccttcaccacactggcctgaagtcagcaccactccctatggccttcagcactgtaggcctagaacttgcaaaaattactgtcttcctgaccccctcttgccactccagatgtgctctttgtgccttgtggcctatcatgaggacagactttcagttcagatgttggaatcacagcatgaagtttgaggtgggcatctgataagcacccacctacatacagacgtttccaggttgtcaggctacacttaacatgcgtttgactgtattcaaacttttcttaaaggcccctggtagatttttgaagatgttggtaattttacactaaggggaggaagtacaaagtgctccaaatctttctggttttattagtttcctagggctgctgtaacaacataccacaaactgggtggcttagaacaacagatatttattctttcacagttctggaggctagatgtctaaggcaaggtgtcggcccggccgtggtttctctgaaggttctaggggaggatccttccttgccttgtcctcacttctactgatttgctgtctgatatactttggccactgattagctgtctgatatggtttggctctgtgtccccacccaaatctcaccttgaattgtaataaccctcatgtggtcatgggtgggacctggtgggaggtaattgaatcatgggggtgggtttttcctgtgctgttctcatgatagtgaataagtctcacgagatctgatgggtttttttttttttttcatttcaaaaaatttatttcagtagtttttgagaaacaggtggtttttggttacatggtaagttctttttaaattttattttaagttctgggatacatgtgcagaaagtgcaggtgtgttacataggtat

SEQ ID NO: 65003 - DNA, 1040 bp, Homo sapiens
aatcaatgtcagctgtactcttcctggcagtgtggagatcccagctctgcccctagctagtcacttctcttcttggaatctcagttccttcatctgggaaatgggagcagatgtgaaaaggggcagggtgagaatacatatgaaagtgctggctcctggtgcatagcaggcacttaatacgatacacttttccatcttctgccttccccagggatgcattgtgccatgtaagagagagagcctccagggttggcgagagtttttgatccaggctttttcaggtgtcaaagatgagctgggtgattctccatagattctcctttctaacaggtgacagttctgtttcagaaatactgtggatgttcaggtttacagcacattagtcaaaattagcacctcctcttccctgaaccattttcaggagatggaatccagggatctcttgatagtctggttctgaggagtgggctgggggacagcctaggatggggagccccactccaactacaatgctgtcgagttcccattgacacccccaccccctgcccaggaggtgagaagaatcagactatctacctggggtcccggtgctccctcccttgaagctgggacagaagacccaagactctggttgggaagaagttgagtcaggtctattgagataaggcttcctggagcctagagaaaatctgagaagaacttatccaattaagtatctcccaggagaagagtgactgtttcattttctgaagtgactaaatcccccagttcttagaacgtttgtttcattatttagttaagtctcctgtcacatatctctgctggtgccattctaatcctattctggtggtgatagggggacttggacggcatctgcaagaatcccaccaggcctcttccatctcccttggtccctcctaggtgatagcagctgttgtttgggacctgccactgctttcttggaaactaccaatttaaatgccaatattgtcaccagctgagaagtgagtggtatggagtcgtcttaaagttgtctttta

SEQ ID NO: 65004 - DNA, 1054 bp, Homo sapiens
tctgccacttgtcagccaagaaatcttgtgcaagtcactgagttctttaggttgcagttttctcatctggaggagggatgaagtacctcatctcagtggagcgcccagcactggggttgatgccctctgagcactcaggagatgtctctttgattttcctttaatcattagtaataagtagtaggaataataacaacaaccctccagtggctcccagattgcacatgaaatcaagtgtgtcttagagagccctcctggctggtccctcctgtctcttcagcagcagctccttccctcctgctctccgcccgccagctctgtctcacaccctggtgctgtggcacatgccatttccctctgtgcctctgtcttccaggcacaacactggaatctcactggagcactcacaccacttcccccagaagcaaagagccacgtcttccttcacgcttctggtcagtcttgggggtttttctgaagcatatgacctactttatcaactccatttgcttataggtctgcgtctctgtcagattgcgagctctttaagttatgcttgcatccctggcatcgggtttggctgacactcattgtggactgtttgaatgaatgaatgatttagtggcactgcaaatcaaaacccagtccactggtatagagggagagccctctgaatgtctgagatgatcttaccttgttacatacaaaaacttagaaatccttcttgagtcctctgttttagtaattgcccactctccctattctaatccattagcaagcccagtcaactctacttctaaagcagtgggtctcagtcagaggtgattttaaccctcatagtcatttggcaatgtatagagacatttttgatggtcacaattggggttgcagctggtgtatatggatagaggctaggaaagatgtgaaacaccttacaatgtataggacagtcacctcaacaaagaattatccagctttagtgtgaagagtgctgaggttgaggaaccctgatttagaggatactgagttcattcacagctctctgtcttcccca

SEQ ID NO: 65005 - DNA, 1110 bp, Homo sapiens
tcttgtgtccaggtttggctggccagccttacagcatgggctttgagtctgccagcttagaagataagcttactgcttcctgagcgggacacacgccaggctggaagaagttccagggtccccaagggaacttgctggcctccctggtaatgtgctgtgttttccctctgcagcagcaaaccctctgctttgctccaccgcccgctaccactgcaagaacggcctctgtattgacaagagcttcatctgcgatggacagaataactgtcaagacaacagtgatgaggaaagctgtgaaagttctcaaggtaggaacctctcaagctctaaaaagataattgcaacacaacactgcagtaatggaacaccctgaaaggcagaaagcaacacccattcccattccaaacacaatagctctgttagtttttgcactcagccttgcagcccttgtacaggtaggtacccgtgtttacgtggctttaactacaacacacctaccattttgaattttgtattgttcctgaattaaatatcatctatacatttctcttcaaaactgtaatatgccccaactgtgttacatactgtcatgttactctcctgtggttttctgagacaacgctttattggggcaatccaggttgtttctttcccttgaattacttctttgggataaagtctgcagagtgggatgtctgcacaggtgtctgttacacctcagcatgcagctgtgtttttttttcttttttaagtttacattgctgacatcattgtctgtgcctgtcagttttactgtgctatcacagacattcacaggcatcacaactgctgccctattttttttttcccatttttgctaatttggtagtcatagaataacaacctccccaaatgctttcatttgcatttctctgattatgagcagagttcacattttttcccgtcatgtttgtttactgctttgtttccttttctgtgaattgcctccttgtgtctgggctattgattttggggctgtctcatggaagctgagggatgcagctggaggatgggaagatgagctttgttagggagtctgaggaggacacaatgggataaggtcatgtcctc

SEQ ID NO: 65006 - DNA, 1014 bp, Homo sapiens
ggaggcgagtcttggatagaattagcttctgattgtctttgcctggaaaatgcctttcttgggtcgactcttcacagtggttctcaaagtataatcctcagtccgggagcatcagcatcacatgagaactccgaaaatgcagttgttcaggcgccattctagaccagctaaatcaactggtgtcggtgggcccagccagaaatgcagttgttcaggccccgttctagatcagctaaatcaactggcgggagtgggcccagccatcggcgttttacttaagaagccctcaaggtgattctaatgcacactgaaggctgagctccaccattctacagtcacctgagagaggtttataatcctgccatttgcctagaaatttccaaacttctgactgaacgcaacgtattgctggcctttacacaagatcaaatttttataaaaccaaacatgccaatgtcttgccagtgatggacaccaaatagggaacaagaatgcaaaatcaagtaagtattagcatagataggaaggattgaggaacattttctatggcgattgtttctttttttggggggatggcatggacggagtcttgctctgtcacccaggctgaagtgcagtggcgtgatcttggctcagtgcaacctctgcctcccgggttcaagcgattctcctgcctcagcctcccaagtagctgggactacaggcgtgtgccaccacgcccagctaatttttgtatttttagtagagatgggtttcaccatgttggccaggatggtcttgatctcttgaccttgtgatctgcctgcctcagcctccccaagtgccgggatttacaggcgtgagccactgcgcccggcctatacagtttcttaagtgtgtatgtatcctggactcacttactcatggtgccctaagacgttcagtgaaaagactcccacgtctaagatgtggaggttaggcctgtcaatagtttgggcaacaccctcttctgtgcccatcccagtattttactga

SEQ ID NO: 65007 - DNA, 1654 bp, Homo sapiens
ttagccgggatggtctccatctcctgacctcatgatccgcccgcctcggcctcccaaagtgctgggattacaggcgtgagccaccgtgcctggcccagtatttaatcattcttaagtgtgtatgtgtcctggactcacttactcagggtgccctaagacgttcagtgaaaagactcccaagtctaagacgtggaggttaggcgtgccgaaggtttgggcaacacccttttccacgcccatcccagtgttttactgaagcagatttttgtttgcccttaagaagaatgacaagtccctctgtaggccgtttgaagtttgcatttttaaatcctgcttttctctcttcatgttccatgtttgtgactggcttatttcacttagcataatgtcctcacggtccatccatgttgtagcctatctcagaatttccttcctttttaaagctgagtggtattcaggtgtatatatgtcacatttggtttatccattcatccattgatggacacttaggttgcttccaccttttgactattgtgaatcattatggtaagacatgagtgtatggattgtgactcgcttttaacaaagaaaatgcagcaaaagtggcggctgtcagtcccgaggttagatgatggagccactctagcattgtcttgcctgccctcgctggctagctctctcccactcttgaggcaagccagctgccatattgtgagccgccctactcagaggcccatatggcaagggacggaaggagggctccaacctaagctagcggggaaccgaggcctgccaatagccacatgagtgaggttggaagtgggtcctcccctagtcaaacagagacatctgcagccccggctgacacgccgactgtagccttgtaagactccctgagccagggtgtggccactcctgggtttctgacccatagaaactgtgagatcataaatgtttgtttgtttaaacctctaagttttgggggtcattttttctgccacattagataactgacatactgaatacttctcaggtgggctccaattctcactgctctaaccacagagagcttgtggtgactcaggtcacagtgatcggtgaaacctttggaagatcatgcaggggtttataagaatagcaaacatttggagtactaactgcatgtcaggcaccattctgagcattattgtattttcctgtacagttctcacagattccctctgagagtgggtgctcttatcacaccccttttctagatgaagaaactgaggaacacatagtttgttcctggtctagtccgcacagggagcaggtggtggagccaggatggggactcggctcatcacactgacggacagactcatgtttttcatcaccccataagactcctgtctggtaacactgagctgggcccaggactttcaggcggtcagtcctactcttggcctgtgagtttatgggggagattagtatgaagactggcatgttttccctctctttgtactccaaaagttttcctttccatgaaaaagaataatgtgcctgtccaccttccctcctcctgaggaatgtctggcagttaagctcttctcaagcagccaccaatgccgggagagttaattaagtgttttggcagtttctttatcttgcttgc

SEQ ID NO: 65008 - DNA, 1017 bp, Homo sapiens
ccaatttgcatctggaggagacctccaaggacagatgccttgtcctcattagctaatttgtcaggcagtctttcctgtgtggcacagaaccttttatagatttttcctcaaactcgttttggttggccagtgcctgcctgcctttctttctggaaatgtgctgtgtatttgtggggacgtgactccatggtgcgtctctcttcccaatacattccctttcccctatccacagccctgttacttctgtctttcttccactctcagtgcagcaattttaaagtacatccacagattctttggcactcctacctttgagaggtacagactgtgtccctacttctggaaactgggccagctattgtgactattttgatcagtagagtatggcagaaatgatgctatgtgatttctacgaataggatataaaaggcgacatggcctcttccgtgtccagaatacccctcttgagagcttcagccaccatgtgaatgtggtgccctgagactgccatattgtgaggaagcccgaactatctacacaaagagaccctggagaggccaatgagaggagagagatgcttgggccacccctggctgcttcagccactgctgtcccagctgcagatactgtctgactgcaatgacttgtgagacctggaaccaaaaccaccgcttccttctcaaattcctaaaccatagaaactgtgagagatgataaagatggtgttaaatttggggatgatttgttatgtagtagttgctgattggaacctcagtcaataaaaaggcatctccttgctgcatcgtcagtgtgctcgtcttgatagagaagctaatagtaggtacccattttcagagtcttacttttcctaggggcagctcgaacctttcactggacccccgcttcccaagagagcattcatgtggcccttgtgttcctgaactctgtcaaagatgaccactccctgaggttgcacacgaaggccagaaaggctactgacctcaagctctgctgtgt

SEQ ID NO: 65009 - DNA, 1026 bp, Homo sapiens
gctgtaccacttagtagctctgtgattttgagcaagttacttaaccactctgagcttcacaaaggcaaccaggcctgcctctaggattgctgggaggaaatgtgagaaaggctgtccagcacttagcaggtacttctaagtgtgagttccattccccatggaccaccattcccctatataaccagcaaccatcagagctaccagcccaagccattccatctttcgaaaaacaccaaattgaagaaccagatgggttccccagtgtactctgtctctgacagctgacaagggttttctttttcctgcctaccagcaagaagccagcgtcccagcttggttccatctggtatcttgcttcctggcctaacaaaaaaaggaaataccagtggaatgttcacatatagctgggggtgaaaccgaccctcttccaggaaggcggggatggggggatgctcataaggcgcttctattgtctaaagtgcccactataataactcccccaattgtgttcagagaaactgtattacaaataacagagctgaatctcgtattagcctttgttaattcagtgttaggcacctgggatgcatccttggacaagagagactccctgcattatgtggttctcttcatttctagtgattggcacctcagatatcaagggaggagactaaaaaaataaaaaataaaaaaataaaaaaataacaactggcactagtttaaaagccacgtgtaattcttgattagttttcttgattagtttggggaaattaaccatattttgattatttatcaggacaaagacttgccttgtcattgcctgagtaacctttctttttctttttttctttttttttttttttgagatagagtctcactctgtcacccaggctggacttcagtagcgcaatcttgggtcactgcaacctctgcctcccgggttcaaccaattctcgtgcctcagcctcctgagtagctgggactacaggcgcgagctgccatgcccggctaatttttgtattttta

SEQ ID NO: 65010 - DNA, 1134 bp, Homo sapiens
cacgtacacccagggcattctaccctgtcctgtaaaacagcaagggcccactttgtccaccaccacaatggcgatggctcctgggaagggtgcgccatgagtatcaaattattatggttcgggaaaataattgctggttgtggaattctggagaagtagtatcgcaaaagagagacatgcacagaagtgttcaggcagggagagctggtttgtataaataagagcttgatgagctatctgttatgatttatgctaggaatccatagcctctgtgcttctcacacagtacataaacccaaaaggtcgcctctagtttggagtggtgatgctgtgccagtgtgggagcaggcaaggccgtgaggccttcttcctcacaaatccagcacctcccacctgccatcgggtaaagagagggagggcactgcaatggctggtgttactgagccctcgcggcatgccaggcactgctcattcgtgttttacaccatttcggaatcctttgaggaagttatttctattatcacaatccccattttacaggaggggaaagtgaggttaagggagacaatgggataggcatgaggtcatccagtaaatggcagagccaggattcgaacccacactcttgtgacctcagagcccaagctcttaactatgccttccacagacacaatccatgcaccttaggatttttacctgaggttcttagtttggtttgggggaccaaaggaacaagtaaacaagcagaaaatgatgaggaagggctgtgctgtgtgcccaagcgaggaagcaaaaggatgggcatgaacaatttgtagatgccatccagaacagagtggtcaaggatttggaggctcagtgcagggggagaagtgggaagggcttgtgctgtacacatgagggttaggaactgatgaagccacctccccaagcctcagattttccatctgaaaaatggaaacaggattcatctccttaattgtgactatcaagtgtaataacgttggtaaagagcttagcacaggcttggcacatggtaggactccataaatagacactgcaattattcgttctgtggttactgcatgacgatgatgataacaataataattactattattattaagcaggaac

SEQ ID NO: 65011 - DNA, 1004 bp, Homo sapiens
gaccagtgggtgtcctgaatggctaagtaattagaacatgcataatcacccagagttaaacccactgccgagcaagtgcatcctgtgaactcgactgtgtaaacaaaattgtgcagaatcagcccaaaaggaaaattcaacaaatgtgagcagtggtcatccctggtggtggattgtagagaatttaatgtctggttttgcccatttttcagttttttacactgagcacattactgttgtgttttgaaagaaagacacgcattaaaaaataaccaacacctgtattcttgtcaacacttgatcttgcaatcttaatatagaagactgcaaaaaaatgactgttagaagctaaagatacaggtttaaggaatgtctttactttattgtttatataatgaaatattaatataataaaactacagatttgcatatggaattggggttaaacagaggtttgaaggattatcaattatgaatagtttatggtgaaagttacacaataaaacagtactgagaggaaggtgtttttcacttatatatttgaatttatatagtacatgctgtttaatcctggctggttccttaaatctcactttgtctcagtttcaccatctgtaaaattggggtactagcctgttaggttatttttaggaagatgtgattaatatttgtgaaattcttagaacaggattggaacatagtaggtactcaagaaatgcttgatgctgctgggttagtcttattgttgtgatacagaggctttgacaacagtttttgctcctacatcagaagtaacagtaggtaaagctataatgttagttaacctgagtagacttcttaccatgtctgagccaccatgctaagttttttatttaggttatgtcatttgctcctcaaatctgcttcatatcagtttaggatgtaagggctcagagaggttaagtgacctgcccaagatcacacagcttgtaagaatttgattccaaagctcatgctctgaatca

SEQ ID NO: 65012 - DNA, 1068 bp, Homo sapiens
gaagagaagagtcttcccggtggagggagcagcatttgtgagggcataaggtaaagagaatggggctgacgggatagaactcacaaatgaagtgtgcagaggcttgtctggatgtgtccacgggggctggaaggggctggattttagaaaaagtattaagatcccagccttgatcctcaggacagcgtgaggccatcaaaaggttcggaaggaagtttggagggcagaaggctggagggaatgcttccttgcccagatgaagcctgaatgactcgcagggctggggcaagctgccgccagttttatccacaaagcagcaaccacttctgctaagatagtgatgactccgagcccctccagctcccctgttctcctcaaccctggtctgagcgcctgctttgtgcgagtcattcaggcttcatcaaggcactatgttaatgttaggtccttcttacagatcagcccacgtagtcctcacagcagctggttgaggagctattatcatcatccccacttggcagtggtaggtagaggctgaggctgagagagttgcccaggttcactctactggaaggagccagctctggaatctggaattcagccccaggcctctctcagtccaagtccagtgcgcactatctctttcatggactgcctcccattctcaggatcctaatgtctttatctaaccctgctggtggccagaagcctctacctggtacccgtcacaacccaggtgagaccaggcatctcaggatgcctcacctgacttccagctggaatccaacctgagctgtgcagttggctcaaagggtggccaaccagaggagcagatttatccacattggcatcagaaaaaccactctaggccgggcacagtggctcatgcctgtaaggctcatgccttgagaggctttccctgttctcccagctctcaccccaccaccagtaatctgtgcttaaacgagctgtcttgcctttccacgcaaatgaattggagatggtgaggctccaggcagcagcagacgcatctcaaagctggtttggggcataagagctttctctcta

SEQ ID NO: 65013 - DNA, 1889 bp, Homo sapiens
tcttccagctcccctgcctctaggtttctctcctggttactcttatgtccccagttctccactctcagcacccttcttttctccattttccctgtttcccctctctctttccctcctcttcctcactgttgtaggtgcagcaaaagaagagtgatgtttggtggatacttgggataactgagcttccaccttcttttgactcagcctggagatgcagcctctcaacttttctgtataaatcatttaaacacacggtttaataagcacagagttttgctgtggcttgtctctggtctttcagatcaaagccagaagtccagggaaatgtctgggaaaagtcgtgcctctgcattccagttctgtgcattttgattcttgaaagattgattgctggctttttgccctttccccatggctggggtttgggaagattctggagagttgttatttctggcccctaagccttgaggggtggcaacaattctgaccttgctttccttcttcctgccttctgttcccattctgagtcttctcattatcctgagtgtttaaaatgataaactccttcatggcatcacctacccatctcccaaaacagtgatttaaaaagcatgaaaaaccccaggtaaaatgaagtcaaacagatttctttgttttggaactactacaagtcttggatgctttagaaatccgtaagtggggttgggcacggtggctcacgctgtaaccccagcactttgggaagccgaggcgggcggatcacttgaggccaggagttcaacaccagcctggccaacatggtgaaacaccgtctctactaaaaatccaaaaattagttgggtgtggtggtgcacacctgtaatcccagctactcaggaggctgaggcaggagaatcgtttgaacccgggaggcagaggttgcagtgagccgagatagcaccactgcactccagcccaggcaacagagtgagactccatctcaaaaaaagaagaagaaaaaataaatccctaagtgggagatacagtatttggcattttccaaaagtacccaaccaaggaattatttcttggagttacatctcgtggatcaacactaccaacactctagctctgaaggacctgctagcattattccttcaggataagatattccttctatataacccagttcatctgtgcacatgaatctgtgtacactgagtcctgtgctctatgccgattggccttcatgaatgtgtgctgcagggggcatgctggcctatctcagaaggattaagttgaggcataaaagcctgagtgcccactgtgcaccagatgtttcatatacactgtcttaggtagacttcacaacaaccccacaaggtagatcctgtttttcctatttcacaattgaggccagtgtacagagaagtaaagtaagttactgatacagtttggttatttgtccctgcccaaatctcacgttgaattgtaatccccagtgctggaggtggggcctggtgggaggtgtttggatcatgggggcggatccttcatggcttggtgctgtctctatgatagtgagttctcttgagatatggttgtttaaaagtgtgtggcacctcccgccagactctgtcttacttgcttctgctttcaccatgtgacatgcctgctcctccttcaccttctgccatgatggaaagtttcccgaggcccacccagaagctgagtagatgcctgcaccatgcctcttgtaaagcctgcagaactgtgagccaactaatcctcttttttttttttttgagacagagtcttagtcacccaggctggagtacagtggcgcgatcttagctcacggttacccctgtctcctgagttcaagcaattcttgtgcctcagcctcctga

SEQ ID NO: 65014 - DNA, 1066 bp, Homo sapiens
gaaagtgttcagtttttttaaaagtcaaaccacatcttaagggtggaatttactgggccatacgtaactcaggggccctttaatctgttgcatttgaggtgcatcaccctgagtgcttgaagatcagggagttgggtccaaggctggcagtgacaccagcaggctgtcctctgcaagggaaccatctattgccttgtgggcaagaacatgggctctggattcagagagatctgggttcaaatcctgactctcacctttcttaactttgtgaccataacatttctgaaaggcaagtaaatgggattgctaatagtacctacttccttgggtggttgggaggattaaatgagataatgtgtgtcgtgcctagcacagtgcctggcacatgatgcgggaatagatcagttagtttttattgatagtctcttttatcttttgtgcagtaaagtagtttgaccaaatcaaagagtcccaaagtaaggtcttgacaaacatattggtggaggtggctctcagactattttcagtattaattagaagtgcctgatgtctttgcctttgactggactcactccaacttcatagcaacacccattatctcatggaggtcagaggcttggtttggcagtgacatttgtttatgattagttaaaaatgggaatcatattaattagtatttaatagctgcattttggtgacagattttgctaccaagctgcccttacacatcttacttggaaaatgcctctggtttagaagatggcagttgtcagaacatgtgatgcttggggggtttgaggggtaggtggacattgaagatttgtggtggtagaaagtttaagacccttggtctggatggtgttttctagttaaccttctctgattctgtgagtcctgcctgtgcagagagcacagtaatagggtaacatgtaatccctatgtaatagggaacctgactgtttacctatacacaccttgcctaccctttcttctcccacccattatgccctagctggtggccttggcttaagccagataaatgtccttataatctcaggaaaatgca

SEQ ID NO: 65015 - DNA, 1395 bp, Homo sapiens
gcatatgccctgtggtattacaagggtgagccaccagcttgagtctttattgcctgggcctttatttcttttccttttttccattagttgttttttatttttatttttatttcttttgagacagagtttcactgtgttgcccaggctggagtgcagtggtgcaatcctggctcactgcaacctccacctcccaggtttaagcgattctcctgcctcagccttgcgagtagctgagattataggcacccaccaccagcctcggctaatggttgtattgttagtagagacggggtttcaccatgttggccaggctggtcttgaactcctgacctcagtgatctgcccacctcggcctcccaaaatgctgggattacaggcgtgagccaccacacctggccagattgttttcattgtttctgtttttcttattaaataaatgttatatatctagcatagggattttagaaaaggagcccagtgatggtcctctccttggttctcaaccctgtgatctttgtgttttaacccctgccctgtcactttagggatctggaagcgggaaggagacatctgcgagtgctcagatgactatctcgatacactcagggtgtattttctggggtgactgtaggggcatctcggttcatttggtggcaaatccaacttttctattccctaacgaggactttgctgcctttatgatttttctctcactgcctgcttttggaaaaatcttctgacagttatatttaccagtagaactagaagggaatgcttcagtctatcctgtgtttagagtcatggagttggaggaggtttgggtgggaatctgagtgacagccaaggagaaggagatagggccgtcttggggttttctgcagtctcagactctgggtctttgtatgacccttgggaacatgaagcagccagggaatggagccaggaccactttaccccagcaagactcccaagctatatcttcaaaggtctgagggacatggtgcattcacttgtcttctgctacccacagatgaccagctctgtgaaggaggcatcccctggcttgggtaggcagaaagtgttggaaaggaattgaagtaacatttcagtttgaaggttttgtaacagatggtggtggcagctgctctaggagagacaaatgaagttagtgaaatggtccttcattcagtctaccttgtgcatccatccatttagccaactgtgttgatacgtatgatgaaccaggccccatgtcgcacactgggatgataaagagagaacacctggccacagcgtctggaaactccttatctaagaagagggacagactcatgcccacatgatgagttctgttgagtaccaaggtagcagaaaaggggagctttgaactccatt

SEQ ID NO: 65016 - DNA, 1043 bp, Homo sapiens
gaggcactgctggccactgtgccaagaccttcatatagataatctcagccctaacagttggactctgttaccgccattttacgaagaaggaaactaaggctacaaatgttaagtttcttgcccagggccacatagctagtaaacaattgggctgggctgtagtcaactcaggtctctttccaaagcccatggtctttccatggcactccgctccctccttaatagatgctaagttccgtgagggcgggatcccactttgaattgtttttagtcttccacctcctccattgagcttgataaatgtatattggtcaaaatccccagtcctgtctagtgccagttacacatcagtgtctgtagtagagaccctggcgctagcatgaattctaccaagcaggctagactttacaatcaatcaatagaataaaaggaaggaaaataaacagttcctcccagcccactgagtactattgtcttgtctcttagtaccactacaaggaaatgctagatcatgagctggggctaccagagagcttcatagacttgaccccaacactttagctggatgacttggagaaaattaccccaaagtgtctgcagtgacttctgtgaccaccaccagcttcccaaaccagcccatccaactcccttttcctgagtgaggtaaaaactggtagaaccaaggaatgctgaatttccaaacgcctcctaagggaactgaaaccgcaaattggccacttggctgagaaatgctctctttccctccaacacacactttccttttcctttagctaaagaatccatagatgagtctcactttgtgatacacgtgctcctgaaagctgtgtggaattgagtcattttctaaattcaccagggaatctttccattttaaagaaaatctctagtcagttataaaaccagatgctatcagagacagaaagaccattagaggtttatctaattcagctttcgtctcattttacagatgagaaaaccagagaggttaagtgacttggccacagtcacacagctcgttagcg

SEQ ID NO: 65017 - DNA, 1034 bp, Homo sapiens
aattagccaggatcctgagcttggctaatggtgggcccagtgaatgcttgatttgcaatggaaatgcccaatttggtatggagtctccatttttaaaatgcattggctaactttgcagcttcccccatccccttctcatgacagtctccctttctggaatatttcaaatgcaaagggggaaacagggttgtcgttatatctggatcctatccacaagggctcagcagctgtgatgttcagcaggccaaatacagacccaagagaccaaacagcttcttccttccccaagcagttaaaacaaagatctgctcactgccttgcctgtgtgtcttcatgggtgtttgatatcagggtaaactctaggggctaaaagtgggagcagaaaaagcaatgcaaacgcattaggcgagaagccagggcggatcagcaaaaggtctggaattatggaaggctgaagataagcagttttggttgatttccaacacaggcagttgcctgctttaatgtctggataagaacttgcctgtaattggtagatggattgcttggctataaatggagcctgaaaagagtctattcccttccagcaattaaacatccccctgactgctgccactttctccactctgattattcagcagacccattcttcttaatacacagcaccgaggtgtggcttagcccagcctggtttgaattagcttatgggatccacattaatgaagcctagccttacttccctgcatatgatgtgtgactgggtatagtcaagtgcccagtgtaggtaaatagatttcggagaatggtgatgtaagatacctaccaaccatatgtggaaatccttttcaggatggtttccctctgcaagactgtaaaggtaggaaatgcactgcctttcccaccccttcactcctgcacccatttgataacccacttgagtgtttagaacagtcttccaaagagggatgtgtgcaaggtgattgtttagggaaggaagggagggagggagggagggaaaagggagagagaaaggg

SEQ ID NO: 65018 - DNA, 1148 bp, Homo sapiens
acagaagcagggaattaatgatccaaagattctagttaacaagatgatcacccaggtttcaaaaaataagtgatctcatttttatggcttaaatattttagtaaccgttgagtgcctactgtttatatttcttttctaggctgactggcttgcttcctccctccctccctccctccctccctccctcccttccttccttccttccttccttcctctattccatcctctcctctcctccctcctctcccatcctagacagcttaggtgaagggctgacagagggaaattgactggctaatctatgtgcagtagcccctggttcctgctctttccgctgaacatgatttatagttgtttggcagaaggtcaaaatctgattccatagagtgggaatgcagggggaaatatttgatttctttgacacagttcattaaaaattcatacatatggatctggaaatgaaacattgctccatgtcaacatgagttacagtgggagcctagagcaagacatgagtattcaagtgagacactgtcaccaggtaatcacatcggcatggcagtgcctctcagtgagacatggaagggggaaaggtgacctggactctggagggtggaaatgaaatttttctcttttgcctaaaggctttccttgtaaatagaagccagtttgttagaaaacctctgttacaaagagcccatttcattcatgtattcttttgtccatttgtttgacaaatatttatttattttccactattggtaaggtgtatattgattaataagagagatgacttatttcaaatttccctgttatttctactttgtttcttaattcttcctctttgaccctttactttagagctatctgacttttacaatgtctagacttcaagccttttattataaatactgtaaatggttggaaacatgatcttctagcccagtacttctcaaattgtaatgtacacacaaatcatctggggatctgttaaaatgaagattctgattcagtaggtccaggatggggccagagagaatgcatgtctgtcaaattcccaggagatgccgctgctgctgatccaagcaccatttgaatagcgaggctctagtctaccatatctgtactgggttgaataatgttctcca

SEQ ID NO: 65019 - DNA, 1086 bp, Homo sapiens
tagattgaatttcaagagatgaaagtgaggtttttaagtaatagcaaagccttgtgtttctgtagtactttgtgctttttgaagtgctttcacagtcattatcctgtttgatcctactaagaaccctgaaagtacataggttggtggtttttatcctgagactacaaatgataccaaggataacgatgagtaggaatcagagctagaattaacccctattttcttactattgacccagcatgctttctatgttgaaaagtgcaccacatcgagaagagattggtcaccgcagcacagggcacgcagaattccattagtatcacttacctgggaagtccaggtgccttcaatagttgaggggagtaaatgatatgactacctaccttcaaaacttgtagtttaaagtggtaacttgaatactcacatttacctctgtttccttcctctaaaagaatggttttttaaagggtaaatccacagggacaaagaaaaggagaggaaaaccagcaaaaaaaaaaaaaaaaaaaaaaaaaaaattgtggaagctggagaacaaatgggtgagctatgactggattagtgaactcagaaaatggaattctaagctggcactcaggagaaccaagaggcaaccagatatacttccagaaggcctgggaattggcaacttgagataactctggaaacagaagagatgggctaaaaatgggaagattagttgaaatttcgttaggaagctatgacactttcatattccttccctatgctacacagcctagcgactgcccctctcacacccaggcagaagactggagcttactctctgctgagggtagaacaggtctctggaataccagatatgaagcacagctgagaatgggggtccgtttctgaaaacagggatttagcataagtcaacataatgaacattgaaactactagcccttttcctcaagtcaggtcccagaacacagccagccaggctcatattccttctaagcaggagtttataaaagtcttctttgggaaaactcaccagtttaagagattggatgtcaatgaagtggcgcaactgaatcatctaat

SEQ ID NO: 65020 - DNA, 1043 bp, Homo sapiens
ctcccaatcttggatccaccttaatgatggaagcacagatgctgtgggaacatttcagaagcctgtgacctgacttttttctctgcaggtaactgcaggatgagtggttttttgaaaaacccaattctgagcattttggtctaccacaaactagaggagaaggcagaagtgccatctaaatgggtttgggtcacacacaaagcatcacaaggccgctttgtggggtaagttataatgctgccctgctcttcaaagcaaagccacatgcatatatctggcatatgtgcaggataagaattcattctctttttctctcacactcctaggcaacctggattaggtccagggcatgaattgtgacaccttccattacaaactccaaatgcagaatgtgttaccggagttgtctccctggaaccttttagggtgaatgatggagactcctttcctgagatgagatcttgccacttgctccccggccaaaccagccaaagcctcaggggccaaatgcacatgctcgtgagtatagcaattcagagcatggactttggagccaaactcaacggagttcaaatctggaccttgctacttactagctgggtgcaactcagaggaagttacttcacttccctgatcctccattttctcttctgtaaaatgggaataatagtagtgtctatgttgtaacattaaagaagacctaggatatgcttttagcacctatcatacattagctattaactcagtattatatttgctgtatcattgtgggaaaatcacggaatctctccgagccccagtttcctcatctgtaaaatgggggtaatgctgcatcctcgagagtgttgggaacattctgtgagccaatgtatacaaattgcttagcccaaaatatggcaactagtgagagctcaattcatgaaggtgattattactttcctgccttttcctttccacagcttctctcctaattcaggcctactttccttttgtctggccaccaaaatagcttatctggccaccctgagtctctctccctcttt

SEQ ID NO: 65021 - DNA, 1013 bp, Homo sapiens
atttttaaattttttatagagacagtgtctcactgtgttgcccaggctggagtacggtagtgcaatcatagttcaccgtgaccttgaactcttggcctcaagcgatcctcccatctcagcctccaaaagtgctgagattacaggtgtgagcccccgcgtccagccctgtgctacatactttataacgaccatgtctgatcttcacaaacacctcatgagatgcatgctcttatccttcattttacagatgaggaaaacaggctcaggagtttaagtaacttgccacagttgcaaagccaataaatcgtagagccaggattcagacatgggtctgtcagcctccagagtctgtggtctgtgttggatgtcagtgcatcatcgtctcaactcctttttaatgtccatgggcacccatccaacaggtaggaaaacctggcccaacaaaggcagtctttaattttgctcactggtggtaagagccggagtgcgagtgttggacatcttggaaaatttccccaggcggcacatgagatgatatttggatacttgcaaagaactttctagaatctccacagcaaagagttaaagaagtgtagattgtccctcactgtaatgattacggggtcttgtttttatttaacatggagcactttgtctgagcttctcatttccaaatgcataaccccagaaggcttctccacccttgccccttcactgttaggtcacaacatctcagctagtgactttctttggtttgggaagcacactttttgaggtcagctgttactttctggaatagtgtgtgatttctgaaggcagttacagctcaccagaggggccaggatgggccccagtgaatgctggttccacggcacttttccaattctcattaagcacaatggcttttagtttaaaaaaaaaaaaatccatcacagacgtacataccagactgccattagctgacccggggagaaccttttgccaagtgaagcaatttccttcttctgtagtta

SEQ ID NO: 65022 - DNA, 1022 bp, Homo sapiens
ctaaaccattgctaggagtttgtatttccagtacagtgagcaatgcttggtgggaatataaagcaggaaacataccatggtcttatttatttcctaaaacgagctttgtaggtgctgtgtggaaaatggattggagaggggcaagatcagaaattgggagaccaagtagaggttcacatggtaatccatgcaacagatgatggtaacttgtcccatattatggaagcagaatcagcaggacctgcccctgagttggacatgaatggaaaaggaaaggaaggaaccaggtttaacactgaggcctgcagctccagtgactgcctggggtccctggcccaggattgtaattgctatttaatgatgatacttgctttcccaactcccacaagtgaggttttatttgcaacaatggcctgcctgaagtagatttttctctctccagtttttagggtttgcttttccctgcaatgctatttgtgtgtgattacaccacactcacaaactgatcaaagcatctccgctccctgcatcctgcttgagttagcagtattcgctctggctgctgactcggcaggctcaataaactattgtattgtaattggccaagccttattactggaccagaaaccaactgaccattgagttcaaagaatgtctgctaagcatttaattttgcggcttccaccaaacactacaggtaaatagctacagtaagcaatagaaatagtagttctttagagccttccttattcagcaaattccagaggcatggatagtcatttccagatgtggcctgcaggagcagcccaggatatcatatataggaatctggatctggcgaagccactcgatgcagaggaggcagatgcctcagaggtttccctttggatgggtagaatgattagattgatcccggtgcaggtgcatgagctcattaccaagtcccacccccttcccgtgctgtctctcattggcttctgctgcttttgtggcctgcagtaggagaggtagcaaagaactcc

SEQ ID NO: 65023 - DNA, 1129 bp, Homo sapiens
ctctgccgtgtatggcattagacattttgctggccgtgttctgatggtgactgggctcttccttggaccctcttccatggcagctcttacattattgaatcttcgttttccttcctcatagaaggtgaataaagtttcagaggtcaggggagaggatggcgcttaaggatctctttgcaaataagtgtaagaattcaggaccttcctcacctaataaagttcccactcataacctcttcatttggaccacccagcatagggtaaggttaaaattgctgaatctggaaacagaatgcgtgggttcaaatcccagcattgctgtttaccagttatttctgatgctgggccagacattgaatgtccctgtgcctcagtttcctcaccagagcaacaggcatgaaagtaatgcccacctcccagcattcttgtgagcattaaataaggtaaggaatgtaaggggcatggcaaagtgcctggctcatgagaagccttcagtaaatgagagctagaaaataaaatgtcttttctgttaaattcattccttttaagccccttctgccgatacagaccgaggtgttgagaggatgtcctctcaccccagttcatagccaggaagagttggctttcaatagaaatgccaattccatgttcccatcagaggcccagtcaagataccagcccagcctcttggccacagggcttttggctgatggagcagagtggcaatgccaaaccacccaggttgagccgagggacttggtgggcgacctcattctggttctacccagaggatgtggttttggcaccgtccggtcaacaccaaccagccagaacacactggccttttctgttccgatgtggttcctggtccttgaattaattgtctttgtacttggagggaaaaatctcatttcgcactggaaacactgtctcagaaatgggctgaagttggcttatcttggccctaatgtgttctcttctcttcctgtctccattgcccctgcccccctgctgtccccatcacaggcctgcgtggtatgaccttcctccaccgccctactcttctgacacggaatctctgaaccaagccgacctgcccccctaccgctcccggtccgggagtgccaac

SEQ ID NO: 65024 - DNA, 1008 bp, Homo sapiens
ctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactg

SEQ ID NO: 65025 - DNA, 1080 bp, Homo sapiens
ccctcctcacccctctgtcccacagaaggtccccttctcctcagctcacctgatctcagcaggtagccaagagggagattaaggtaacttgtggtaagttattatgtagcagtgacagccttatctttccaaggcaaatatgtttttaaaacagcactttcttcatctaaatgggcctatgtttttggattttttttatttttgagacagggtctcattttgttacccaggctggagggcagtggcatggacatggctcactgcagcctcgatgccccaggctcaggcagtcctcccacctcagctccacgagtagctgggactgcaagcatatgccacgatgcctggctaatttttgtattttttgtagagacagggttttgccatgttgcccaggctggtcttgaactcctgagctcaagcaatccacccacctcagcctcccaaagtgctgggattacaggcatgagccactgcacctggcctatgttttttgttttaattctggaccttgtttattgaagtgagctgtagaaaaggaaaaggaaaaagcaagattttggaagtgatttggagacttattttgggttcccccccaaagtagattatttgggagatgattctagaaaacacaaagcagtggggaaaatcaaacagggaaggcaagtcaatgaaagaggatgttaagagcaattactgctatggaaaacttgggatcctgtaagaaaccaagtagaacacctctcagaattgttccccgggagaacagagaggcttggccatttatccatgaacacccactctcactggtggaaggttaacttcccttcacttccgggttgtgtcaggtaatctgcagtgatatcagagaaagccctaaagcagagaaacagttacctccagagagcttttttaggttagctaagtattactctattcacaagaccaccataaacccctcttacacttcaaagttacagattcacttagaaggacctaggatgggaacacagcattttagcaggacgggcagacatgcctcttcccaggaggaacccgcacagccggccaggagctgtt

SEQ ID NO: 65026 - DNA, 1030 bp, Homo sapiens
aggataataatagcactaacctcatggtcattgggaggattgagataatgctaaaagcatccttagcacagggtctggtaatttaataaaggtttaataaatattagccatatgattcttattactgtgaacagttaagaaatagtaaagtgatacataatgggtgagtacgaggcatgagaacacaggccaacgtgatgaattgccccatgaatagtgctgtgtataaccctctccaggccaggtgtcatgctcccacctgtaatcccagctctttgggaggctgaggcaggaggatcgcttgagtccaagtgtttgagaccagctttaatgaaaccccagtttctacaaaaaatacaaataaaatgaaaagctgggcgtgatgatgcatactgcactccagcctgggcaacagagcaagatcctgtctcagaaaaaacttctccagcagtttggatgaggtgagctcactttgaactagagagtctgggacagaatcctcaaagagtggtgcctggagttgaagtttgggtgaggctaagttcttacaaggagagccagctgtttctcctttccacagagaaaagaacaagaggaaatgactttttcagttctccattctactgaacccaaatggtaataaactttttgatggagtatccaagtctggagtcaaagcctaaatcagattctttgggtcactcatcccagccaccctggccactttctatctgtagggttagtatgtacctgggaaatacaaatttatttaaatagtagccaatgcaaaggatgactaggaaggtagatgttttatgtaactgagtcttgtaatgcagtcattattataagtggcctttccatttaagacatgtctttgaaaatagactctagtttaaatgttagcagatagactttgaagtaattatgaggaagaacttgggactgaggatggtcaaattctaaaacacagtattggatccaaagacaggtttctccaccctttaagaataaatctgtcaggccaggt

SEQ ID NO: 65027 - DNA, 1041 bp, Homo sapiens
ttaatttttagattactcactttaaccagatgatgtatgcatttaaagaataaacaggaacattgaaagtgttttcacatgattttgccacatttggtttttgaaattttgctttatcaacttgaatatatttttcactggagtagaccattgtatctcttccatagtttcaatatgactgtattagtcacaccttggtttttaaaaagagtttttaaatgattatactatatctaaaataacctactgaagtcttttccttttaataggctacataaaaacaggcagatttaaaagaataagatcctgttcttcagctgagggaggcttcaaggtcaacacattaaagattctttgtaaaggacagaaatataggaccaataaatatatacaattttcccaaccccatgctaacattcttcagcagggagattttcatttattctctctgatgctagggcatagttgagtataatgaaaggactcatagtatgaggtctgggtttatagttcctaatatctgaactgactttttcttttccaaagaaagatactgtactgtgaaacattaaatcttgctgatccgtgctggccatgttttcttgattgctccagagtagcaagtaacctcatgtaagtaacttcaggcatttaatgtgtgaataacagtatcttgcactgttaatcaggtttgaggcatatattattttatttctgctggcagtaaaaccaggattaggtcttccttcctgtcttaggccagagaacgatttatgtacgaagattaataatagtgctctaaaggcctaataattaaatccctgaagcagccagagaacagaaagccccacattttccaaattctactcatcccttccctatctagacaccaaatccacttgtgactaacacactgccaaaatgtggcatcttcattcccttaaagtttactaacataggctcccattttttagctttggtagaaatgaaggtatcagacctacctgaaggccagaggggctgctcacgcctctctgaatc

SEQ ID NO: 65028 - DNA, 1048 bp, Homo sapiens
agtatttctgatgaaaatttactatctgaattgagacatgccataagcataaaacatacactggattttggagacttgtataaaaatagaatgtaaaatatctcaatatttttatattgactatatttgaaatgataatattttagaaaattgatttaaataaaatatatcattaaaaatgatattactttttatttgtatatttatttgtatatatatttatttatttgtatatttatttttttgtatatttatttatttgtatatttatttttaacatgtctacttgaaaacttaaaaccacatatgtaagcagctctactattgacaagtagttctcaaacttggctgaatatcaggagacttttgtgatggcagacttttatgaaagtatagatttccaggcttttggcttattaaatgaaactataaacttttatataaactttatatataaacttttggcttattaaatgaaactatagcaaggggtctaaaatttttatattctcaaggctctgtaggtgattctgatgtaccactagttttgagaaccactgatttaggctacagattctcataaggcagtctgttaaaaagcaggactgtctgtactgctttaaaataccagataattgcttaaagtgtgtttctgtttcaattgtagagttggcagagactgtctagtgctctttattttagattcatttatggatatattgctaagtatttgtctcgagtaacttatttaattgccaccatgatgcaaagaattagctattattcttcctttttatagctcagggaactgaaagtcattgtagattaaataatttgcctgaggtcagataggattcaaactccagacatctgaccctcctctgtacaattatacctctctcagagaaacatctgggagtgagagattattaaaaaacaagtctaatattactactgatagcagctaacatttattaagttctagggattaatgcttagctcttcacatgtatcatctcgtttaatcattataatgacctagtgagtt

SEQ ID NO: 65029 - DNA, 1121 bp, Homo sapiens
aatttttgttagacctgagatcccaacagtagttcaacatcaggatcagaagctgagacttcattatattttgctctttatttcaaaggagtttcatctggttacctgtcacataacctgggtgttttattggaaatagtagagagtacactgagtgatcatgagaacaaatagaactcgtccttgtagaacatctttgattttcagacattgctgtgcttttcaagtatttaagtcaatagattattacaatagtgttgtgctgggtacatagtattttcttagtaattactagatttaggttatacttgatttaaaggatgagcagggaaaactgaaaccgtttcaccttttattagaatagagcactgaggcatggcagtagccacaggaagtctgctttcctttgaacattgatgaagtttgaggaaccctttcatccttcagttaactcctatttccaagtgtctccatgcctatcttgctctactctgctaccaatgctgtttgccctaggactgatacaggacatctctgtggccgtaaaagtggaagaagtcagggagactaagtcctaagaccatttcttcctcatttatctcatcttgtatagggctggttactccaacatattcttagcaaccctcctcacactttgctcagcaacccccagccctccacccacagaagccaaggttgggtgcttcgcaccagaatttccaaggatttattgaggcaaaaggcaagggctacctctcccactagtagctagttagaagtcactggtgctggtgcagtaggcagtagtagagagctggcctgagctggtgttatttatggatgtgaactttttaaagagaacgtgatgcatttcatatttgtgttttccctctctggcttattaatgacgtattatagattaggtcaccttatctctgtttcccatcagtatatctgtgttatgtcctaaagataccctcacaagtcttaattctaccagtgatagggtattcagaagcaaacaaatgatgttaactggatttgtaccaggctgtgatcattacaacaacatgaatctcactgattttgatgccatgcactgacaggtcaagagaaacaaa

SEQ ID NO: 65030 - DNA, 1033 bp, Homo sapiens
ttttacttttttccctcataagttttctaaagtcatccatacattgctttcatataaagaaaaaaatccctcaaatttagaaaaagatgtgataggtcatgtctaagagtctcacaaatactgtattttattaactttttaacagcgaccaagaacagtgctggatatgtaataggcactcaataaatatatgttgagtgacataatgttatctttctatccagttttagaaatcacttttaacagttcagagtgcttaatgcctcaagggttcggtttgtagagttctttgaaaagtattctttttcattggaagaaactttctcaatatacacaaaataaaccagacttggtattgtggatgttttctaatagtgcataacttcttatttcagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtaataccaacatagtacatgtatagaaacaatctcagaagaaaagaattcttcatgaatcaaaaaaaagagaccctactaaacactagacagttattagatctgtaattcctaattctagaaggagtgccattggggcactttattgaaagtcatcattacatatatttcataatgttgacagctattgtttatgatgataactggttatccccaatttttgttcaaaagttcttaaggatctgccatctataaattattgaaattatttcttttagcttgtcttctatttgggacaaaagagctcctttctctaattctctgtgtaaaatgggactttctttcacctgtcctagattcatctctttcaaactcaagatggaatcgattatcttgtttttctctaatatctggtcaataaatgttagatacgctttttctaatcttgaagactttatagactcttcacattctcctcagcta

SEQ ID NO: 65031 - DNA, 1061 bp, Homo sapiens
tttgttttgaatgaacttttctctcctgctttctttagtttcttctctctggctcctcagagtgctatcagaaagcacggtgttatgacagtagccagagccaccgccaccatttgcttgacaggcaaaagcaataaaaggaaaacaaaacccagaaacactgttttcaactgtcatggtggtggtatatattctgggatagaatctggaacaaagtcccttttaaaaaactctcagactgcttttttccctttcagtgcagaggcctgactatggtgcctacaaaatccaggccagctttcaaatttactgcttctttcagatgtctcttgggaaagcacagtgaacacaaaagccttgagctgggactcaagagttaatgagaaaagtggattcagctgctcagttaggtgttgtggaagtggattcgttgacttttcactgcagtttttctttaggtctattctgcttaaaaattatgttaattcttttttctaggtagataatttcctagatttagaagatttggacatggatgaagagattaaaccccaaatgagtgagggtatgctttctatttcctttctatactacctgacctctttctagaaactacaaataaggctttagacagctttcctgtttttggcaattcttacctccacctctcctaagacaggaagaactaaagttgtgagctatttttttcagtaacaaaaatttcacctgaaaggtcaaagctttttgaagattgtgaaacctttggtcttaaatgaaataaagatgtgctctcccccttaacaattcatcacaggattgattcttaggtaattgtctcaagtggagccattgtaagtcaactctgtttcctagaggtacagtcttgtaaactgaaattatttttgagggacacataaaatacctattaatcataaaaatcataaaaatatcagaattgatcacaaaaataaggctgtcttgcctggtattaaaggttactgaggctgaaccaagtttcagtggatttgagtgaactaatgtcaaggccttcccacatgtag

SEQ ID NO: 65032 - DNA, 1026 bp, Homo sapiens
tggcaacctccatcctactttctgcttctatgagtttgactttatagatagctcatataagtggacatggggtatttgtccttctgtgattgacttatttcacttagcataatgcccttcaggtttgcccatgttgtcgcatatagcaggatttccttctttttttaaggctgagtagtattccattttatgtatacactacattttctttatccatccatcaatgaacatttaggttgtttccatatcttggctattgtgaataatgctgcaggcctgtgcttgtatgcacgtacttgtgcttgtgtgtatgaggaattgtgtgtgtgtgtgttttgagtgtgtatatgtattcataaaaacaccgtttatattttttacaaaagaatgctcttgatttcatgttgccctagagtcaagtgtctgccacatttatttttacttattcaacaaactttcataaagctccatttgtgtgttcaagctttatgctaggcagtggggaggatacaggcaagttagacatggtccaattaagtacggaagagagatgtatacacaaataattacaagctatattgtccaatataatagccactagctgcattctagtacactagagtacttgaaatatagtgactgagaaagtttcagctgttatttaatttttatttcaatttaaaatagaaaactgatatttgattcagttattagaaaactttcaagtacatttagaacaatttgggtatgtgaatctactttttcaattatacattttatgaaatgtaaatgcagatcagttattttggaaaacagcttagtgtattagagttctctagagggacagaactaataagatacatacatatatatatatatatgaagggaagcttattaggagaattgactcttacaatcacaaggtgaagtctcacaatagaccgtctgcaagctgaggagcaaggaagccagtcagagtcccagtacctcaaaagtagggaagccggcagtacagccttcagtctg

SEQ ID NO: 65033 - DNA, 1042 bp, Homo sapiens
ctccaaatataatcacattctgatctactggagcttagggctacaacatatgaattttttttgaggagttgaggagcacaattcatcccataagagatctgaatttcttgtactgaggcaattctcatgatgggcttacatggtaagcactacataagtaatgagttattcaattgtagcattattatttctgttctctcatatagctataaaactaccacatttgtgtatatataatgtatcatttataaatgtatacatatatacacatttctatggcacctctcttagtaactcattttagtgatttaatttaggtaatatatctgggtgacttgtttccgtttcccagaagccttgggggtttataaaatataaggcaaaccttcttaattttcattcatttacccattgaataaatactcatcaatcatgctgtgctggctctggaggtcacaatattgactaagactgcgcagtttacaattcagtttaaatgtcacgaggaggcaagtacagtgtgccagtggaggcttttggaagggccccgtgatggaataagcttgtccacaatttctttgacattcctctccagtgagaggaggtatatgtattccctttctttgaaactgggctgatcgtgaccgtgttgaccagtagaatatggcagaattggtgcttttctgaggctttaaagaagcagcagcatcctcacgtagaatgcttgttttaggggaagccagtgccgtgtcacacgtctgactatcctgagagccatctctaagcattcaagccatctcataaccatctcagctctggtgtgatgtcctaacgtgccaaattatgagctccataaaatggtagtttttttaatactactaagttttggagttatttgttacttagcaataggtaaatgaagcaagaccctaatgcagacatggaagataattaagaaatcctatatatcacgtatccaacattaaagcactgagtgcatgtagacacagaattcttggacgatgcctgtctgcaaaatcca

SEQ ID NO: 65034 - DNA, 1107 bp, Homo sapiens
cagctttggaggtttttcacaaagcccttattgatttgtaacaacatttaggcacttggcaataatcacttaactgtggagtggatgttacaggatctctttagtacttccaaagaggagaagttttacctttgggctataagaacctaataaaccactcaacttcagctaacaaaagcaagcaagtgtcattaagaaaaagatagctactggcttttagaagagttggcctaataatacagtacaattataggataatgtgtcacttggcaattcccttacaggtagcttaaagatgccaagaaaatggcttaagtcatgactaaaacaaatcattccttgttaaaccccaaatcagccagatttcctgcacacttagaacacagaatatgtagaaggtggatttcaaaacagattccctagatttgaaacccaactctgcaacttactatttctttgggcaaataccttaacatctatgtatgtaccttcatttacttaactgtaaagtgagtggtataataataaccatctcataggattgttgagagggtaaactttcatatacatgaagcatttagaacaatgcctgacatggagcaactgcccaataactaactttcttttctttctttctataatttttttcttctctttctccttctttctttctttctcctccccacctcctgcctctcctccttctccacctcctccgcctcctcctcctctgcctcctcctccttttccttcttcatttctgtgcatttttccatgtaaagaatttccttggagatagataagccacatcaacatgcaatatgtttatgtttctcacatatttcaaatgtgtgtttcagaatctacaaatcaactttgactcatgaagtgaatatttgtacttcttggctccccagcatcctactcaactccacttctttggcaataaacccagttcttttgtggagattggctcacttaggtggtgtacaattgttatggaactatatataatggtgtcctgctctcttacaatctcagggtggggggatgttggatccaagtttaatgcatggacttttcttccagggactctgaatcttgaaa

SEQ ID NO: 65035 - DNA, 1035 bp, Homo sapiens
agcctctagtgccaccgattaatattaccttccttgaatcaggaggaaaccatttgtgacttctcatatgtaagatcttctaagggcagaaacgcaattgtctttgtattcacttccccgcccacccacaccccttccatggagagcctgcagccaagctcaagctttcaaaaaggcgtgagctaattcaatcatccttgccgcttttttgctcctccaggctgtagagggcgacaaaaaccgcggaggcgcattggggtggggggtgtctactgaaggccgctcccgacgtgcgcgtctttacgtagacgtcgggggcgcagccgcgctgtgcgcggtgactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccaggtgagttgagtccccgggcggcctgcagggcctggcgctccgcggcctttcgaaagcgcttcccgccgcactccccgggccgagcgggggctgcggcttcatcctcccggggcctcctagcctcctcaggccgtctcgtcggggtgggcctctctgggagtgtagactctggtttcaccagggagaccgcggtccccagggttccaggcttccttgcctcccttgcccagccttttctcaccgtggcgtaacctaactcagcccgttcaggctcacgttaattcttctcacggagcttttctctacaggattctcttaagcctttctccttttcggtggagctcagtgcttccaagattagatcgggagttttcttcatgaggtcaagatgtgttttttttgggggggaggcaaaattctgctactaattgaagaagagtgtttaggagacagaagtttgtgagaaacagaagagggactctttggtccagactttg

SEQ ID NO: 65036 - DNA, 1178 bp, Homo sapiens
actccagcctgggagacaaagcaagaccccgtctcaaaaaaaaaaaaaaaggttttttttaaaaatttattctttttaatgaaacatgtttgaagaaaataaaacagggctgggcgaaggagagtgtgagtgcgcagctctgaatggagttgtctggaagagctctcttaacgatgcttgcccccgatacacagtttctcagcagtgttgaattatccatacaagtcatttgttccctgtatgagttttcaagtactggagtacattgaacttgataagtggttgggtatgtgtgttcttgggaaaagaaccaggctctcctggaggtaaccttgatcattgttttagaaatcccacaccatagcttttcagcgcttagaactttgtgatttttctgcttacgcatcccttcttggagaaagtggaagattctagtctattaacagtcgtgggagtacctttcccgtccccttttcttaacataattcaaataggacttttctgagctgaacgaaaaaaaaaaaatttcatgttggagatttattgtagcttaatctagaattaagaatataccagtttgaaatagcaaatgattttttttccttcattccctgtcagtagggaatttcacttttatcagtaagaaatgtatacggatgttctgctgtacatgtggatagagtgtgtaggtcggttgtgaaggaggaatattctgttcattaagaaggtaaaaactgccaggcacggtggctcacgcctgtaatcccaattctttaaggggcgtggatgggcagatcagttgagatcaggagttcgagaccagcctggccaacatggtgaacccccatctctactaaaaatacaaaaattagccaggcgtggtggcatgcgcctgaagtcccagctatttgggaggctgaggcaggacaattgcttgaacccggagggtggaggttcctgtgagctgatatcgggccactgcactccagcctgggcaacagagcaagactccatctcaaacaaaaaattaaaaaaaaaaaaagatacaaactatgtgtggtcaatcagtttgaatttgttgttcctaaaaagaactagtagtgaagatattctcaatcgtataatttatctgtgacttagttgggtaactttgtagcaaattgttctacctacgttag

SEQ ID NO: 65037 - DNA, 1093 bp, Homo sapiens
gattgctgccactacagactattccctccccattattgtcaatactcctttcagagtagtgccttctaaatatataagggtaaacttacaagccgtctgaggttttatcggctaatttccccaaagcagatcaaatcctctttttgaaccccttggtacgatgtacttactaataatgcttcagacttgtattttattttatttatttctgtacttaaattataacgtctcaagggttaaatccttttatgtatttatttatttatttatttattgcttctcttcttgcactgtaccttgcccttcagtaagcatttctttttcatagttgaagaaatgtattggaagaaggaacagagaaaccatttacaaaagaaaagaaaaaccatttacacagattatctctaatggataaagggaactttatcatacacacacacatacatacatatatgagcatgtatattctaataagcaaactgcagatgacaaattctaagtgcagaattatttaatacctcaaatcttccagtcctatcatcttctcatgtaactgccatgttctgcctatgcgttcatcctgcctttcccccactctgcctctgctactccttcaggtctcactcttctcttgtgtgctcctttacctttctgatctccttttccactgtactctgcccagggctcctgactagccataatagagcaagctgtggcccaccattatttaaaattctgtttcaaattattatgaatttacttactttaaatatagatacttaattttatattatgtagtcaaaatcttaaaagttaaaaaatgtatccgacacctgttaaaggaccatggcagtggggctgattagatctgtataatgctgaaaccctgattcctcctgttctctcaatcattgagtatactagctttgcagggttggcgtgtaggcttcttggacttttatttcatgaaataaccactcttgtagtagggttttttgtatgattaagctaaaaccactgaccaaccaagttcgtaatccctcaaaaatatgtggaaatatttatttcacttctctgagccctagtttcctca

SEQ ID NO: 65038 - DNA, 1072 bp, Homo sapiens
gctgctgacacaggttcctaagaatattcagccgttagctcttgtcttttcagatgaaacagcgaattgccaacatttcatgcagaatttgctggatataaaccctatactttttttgcttttttaatagaaacagggtttcactctgttgcctagaccagagtgcagttgcacatccatagctcactgcagccttgaactcctgggttcatgcatttttttccactttagcctcccaagcagcacagaccaccgttcccagctgatttttaatttttttgtagggtcttgccatgttgtccaggctggtctcaaactcctggcctcaagctatcctcccaccttggccttctgaagcattgggattacaggcgtgagccacctcatctggcccgctgtacatattttatgtaaaaatcgaataagccaagatcagtatttggaattaaacatgcagaatatagccacaaatgttgtatttagtagtcaatactgaaaattctaaagtaaacagttactaggtataacattgccacagtagccattttttaggaatactatattataagcccataggtagtaaaaacctaacagttgcatataattagcatgtaaatagttgtttataatctcaaatctgtctccttcagcgagacattgttaacatccctttttatattttattctgtgtaacttgaagattaaattggagcaaattctctctttttttttttttttttttttgagaaggagccttactctattggccaggctggagtgcggtggtgcaatcttggctcactgcaacctccgcctccctggttcaagcgattcttctgtcttagcctcccaagtagctgggactataggcgtgtgccaccacgcctggctaatttttgtatttttagtacggacagggtttcaccatattggcaaggctggtctcaaactcctgacctcgtgatccacctgcttcagcctcccaaagtgctgggattacaggtgtgagccaccacgcccggccaattggagcaaattctttttaaaactgctagaaatctgctgtttcata

SEQ ID NO: 65039 - DNA, 1027 bp, Homo sapiens
tgttattttaaaggtgatagtatttggttaatttttgtttgaaatcatgcccagattcgacgtcaagcaattaaagaactgcctcaatttgccactggagaaaatcttcctcgagtggcagatatactaacgcaacttttgcagacaggtaagggattttattattacctttttctctaaatatatatcttctttctgaaatgttgactctgtttttaggttttaaatggggtgcaggagagctggaggtcctacctctgatagagattaaatttcctactttcattcagtagttaaagtgtaatgatttctggttatctaattcctggtgttgttttgtttttaattccgttatgaaggtgtaatgactagattcttttgggcattttgatatatcataatttttcccccaatttcctgtagtttcataattgtagcatcttaataaaagtttttcaggcatgccagatcgggttctcaacttacaaggaacacgtatctttttggtacttgagggaatggcttaagttataagtttcctgtcaatgtaaccttgagaaactaagttgaatcaagtttgaaactgaagcagatgatattttaaatttgttttatattcattatgccactttttctttatccagatgactctgcagaatttaacctagtgaacaatgccctattaagtatatttaaaatggatgcaaaaggtaaggccagttcttattctgaattgtgtttgatgtcttacagaatcacaaagttaggtgttactcattaagaataaactctagggtttacccagagttctatttcataaaaattctaagtattgtgaaaaaagtctccttaggtcaagatgtttatgactagaaaaacgagcagaaataactgcaaaaacagatcacgtttttccattagaaatctgttggaagaactccttttgacactttcaagaaattcttccaaaatacctgggttttattattagtaatgataaaaaaggaaagtcatgcttaagctgact

SEQ ID NO: 65040 - DNA, 1100 bp, Homo sapiens
tataaaatgatatatcatatatcccattggaaccaccatagaacttctaagtttttcttagattgaatttagcacttttgtcggtggtaatgatgaatcaatttggtaatttaaaggaatctgattacatttaaacttttcgtggtagtgtccttaaaatttgtgcaacctctgcaaatcacctccttcaggaaactttccctaagtcctacccctcccttccattttaggatactctctcatagtattctaaattatttcaaaatgaaacatcacatcaaaatgacctgttgtcaccttagcccttgacactatctgctcttcaagggtgagaccatgcttgtctttgctcccagcatctagcatagttgtagacgctaagattggcaaggtgcgtcacaattaacttttcactcatcttaatgtgccaaagtttgggaatagtttacttttttaatatgttacagaagattcagcattttatctaaagcatgtgatcactgttatggttcaggctttagaaatttcagactactactacccacttccttattgataagattatttttcagtgagaaaaaagtagatctttagctgggagtatcagactattttacctatgccccagcttgtaatctggtagagtatgtcgtgattgtgagcttttttggtccatgaatagaaagatttagacccactgatatggaagatttaacatgagacttgcaaggtgacctattttgtatacaacaattaccatattaatatgaattaggctgcttttaaatataggatacaatctgattcaacagtttgctacagaatttttccaaccattttttaaagtcactcccctaaatagccaatttttttaattttttttttttcttaactgctctcccatgaaattttaatgccacatatacactgtatatctgtttatggtactacatgtatatctgtgctttgtacgtaaaaaagtaacattttctaagaaccaatttttgcccccttggagaatgcgtggtttacactgaagctcaattgactgaagctagaagttgccttttcgtcagtattttggaagcattaataacaaa

SEQ ID NO: 65041 - DNA, 1030 bp, Homo sapiens
attaggcatccaccttaaagtccttatttgggcccttctgatttctttttgttgcctaatcttaaaaaacatctttaaagggcacccacatttctttggttaatagtataaaaaagactgcattgacatggttaagttcccaggaccctcagttgttcagagatgactggtatcattacctgcaaaagtgtcttgaccttgatggagcttatgttgataaataaagtttatattttttattctttatctttttattccatttttccatgaacttattgaagccccttcgtagatcacctattgaggttatatctggggcatgctggggtgtgcactatatcgtatttgtagtcagaatacttgatgctgtagcgctcagcatttattgaatgaaattctgctataatatttgagcgaatatttgtttttcgacaatgcattttctttggatttcttacagaaaaatgtccattccacaaggtttgtgacatatttctgtgagcaggttctccctaacctcggtaccttgactaccccagtggaaggtcttgatatacagttggaggtaagcaaaaatttcagctttagcactgataaggcattcttatattttaacaaaaatgtaaaccactaacttagatccgatttctaagggagcagtttaaatgtctggtaatggccagccagtaatctccctagaccagaattaattgcattaggactgcttcatggattcaattaaagtttgctgcaatgggaaagccttacctgtagttttattatagtcagtctctacttttgtagccttaatatttttaaataaggtgtttaattcattcatttctatccataactgacagagccaattttaaactggattaacacaaaatatcctttattccttcttcaatagaattcactacccctcccaactttgtatctcaactgtaatgtatgtaaacattttttcacagcatctgtaatactttacatttgtttataatctctccctacatttaatctgattcac

SEQ ID NO: 65042 - DNA, 1027 bp, Homo sapiens
taaaatctgattcttcttattagaaagaagagtgaatttctgcaattattttacatttgagaatttaatgtgatcaggtcataggtattctcacaacaaaatttgaagcatttgcttgactttatttcacctgttgaaacaaaagcagttctcagtatccaagtttattgctttactaaccaatgtctctgttttttgctttacaaacatggtattggttctcacaaattagttcaacttcccggtgcattcataaacatatacccacgtttagttttccttccagtgcacaaagtttccccagtaacctaaaagtactaaatgttctacattttgtgacttgtgttctttactttttggaatataaaaataatccttaaagtttaatttaaactgggagcagtgaattaaaaaaaaaatgtaagcttgaaactattgaaaagatcatgaaaatgcagagtattttttaggatgaagctcttcaaaaagaagaaaatttggtgaatctctgtactatagaaatggctgtatcaattggaggtaaaaaaaaaaaaaaaaaaaaagcatttgccaatatagaaaagataactacgtcaaatagtaccttcatacagtgtatttaatttcctcattaggtacagctgaatagagtgtaacctgaattcatattaaaattgaaagagtggattgtaatagtcttttagcttaaagctaataatagtatctatgacagtgttaagtgtgttggtgtgaataatgagtatgatagggtgaaatgtgcaggcatctgcatagatggctctaagtctaaacagtcaaaaatgcagaagtcatggcccacaaaaggctactgcactaccttaatgctcccatagttactgcatctgtctctgggagcatcttgccctcagagaaaccacctctgattttctgaatgtgttcactaggataataaacacaatgatttcattttcaaatggtttgcatactaatcagcttgtaaaaaaatgtgtcatggcataagaag

SEQ ID NO: 65043 - DNA, 1068 bp, Homo sapiens
ctacctgctctggctatgactttcatgacaacttcttagttctttatttattgtctatcattactaaaggtaactcatataactatgaaaaatatcttaaattatcaataatcaatttcgaaaatcaggttagactacaaaatgtccctttgaatgcaataaatatgcaatttttgttttgatcacagtatttcacgcaactggactcacacaaatgtagatctaaaggctgagtttttttcactgctttatcagctacataagcttctcagaatactgccaaataggtgctatgtgtgtatgtgcgtctgagtgtgtttcagctactgatataaactaagcatatcttttgctgaaaaatcaagtcacttgtgatgtacagaacaagagtctctcatccattggtcagtcacttttatagccacagagaaatggtcctcaaaggtgtcgtcccatgaagaaaactgatcgaagttatcacaaggctggacttttaatcatatgtaaatgagatcaaatctcttcattaacttctaaacttcctcattatagcaatcttgttagcaacaatagagagagcttggttttgctgtttttgatccacaatcttggaggcttgaaaaataccttttcagtcaattttgcaatcaatttttttgccattatgtcttactagggtgatgtcttgatgtcttttttgacccccctttctgcagaaagaaaagtaattcaattctgagacaggaaactcactggacctttccccagtttggctaatatttatctgtataatagaatgggtctgattcaaagtcaccttcttatgccatgacacatttttttacaagctgattagtatgcaaaccatttgaaaatgaaatcattgtgtttattatcctagtgaacacattcagaaaatcagaggtggtttctctgagggcaagatgctcccagagacagatgcagtaactatgggagcattaaggtagtgcagtagccttttgtgggccatgacttctgcatttttgactgtttagacttagagccatctatgcagatgcctgcaca

SEQ ID NO: 65044 - DNA, 1661 bp, Homo sapiens
cagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtaggatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcat

SEQ ID NO: 65045 - DNA, 1050 bp, Homo sapiens
gttcctattgggtaacgttttctatatgacatacataaagaacagtttccttttcattgccatactatctgagactttaaatatatgtgtatgtgtttcagaaacccaagaaaacactgtaagaccatatgtgagtgctggttgcttccacccttcttttgtttcttgatagtggttttccctgaggtctctatgaagacgtggaattaagtcactcctgctgcattttggggagcctttctcctgttggctcttctgcaatattgtttttggccacagctatttatactctatgacattgacttctccttcccattttggtgtcctaccactcagctgaaaaagtagcccatctaaaaagtgaaagctggtagaaatgttttatgtatatacttaacattgcaatgggaaagtagagtctgattttttttttttttttaacaaattccttctttttgcactttggatacatatgtattaatgggggaaggcaggggttactggaaacttgcctcagagaagcagggaagagctgaagaatcttttggatctctgccaagtcactgctgagctaagtaattaggcttaaagtttaaaaagcaagatttctctattacatgactttttaagtgatccttttcattgaattttccaatactttgctatacataacatttacaatgttatgttcaggcagccacaagattttatgccagaagaaataaggttggtgtctgcagtgtaacaataagaggccaggggaggaaagttggatttaatctgaagaaaaggcaccacatataaataaagtaaaagaattgggtgctgtggtgagctgccgagttccactctgatagctgattgtgcatgacccatgcttcccttcctggccataatttgtatgcaggtagaatccaaactatcaatttagatcgtgattaattataatatttgtatatactgtacttaaggacttgaaagatcacattagtgtatgaaatccatatatattgcagatttgtacattcagaaacataattaaaagcttag

SEQ ID NO: 65046 - DNA, 1026 bp, Homo sapiens
gaagaaaataatcagaaaaaacagaggcgtggtagatgagaaatggcagctgcactgttgaggagggattagaaccagctgtggggttcagcagttgttgcagtttagaagtcactctggtgaaagtaaacagaaggcgctctgatagtgaagaataaataagagggctcacgagctgctcacgtcaaaaattagaacaactttgcattccaaaatgttaaggagcagggtgtaagctaaaacctgcgtctcagctgtactccttgatagcagaagtgaaaacaaggggaatgtctgtgtgtgtgtgtgtgtgtgtgtgtgtgtgtgtctcttttacagacagacaccctaaaagagttatctgtgctcgtggagtctcctctctcttccttttttaagccccctccaattcatccttcatccctataactcttgtcaagatacccagagcctatgctcagttctcactaatcttaagttcttagcagcccagcatttgtcttcatatcttactcagctattttcttacatgcttacctaaaagagtggctgacacatagtatacactgaggaaacactgagtaagggagagagaatgtgtgcaactaagcaactttttacacctgtaatagctcttacatgcattagcatacagaagagccaacacgtattcctggtttttcttctcagtccctggccctgacttctcattttcttctgctgaattcaccttttcttgatgagtcttaggtgttggtgtgccccttttcttccctctgtacatatgttcaccagatgatcttttgcagtctcggggcataaagtaccatttatattctaaagactctcaaatcttacgtgcagtttcaacttcttcctgaacttcagactcatatatccaactgcctactgaacatcaccatttagttgtcatcacaaatacatcatgtcctaaactaaactcttgattttctaccccaccacacctgatcttcccccattcacaaaattgcccaggtccaaaat

SEQ ID NO: 65047 - DNA, 1027 bp, Homo sapiens
ttttgttttgttttttgtttttttgagacagagtctcgctctgttgtccaggctgaagtgcgttggcgcaatctcaggtcactgtagcctctacctcccgggttcaagcaattctcctacctcagcctcccgagtagctgggactacagtcctgcgccaccatgccagctaatttttatatttttaatagagatgaggtttcaccatgttgggcaggctggtctcaaactttcaacctcaggtgatccacctgcctcggcctcccaaagtgctgggcttacaggcataagccaccgcgcccagccttggttaggcattttggaatgggactgtcacacttccacagtttcttccctcccccaattttattttttctaaaaatctcatttaaaaatacctgtagagtcatgtactaaatagctatctcttgatgtctggacggagttgtaaattaagcactttctcctgcttccttatgtaaagctcttatactctggtcactggcagtagctttaacattttttcctgtatcccattccattggacagtgggtctctctgtcactttattgatttacttaggttgtttctgattgtccttttgcagctacaaatgttgtaatgagcatccttatgtatatccttgcctacttattgaacaatgtctgtaggatagtttcctagactttcttttgctcaaaggttatgcaattgtaacattttgatatatgttgtcaaatgacactccaaacaatgagaacacatttataagccagctaccagtatatgagtgttcattttttctacagcttcaacataattgtttgatttgttgatccagagaacatgagcaataagtaataaatctcaaggttattttatattatctttgatttatgacttctacaaatagctttcaaaaagaggtacatttaatattttccttttatcacttccaagcctattcagatatgaaatgtgctatcaaaacaagacaattcattttttattattacaggcatgaaaca

SEQ ID NO: 65048 - DNA, 1030 bp, Homo sapiens
caattcagtggttgtgtagaggaatatctttaattgtatggattcctgcaactagagaatatttgtagtaaaagctgtcacttaaatgtttacaattttgaccattgattacttttatgaagtcagttggggtggggagactgggatacttagttgactacttactttgttgactgcatttttatttgcatagaatatactaagtttcagtaaaatcacttacatgtgcaatagttgatatttctcctcttggagagaggtggtggctcctagggttgagttattgttaaggtagttaaatggcattgagagacattatttggcccacgttttaatcatgattgtgtgttaggttgtacagtaatggaattctattgtatttgatccttgaggtataataagttaaaaaacatttccttcaatcagtagggctagttaagaaacttcatgttaactcagaagtgaatttttcatatctcagaattagctgtaatatttgagtttactttggttagtagagaattaaacagagatttagaactcattaaacttttgtatttgcttcttttccaatctttttaaggcataatgtggtaggaagtaaaaaggatgccagcttgcttattcataactggtttctgttatacctggctgagctttttccagtatcatgctcttaataattgagctggctctatctttacacaatctgtatagttcctaaaatctctgtatgttacagtgtgtaataggcagtatgggttttctgattaaatgtaatcaggcagctgatttactgaaatcaggtggtgaagcatattcctttcgaagcatagtttctgtagtttttcctggcctgtaaccaataagctagagtatgaaagcaaagtactgtggcccctaactcttaactttgtctttaagcagaatctagggaaaaagtgaaaaggaggaaaggattctagaaagactttgaatgttgatggaactaatgcaaattttgtagagagaaatagagttgttaaataca

SEQ ID NO: 65049 - DNA, 1109 bp, Homo sapiens
tacaatcctaatctatctagttgggaagaactaacacatgtaatgataccagatagtatataatagatgttgaataagtggtacagacagcaagtacagccagaattctgagtataaaaaaaaaagattcaaactctgaaactttttgagcactgacatgatgctcaaaagaaatgatcattggagcattttggatttcacattttttgattgggatgcttaacaggtaagtgtaataaaatattgcaaaatccaaaaaaatctcaaatctgaaatactcctgattaagcatttcagaaaactgatactcaacctgtattagaaataaaacatttattctatcttagagaaaactcatcatgtctaatcgtagatacagaaatttccagcaataactacttaagataactaagagattaggagagcatctataggaggacaaaccacaaaaacttagaactctttaatctggaaaaatccagactgcattgggaaaaaataagagacaaaaattaagaagccattttaaaggggaaatagtgatagggaccaaaagcttcctatgagtattgtaaaccagctcccagcaatatctcatgtttggtttccaagggaaaaaataaagaagaccagattcacaccctctgggattatagctctttatcttaaaaccaagcattttaaagggaagaagggggatgtttagaaatgaaatagattgaaacccaatacaccttttggactttttgatggtctcaagaccgatcatttgaaggagtgtagcttccaatagtctatattcataaaattgtatcaccactatatagtgaaagaatccattcctgttcacaaagacctagagctacaaattcgtcatattcattccttttccttttgtctttcctaccccatcccatccccagtcccattctcattatctagcaaggtttcagaaatacacaagcatctttgtaagtatatccaacattgttccaccttgctttgaaggaaggctgtatatgtttgtgttctctcatctaggttaccctttcaccctcaaaacttttctttgtaattgattgcacaacagtctgtaatccttaagtgat

SEQ ID NO: 65050 - DNA, 1030 bp, Homo sapiens
tcttttgctgaccccttttctaccctttaagtgttggagttccccaggatttaccactaagccttcttattttgtaatcacttctagtcagactgatctactcccaaaattccaatcaacacaaagatgtactaacagctcccaaacttgaatctccagaccagatctttttacaatgcgttcaactcatttgtctgtctccctgacctgtctgtctagattgcactcaggcaacccatgctcgggaaaactaaagtcataattttcttgcccactctccatattaaaaaattattgtttttttttgttttgttttttcttttcctatttttagtaaatagctccagtaatgcttaggccaaaaacctgggagttatccttaatgattttcctcccttgctcttcaaattcagcctgttaccaattcttagcacttttactccctgagtatttttcaaaaccacctacttttctccatccccattgctgcctcctcaaaccagagcataaccatccctacgtcggttcatccagtacttcctagctggtcctcttgctctgttcactcttgcctctgttcaatctattctctccacagtactcagaattcttcaaatataagtcaaatcattcttaaagcactctaggaaattcttaatgctatttaaagtggaccataaagcctttcttgatctgctccctgcctgttttttcatcctctcttttgccctctctcctgccagggctgtcacacgtggtgtctcctttgtctgtggcattgttctcactgtgggttctcagctggttaattcatactaaaccttctggcctcaacttaatcttacctccacagaatccttcactagctaccctcctccaccagtgcagaggcaacatatatcctcctggagtgtattatcattgcaccatattttatcttttataacttaccacatgtaataaatgaatcactcacaagagaatgaacatggtaacagcagggactaactatgttgttttactcattatt

SEQ ID NO: 65051 - DNA, 1028 bp, Homo sapiens
aaagttttggaaaaggtaagtcaccccacagaaaagctggaaacaattgccctccttctaacttcttttctaagttatttgctcctaagtgtctgtaacctcttctgttagttacttagcacttggtggctaaaaggataatgtgaaataactcccctcagaatgtttcagtcgctttttctatcacttgggtaatattcttttctgtctctttgcctgctttctgtggtgaaacttacctagtcagttttctcttctttaccccagtatgtgtgtatagaggtggtagtattggaaaccatggaatctaggtatatgaaataagtcagatattcttctgatggtgaagaatatttggtattttggatgatggatgggaaacacactttgaaatgtcttttctcttgaaatcatgaaacaaaatatttaccaaattgcattttcgtagagcctacagaaaatatcattgagaggttctaagactccttttcttcctctgtgtgatatttgtgtaaagaggaggggttttttaatttaattttattactttatggctaagaatctctctactttattactgtataatattaaagagctaatttaacatagtcatttaaacaatcaacccaacttcaagtatgaatgcgacactgtgagatagcaacttccttcatcttccgagtatcgcacatggaaaaatcatcagcagactccagttataatgaaactagggcaaacacatgatccccagacttcaaaaaaagtaaggattgccaaaagtggttatgatccacacaaaaaacatacaggatgaattgtagcagaattcaggcagggttagcaatttcagaaaacgtcagcaaaattctactacctgaaggaactttctacaggtagcccaaccaggaaaatcctgagtaataaaaacagagcagacacagcactgatacaaaaataaaagaaaaccggtcgggcccggtggctcacacctgtaatcccagcactttggaaggccaaggcaggtggat

SEQ ID NO: 65052 - DNA, 1051 bp, Homo sapiens
ggaggctgaggcaggagaatggcgtgaacccgggaagcggagcttgcagtgagccgagattgcgccactgcagtccgcagtccggcctgggcgacagagcgaaactccgtctcaaaaaaaaaaaaaaaaaaaaaaaaaactagaagccattgtaacaacatgtttaaagtgctagaataagaaaactgcaggcttagaattctaaaccagccaaaatgttcttaaaagattaaggcaaaacaaatatgtgttcaaacaaacaaaaacagagacaatttggcaccagtaggcctgcactgaaaaagtaaaggaagtttatcaggaaaataatccaagatagaaatatggacttggaagaaagaatgaagaacactgggaaacatatgtaaatgaatagtaactgtacaaaataataatggtacaccctgaggagtttcaattttatgtactgtatatctaaaattcatggtagcaataacttaaatgatgagagggaagcaaatagagtttaaaagtcctaaggcttaattggtatcagccaagtagtaaaagtaataatttgcattggccttaataagtaaaaaagcatgttttaaactctaggctaacaactaaaaattatttttaaatgtaacttaatagaaggaaaatggaatcatgtagaacatttgattaatccaaaggaagtcaagggaagataaaggtacataaaagtagagcacaaatagtacaatggcgaatatagacccaagcacatcagtagttacatggaggaagactgtgtaacttaagaattaaatgtaggctagattaaaaaaaaaaaaaaaacggctatataactatacccttgtcagaaaaagtaaactttataataagaagcattactggagttaaagtggaatattttataacactaaagggatctgtggcaggctgaatagtgcccccctacaaagatatccacgttctaatccctggaacctgtgaaaactatatacatacacagtatggaaagaagaggactttgcagataaaattgaggatctggaga

SEQ ID NO: 65053 - DNA, 1023 bp, Homo sapiens
ggggtgtgaaaagttgtttaatggatattgagtttgttttcccagacgaagaagttctgaaggttggttacatgatgtgaatatactaaacactactgaactgtgtacttagaatggttaagataaattttatgcgttttcactacaataacaagtagaacagtagaacagatgattagtcacagcagaaaagatgaaagataggtcaaaacaggttattagaaaatatccaaactgaagatgaagaagaaaatcatttttagtagaaaatatccaaactgatatataaagacataaaggaatttgtggaggcagaggggagataaggcaataaaggacatgtgggacacatccaaaaaaaaaaaaaatccaacatacagaatcccaggagaagaggagagagaacaaggcaggagcaaggtttgaagaggtaatggctcagaatttatttcctaagaattatgaaagacattatttcacagactcaaagtgtgtgatccacagatttaaatacaaagaagccttactagaatatcatagcaaattgccaaaaacaaaagacagagaatagaatcttaaaagatagagaaaagaactcactttcaaatgtccaagactgacagctgacttctcagcaggagcaatggaaccagaagacaacaaagtgacatttcaattgctggaagaaaacagcaccaacctagacctctgtaccctgcaaatatcctttaaaaatgaagcaaataaagtaatcattatgtatgttattggcaaaatgatagaccaatagaacagtggaacaaaagagagaggccaagaataaacctttacatagatggtcaaatgattttctcaaagggcacgacagcatttgaatgaagtaaaatctctgtaataagtatgtctggaatgcatggatatgcatatagaagaaaaaacccatacctcacatcatccagaaaaatcaacttgagataaattatagacataaaagtaaagctaaagcaataaagctaccagagc

SEQ ID NO: 65054 - DNA, 1047 bp, Homo sapiens
ttctcagaaattactttagcaattaattcaattgatgttgctgtggaagaagcagggcttgatgtttaaagggtctagaggaagacgggcctacattcctgatggacccaataaaaagagtatttttcctgccttcatcaactgccttttgctcctcacctactagggagcaaagctagagggcatcttagagatgtgaggtggactagtttgtaaataaaatagcattaaaaatatatccaacctagagaatgaagactatggaccctccatcgttggttgagggactttgagagtttttgagagttgtgtttttcaagcttaatatagctttcctttctagcctgttccttcaagtgacacaaacaccctttttttttgagaaatatttagcttggtctaggctactgacagtacctagaaagaaaaagaaaaagaattattcttgcttattattttataaaacctttactagacttggagactgctgcagcgacagtccagttagtggactggaagaccaatcaatgaataatgattgactgtttacaaatgagcctagcacggtgcttgacccatggtgggtgtttaataaatgttagctgactcagagtatgtctcattattgtggcactatgttatagtgaaagagctatgaatttggcatcaaaccacataggttcaagcaaccatgtggatgtatgctcttgggcaaattatttcgcttcttcgtaaactgcttatcatacctaaacaatgggagtattcacattataatagctaccccacacagttattttgagaatgaaatcagaagtgagttggctcattttaaagcactctagataagtaagtgatacatgtgtttctgtaatatgtgtgtgcacaaaggcagatattaaaaatttttttaaatcctgcctttttctctttcccatctcactcagcaataggagtaggcataggtctctgataggctggatggcatcctgagtacagtgtaactgtggatagtttaggctttgcagccaagaaggcgtgcattca

SEQ ID NO: 65055 - DNA, 1055 bp, Homo sapiens
actacgcccggctaatttttgtatttttagtagagccggagtttcaccatgttggtcaggctggcctcaaactcctaacctcaggtgatctgcccacctcggcctcccaaagttctgggattacaggcatcagccaccatgtccagctgccttcaatgaatttatgtgattccatttaccttaattgtaagaatttgacaatgtgatttttctatatattttacttctgcatatattatgagccacacttttacacaattacttttaaggagatccacatatttctatgatgctcttcactcctttgtttatgcagtttttattcagctccaaagggcttccttgagcatttcttataatagagggctgctggtgatgaattatctcatcttgtggctatctttaaaagtctttattttgccttcattttttgaagtagattttcattggatatagaattttcaatgacaagtttttctcttttcgtttcagcactttaaaaatgtcattccattgtcttctggctttcattgtttcagataaaaagtcatcaataattacatttttgttcctctgtatatgtgtgcctggttattttcaagatttttcttttcttccccccatagcacttctgtccgtttctcagatttttctatgtatatttggatttcagcaatgtgactacaatgtgccttggtgtcatgtttgtgtttttgtttcttaaggtttgtaagtttcttagatctgtgggttgatctttttcataaaatgtagggggaaatggtcatttggtcttcatatacttttctgacacaatttctctttctctcctgagaccattttttattatcctacagttccctaggacttttaactttctgtgctttattttctttggtcttttctacagtgtccaagctgctgttaaatccattcaatagattttttttattttagatatcataatttttacttttaaaatttttatttcatcctgtttataatttcttcttctgtgctcatatttctcatttcttcacctattatgtctagtt

SEQ ID NO: 65056 - DNA, 2037 bp, Homo sapiens
tgagctcaaaccagcctgggtctgaccggccaatccgagcgcagtcttccgcagtcgcgagtacggctgcagccaatgagagaccggggcgcctcggtggggtgagacagggcgctcactggcggaaccccgggggacgcggtgatgggaggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcaggtgagtcggatgcagcgccgcgtcctcgctcccgcggcggcccggaccaggcctgggccgtgatgactagttctggggtctgctcctggccttcccctccccagctctcctctttctcaggctcctgtgccccgcgggcccctcctggctcccttggctgtcttctgcttgcttagactacttgcagagttttaaggtacgaaatacactgctcgctcaatcctgggaatctaagctcagcttagggtgtaggagaaaactgccttaagtctctggggcttgtgccctttaagccattccgtgttcatggagccagtcagtcgccctgctgcctcctcagtcacacgctgtcctccttggttcgccccttgtaagtgtttttaaaataaagtttttcgctcggtttgaatattggccctgtgctaaggatgcagagcattctgttaacatgtttgggcagaggatggaaaggggtgtagggacacaatttcagaaggctttttgcactgcggaatcgtacctccccagttacgattaagatagtaatcgtatctggatttggcctatttcatacaattacaaagcccctttaaaaggaattctcgctaaactgttctggagtcctaacgagtagcaagaactattgcttctgtaaaatgataactcatcatgttaaaatcagatttttttttttttttcacaaggacgtttgtaggaaaaagtatacccgtaaagagtgaaccaaacacatggaacttgtagtcggaggatttttaaaatggaggacgaaggtcaggttgaggaaatagggaaaattatctgcagggaagttttgctccccccccccttttttttttctttttcaacctattttgtttccttctttgctttatttttcgtctcttggccttttttccctttaaaccgagtgattacttatgatatgcttgtggtcctaccctgagatgattatttattttgatgttttataatcgaatgtgcacttcctaagcattttattgaattttggggtggttaggcattgcctgcagactgggctcaggtaagatacactaataatgttactccatgttctttgtttatttagaaacatttaaacaacctagtaggaaagacatatgttaaccttttgggtttatgttaacattaagagaaaacatcttagcagtggatatgtatgtgaaatctttggacgatgtggagcaacattataattctgtttcacagtcacctgtttctctgaaaaaggaagtgaaatgttcagctgggtgtgatggctcacgcctgtaatcccagcattttgggaggccgaggcgagtggatcacaaggtcaggagtttgagaccagcctgaccaacacggtgaaaccccgtctgtactaaaaatacaaaaattagctgggcgtggtggcgcgcccctgtagtcccagaggctgaggcaagagaatcgcttgaacccaggaggcggag

SEQ ID NO: 65057 - DNA, 1757 bp, Homo sapiens
ttgccggccctctttgggaaaacattgttacacagagatagatcagtctaggtattcagataaactcagttaaaattgccttttttaaaatgtcaattggctgggcgcagtggctcatgcctgtaattccaacactttgggaggctgaagtgggcggatcacttgaggccaggagtttcagaccagcctggccaacatggcaaaaccacatctctactaaaaatacaaaaattagccaagtgtggtggtatgcacctgtagtccccgctactcgggaggctgaggcaccagaatagcttgaacccaggaggcggaggttgcagtgagccgagattgcaccactgcgctccagagtgggcaactgagcaacactctgtctcaaaaaaaaaaaaaatttaatgaatacaataaaatgggaatttatgctttttgtaagggatgctacttttgtgcacttcttagttatcatctctcagagaccatttctgtctgggggaaaagtctgatcactgtggtatgggaagttcttctcttacagggactgagtgatggggttattgaaacactgaaactaggttattgcgttgtcatggtaactccataataccatggtgtggtagttgagaagcttgccacaaatctgtatcagaaagaacgctttgttttatttgtcgatttttgtctacaaaacaatgcgtttgccctatctctaactggcaattccaggaaaactatccagtttctggaaagttatctttgccaccatttagtgaagttatttccatttaaataacctagtcattgtggaagagaggaagggctagacagtttaagaacttgaacaattggtgcctctcaagagtattacattgggaaacagtatagctaacaaacagattggctttggagtcagtgggcaagctgtgctgttactaagctggttgaccttaggcaaaaatagttaacctctgagcataacttctttcattttttagggggatgatacttttcgggattattatgacaattaaatgagatgtaaatgaggttctagtatagtccttactgtatttttatgaatattaagtaacatatatttaagagcatcatttgtttgtatagattactcttattggatgaaaagggattgttgaaactaagaaataattgtagttcactcagcaggtatacacttgaaaatctaaaattatgaacagaccaattaggagatgactagtgctactgcagaagaattccttgcttgggtaaaagatttactaagcagttcctttatatatagatccccttagtgagtaaatctaagataggaaggacttcaaaaaatttggttatttataatttttcaattacatttgtaaaaaccttagagttatctttaagtcttcaccacatgcagccttttaggaaatcccgttgactctgaacttcaaaatatccagaatctagtgagttctaagccaccacagactcttgtctctctaataacaagtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacc

SEQ ID NO: 65058 - DNA, 1052 bp, Homo sapiens
tttgggctgctgtgacagaatactatagactagatggctgaaacaaaacaaatttattgctaaaaattctggaggctgggaagtccaagatcaaagcttctgatgtcaggtgagggatttttcctggtttgcagatggctgtctttcattgtatcttcacatgcttgtgtctttttttgtaagggcattaatcccattaataattacctcccaaaggccccacccgcagataccatcacattggagatttaagcttcaacgtatgaatttggggggatgcaaacattcagtcccagagcataagttataatattttgtcagttgacctaataaaacatgatatcctgggtaacagcatagaggtaatcacattacttttaacacaaataaaagcttggaaagctttttggtaagctgaagaggaataacagttttattctaatgcaatttttaaaacaacaataggctattgttttacacatctctctgaaaactatacatttattgactttatctagaagggcagtaactatgtatctctttattaatctttctcctaaacatactgaaaatattttgcagtacacccttaggacttattaggtttataaagaaaaggcagctgtgaatgaaatgctgaattgcatcccccattggatcaactctaaaataattatgcaaaaaataagaataaccccatttttgctgaacatataaattttatcattgcaaaagaactgaatagttcaacaccacattctcatggagatgtcttactgggaccgcagtagttgggtgtactattgttgaaaaagataatttctatttgtatgtaggttactctgtgcctaaaatggatcatttctaccatcgtattttatcttccttgttttccacctcatcttttatttatacttcatagatcatgatatttggagcatatttggctattagccaattagtgcttatcttttataatggttttcaaggataacagagataaattaaattccaaaatattactgaaacatcattcccaatagcaactataa

SEQ ID NO: 65059 - DNA, 1045 bp, Homo sapiens
gtggaaattgggagatacgtttccctaaaagaatatagtgggtgatagttgagaaacagtaaacagaggctttctttttcttaactcttataaaaccctgagccaactatccttacaatgagttgtcatttgaagttttctacatactcaagaaatatgtttccttatcttattttaatggagcgtatcttctgcaaacctttttacagttagagtgattcttaaaatttaggcacatacaggacaattagacataaaaagacttgacttacagattttaaagcagggatccttgcatggtagactttcaaaatgatagtatcttttacttgaaccatcttttgcaaagtaacataaatatctcagagacactgccagagcgaactcacttttagaaaaagcaggatatgtaaacttttagtgataaattttgaaattcttgaggggaaatgatatgtgatttaagttccttcaaaataatttatctttattttatttttattttaaataatgaattatgttttaagatctgattcattctgaactataactgactctagagggtgcttaatgagcactgaagacttcctaaagatttatattgaagatgatttttattaaaatgaagtttatttggggttttaatccagtatttgaaaataaaccatattttgccctcccaagagagcctagagcaaaaatacttagttgtcagtattttttcgtttttttgagatggagtcttgctctgttgcccagactggagtacagtggcacgatctcagctcactgcaacctccacctcctgggttcaagtgattctcctgcctcagccttccgaacaggtgggacaacaggtgcatgcgccaccacgcctggctaatttttgtatttttagtagagatagggtttcactatgttggccaggctggtctcgaactcctgacctcaagtgatccacccaccttagcttcccaaagtgctgggattacaggcatgagccaccgtacctggcctagctgtcattctttttaaagtaggtaaa

SEQ ID NO: 65060 - DNA, 1046 bp, Homo sapiens
agcccctcccctgcactgagttttcctgcccttccagatctaaccaatgtaaatcttacgtgtattgattggtgtatatatcttccctaagatgtataaaagcaagctgtaccccaactatcttggggtacagcttctgaggctgtgtcatgggtgcgtccttaacgttggcaaaattaactttctaaactgactgagacctctctcagattttgagttcacaacgtttacaaaaggtctgtgttatagtgagaaaactttgctaaacaaaatgagttatccttcattggagtattagtcattgcagagaatgaatgttaatgtaaacttttacatgatgtcagcctatgaaaaagtgatgtgtttccatactacccgtttgtttaacatttcttcagaaatatcacactgttttcattactgcaggcagagaatcatattagaaaaattcagtaatttgatgtgaaacctatgttttactcattgaaggcactgttatccaacagaactttttatgataatggaaatattctgtatctacactgtacaatttggtagtcaccagcttttttaaatttttttgttatactttaagttctagggtacatgtgcacaacgtgcaggtttgttgcatatgtatacatgtgccacgttggtgtgctacacccatgaactcgttatttacattaggtatatctcctaatgctatccctccccctccccccaccctacaacaggccccagtgtgtgatgttccccttcctgtgtccaagtgttctcattgttcaattcccacctatgagtgagaacatgtggtgtttggttttttgtctttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgctgcagtaaacatacgtgtgcatgtgtcttt

SEQ ID NO: 65061 - DNA, 1069 bp, Homo sapiens
aaggtatatatatatatatatttttttttttttgaagtccttgtcctttattgcacaaggagtgagggaaacagacagaccagttggaccatagtagatgggtgtatgaggacaaaatgctacctgaaagccagccaacccatactcgcctgaaatggatgctaatacccttcaaactctgggcattggtttcacacacagcctcttccagggataaaaggggttcttctaaagcttcttgttaccctcaaccatggaggcaagttctgagttctggttttcctatgatgctaactctagtcacatagatctctggagtgatcaaacatggtggagtggcagggtgagtattccaaaagcataagtaaaacaagagtcttgaccaagccctgttacaatgtcaatgcctgtatatggcctcccagcccaaccagaaattgacagaggcatgtatatggtgaaaagatatacatatatttagaattagccatctggactaagtttagatgatcccaattttgttggcaacatccaaagcattgtaatcaggagccagttgaacatatgctttcttctctccatcaggctgaatcagggtgttgaccttggccacatcaatgtcatagagcttcttcacagcctttttgatctggtgcttgttggctttaacatccacaatgaacacaagtgtgttgttgtcttctatcttcttcatggcagactcagtggtcaatggaaacttgatgacagcatagtggtcaagcttgtttctcctgagggtgcttttccgaggatatttgggctgcttccggagtcgtggtgtcttgggccaccagaaggcgggtgacgtgcgggtcttcttttttttgtggctgtgaacacctttcaacactgccttcttggcctttaaagcctttgctttggcttcagctttaggaggggcaggagcttccttctttgctttcagcgccatcttgtgaaaaggctattcaaggtatatttttgatacatggggtaagagacttagtaacatgtgcccagatgaatttcaaaattgctatggaacagt

SEQ ID NO: 65062 - DNA, 1047 bp, Homo sapiens
tacaaaaaatttaagaattggccaggtgtggtggctcacacctgtaatcccagcactttgggaggccgagatgggtggatcacttgaggccaggagttagagaccagcctggccaacatggtgaaaccccatctctactaaaaatacaaaagtactagctgggaatggtgtcaggtgcctgtaatcccagctacttgggaggctgaggcaggagaattgcttgaacccgggaggcagaggttgcagtgagccgagaccacaccattgcactccagcctgggcaacaagaaaaaaaaaattaagaattcgcctgccatggtggtgtgctattttgagtaatgggaagtcactgaaggaattgaacaggggtagtgatgtgatgtcatttactttttgcaaagatgcccctggttgctgtgccgtgaatagactagtggccacaggtggaagcagaatggtcatttaaaattttctatttattccaattcagtgtggtcataaaggatcaagtgtaatttattattcacattttattggtatggagaattaattcatttttactattaaaaaaaggtggcatgttagtaatcagaatgttctaggagaaccttccagaggtttgcaactcttagaattgaaatcactatttagctaagaccagaatcgtaacataaggcaagattgaataaggtgaatggatttgatgaattaaagtgctacttgtaaaggatagtaaattcacttttgcattttagatagtagcttttattgtaaatttggatgcaaaatgagataatagcgttttcaccccttttcaagagccatttggagatagcattttgactagatctgtcattcaattcagcttagaaataatttataattttatttttaaattcctattttaggatattatcatattatcatgagataatgataataccactctaattttattataattgggttgggaggaaatagtcttttgtaaaaggttagttagtggcatattgccattagcatttattttaccttttttagaaaatg

SEQ ID NO: 65063 - DNA, 1583 bp, Homo sapiens
ttctggacctatagatgctttgaatttttgttattgttgttgtttgggtttgccagttttttaagtgacaagtagaacagtctgcagtgtctggttgggtcaaaagaaggggagtaaagagtcgaagagagggctgctcagtggggaacctgaaaggactgagtgggaaaaaggggactctgtattgggacaggacatttgtaaactgggcattttctttctataataatctactgttcttgaagaaagatgtgtgcttcctcataccatgggattgtggaaaatgcccacaatatctgggtgtatgcataaactaatatttttctgtaaaattatttttataatatgattaggagaacaagttagagtggtcttatattgcatcactttcactgtttgtctttaataaaaatggaggaagttgctgctgttttattaacttgcaccctgcatgcttctcttctttgttctttgttaaatatgagctggcgtgtgttaagactacgttagcatttgctctcagggacttctgtggtttctaaattcagcactgctaagcccctacactgtttgcctgaatcagttgagactgctatttttagcaacaaaagggaattgaaatagcaattttctttccatgtaatagattcccaagaggaatactgatgcaagctctctatcattttctattcctaccaccctcctcccaaagccctcagaggaaaggcagctgtcatggtttgcggcagtattaatctttaatcaatcgagtgttttctgcattcaggtgttcggggggaaaaaagagtcacaagaaggaacctgtttggaataactaagctcttaggcatggactttacagtcagaattttgtgggtagtggcagggaatagacagaagagctaaaaatagtgagtttgcttccagtgttgctctagtctatttttgatgtttgattttgataaggttgattgggttcttactaaaaatatctgttcctagcaagttgaggacaaaaagagtagaatatttttaacctacacaaactaaagtatttttgttgactgtataaaatctggaagtggagccctggtcagttgccagtattttatataatctgtagcaagctagacacttctggatgccaagttgggctattctttatagttgtcagtttccatcttctcaaaggcttgtaaatttgggttctagtgttatatttgtgtatgaagacataagcctttttaaaaaatcttcctttttccactttccttcttttcttcctctaccttatagtgccacccatgaccatcatctgtactgtcccaacccacagggttctgggtgataccatatagcttttttctgtgtattgttaaaagctaccctaacttatccacgtatttcatagcaaagtggaatctgaggacaccagtgttaaatgaagaagcaaatcttagagacaagaatagtgaactgtccggccaggcgcagtggctcacgcctgtaatcccagcactttgggaggccgaggcaggtggatcacgaggtcaggagatcgagaccatcctggctaacacggt

SEQ ID NO: 65064 - DNA, 1006 bp, Homo sapiens
aggtcaaggaaggcttaatgggagatgagacggtttaactgaaaaacctcaaggatgggagggaaacacagctagaagtgtgtcttagttcatttgtgctgctataataaaatacataaagaacagaaatgtattttctcacagttttgcatgccaggaagtccaagatcaaggtgctggtaagttcagttgtctggaaagggatactgtgtgtttccaggatggcaccctgttgctgcatccttcgaatgctgtgtcctcacagagcagaaggcagaaagttggctgaaggaacacttcatgaagattcttttataagggccttaattccactcatgagggaggagacttcatggcctaatcacctcttaatgtctccacttcttactactgtcacattggccattaagtttaacacctgactcttggaagggacacattaaaaccatagcagagtgtacgttggaggtgtagagaacattttcgaagagaaagcatgttaccttggaggaactgtaaaaatttcagcacaactggggcatgcttgagtggaaggaggaaagtggtaggagtaaggtcagctcatggaagaccttgtaaagaatgaggggagtgagaagccagtgacaggttttaggcagggaagtgaagttcagatttgcactttggagtgattgttttggctacaatgtagagattgaattggagaggagtaagaacgggaccaggcgaatgcgttagaaggctgttaacagtagttcttgtgggagatgaatgatggtagctctaggtggtagcaatgggaagaagtgaatgaatttgtgtttcagtttttatatagttggcaaaagggaaatgtaacttcttggcagagaaaaaatggtgtttgagaaagataatttttaactgtgtatagcatgaattgagtgaggagggatgaaagattcctcgtacaagtccttgtgtttgggatgatagcgtagattggggtagtagttgtgagaat

SEQ ID NO: 65065 - DNA, 1325 bp, Homo sapiens
cagctcagtgaatctacacacacacagtagtaactgccaccctgaaaagatacagaatatttcctgtatcctggaagattcccgtattgcccttccctgttatctactccactatccagagataaccagtattctgacttctgtcaccatagattagttttaccttttcttaaacttacatttttatgtcagactttttgtaatgtcttagagattcattcatgttttgcatatatcagtagttctttttttattttcttttttattgctgtttagttttgcttcttttgttttctcttttattgctgtttagtattccattgtttgtctatatctcaatttacttattcttctgtcgattaatatttagttgtatttacctactatgcatcaactaagctactgtgaacattctttggggtagacattaatgcatttctgtctcttgagaattggtgggttaaggtaggcatatttttagttctgaacatattggcaaatagtattttccaaaataattgtaccaatttacagtgccaccagcaatgtgtgagagtctagttgctccacattctttttaacacttggttttgaagtctttttaaaattttagctattgcggtgtgtattcaaccttagatttgaaccgctggtattgttctgtcttttacatcaaagtgtcacactggtccttttgtatgtaattggtgggtcctaactatgaccaattcctcaatgtaattcttagactaaactattgcttttttccctttcccagttgtcacaggtagtactgatggaattggaaaatcatatgcagaagaggtaggtgattttcaagatctttccttttaatataaaaaataagaataaatatgggatgatttcttatagtagttttgatttttgaagtaaaaaacacaaatataatgttgcatggtacaatagatgctttttgtttctaccttgttggaaataccatatttgcctaaacagacacaattttttgaaacaaatttcatgtaaaataagtataaaactttctggttgtactgggtagttggaactgggaacaatttagtgtaattttattttatgtcatgtaagtgtgtacagtcttcagatttgaaagtcaattattttgaactattttccaaaaaatgaaaatattataggtggttacatttctaggctagtccatgacatcattttcacaagaaggactgtgattaacagaaaggtattgatagacacaggcaaagggttcagattctctgcaatgaaattaaagaacaggagagcatcatagtttgaagaccactgga

SEQ ID NO: 65066 - DNA, 1028 bp, Homo sapiens
acccagataattaaaaaaaaaaaaaaaatttttttttttttaattttttgtagagatgggattttactatgttgcccaggatggttttggactcctgggcttaagcaattctcccacttcggcctcctgaattgctgggattacaggcgtgaaccactgtgcttggcataaaacttttttaaagctaatttttaaattatagaagtggtagacacttaaaggtttaaaaaacccaaatagtatagatgatataaaatgaaaaagtaaaagtctccctccttctaaaaccctttcacatttaaatactagcttggcttagaaagataactttttggggcatttttttggtaaaatctctattttggattatgtcttcattacacttgggtttatattttgaactatcatctggacaggttttcttaaaatgggggttatagctcattaatgtttttcagtgacatgcacaggtgtgattcaaatctcctttactgtttcagttagcaaagcatggaatgaaggttgtccttatcagcagatcaaaggataaacttgaccaggtttccagtgaaataagtaagttctcacatcaaacaaaaggaatacatagctaattaatgttttcaagcagttatccgatactgacatagttatttctagttcaggaaacttctttttcaaggagagatatcattaaagagcatgaaaaagcacaggatgctttaaaaatggatcatcaattttaggctgggtgcggtggctcacgcctgtaatcccagcactttgggaggctgaggcgggtggattacctgagatcaggagtttgagactggcctgaccaacatggtgaaaccccgtctctactaaaaattaaaaaaaaattagccgggtatggtggcgggcacctgtaatcccagctactcaggaggctgaggcaggagaatctcttgaacctgggtggtggaagttgcagtgagccaagatagtcccactgcactccagcctgggtgacagagtgagactccatc

SEQ ID NO: 65067 - DNA, 1071 bp, Homo sapiens
tctcatgagacttattcactaccatgagaacagtatggggggaaccgcccccatggttcaattgtctcttaccagatccctctcataacacatgggaattatgggagatgcaattaaagatgagatttggatggggacacagccaaaccattcacagcgccttattggagattcccaatattaaatatgttatatctttttttttttttaattattttaaccttgctgagagtacagatctttacaaagctgagcatgtggtatatagatatacaatatatctttggcatttgaagcttttaacattcaagatttcagctatgtaaatgcaaccccaaagggccaagatatacagtattttacagttttgctgaggtctgaatctgaattaagccatgacactaatgagcctgaggtagttactgagatagtaggtgaatttaacatactgcctggatcttagcactgtttcattcttagcttcttgtagtcttgtatataataactcttaaagtgatttaaaaaatgttgtgtttgtgggtgtgtctagaaattgcctctcaatgaatgcatctactagttgctagaaataaaggtacataggcagaaagtagatgcttttgactaaatggaatgttgcattttgaaatgctatgatatgaatgaatctaccgtctactcgatacagaaacaagaaaagctacctcatgacactttcagcaagtactgcagcctgtacaaagattgctcagtgactcagaagatatgctttaatgatatttgagaatttggttaactcatgatatgaggtggcacgtgactgttggcagaaatgtgattctggagaaagagaggattctgttcaaacattttcatgaaggaacagatggtaaagacactgaattgacctttattaaaaggcatgggtttttatccttgttaaaatttttgaaaaatgtttttctgggcataatatgaatttaataggagaggtgatatcagcagactatgtcttctgttctaagctgaaaaaatacatagaggagatttataagttaagacagattttta

SEQ ID NO: 65068 - DNA, 1026 bp, Homo sapiens
catatagccccatgagtcatatttttaaaactgcttctttaatgctagaaatatctttgttgctcgtagagtttatatgttacagggccaggaataaaacccatccattttgcctctactggttttgcccatagtacctgtaactgtagagatattctacaattttgtcaatgttcctggccttccagaaagtgacgttctgtactgcctgtaagacagactccacaaggcagtgagctagtcccaggatagtttcctgaaaggtctttgaagcattgtttccacataagagaatccttgttccttactagtgggcttgtcatgcttaattaaatgaaatttaccattaaatgaaacatttctgttatggtcatggttacaaaattgttttatctaattatatcctgatagggagaaggatagattcttactgagacaatgcaaataattacattgtcatgtaaaataaaagaactcaataaaggcatgttgtagaatatttggccattgctttgattagttttacagacaaggccaatcaatatgtgttgtattttctatataattaacatctttaaatttatctaatgatttaccagtttatatttcagctactgttgcagcgtaacaaaccaccccaaacttattgtggtaaaggaacaaccattttagatgctcacaagtttttctggtcaggaattttgtcaggacttagacaatccttttgctcctcatggcattactgaggtcactcagtgatattttgctgacggatggtctggtctggaagatctaagatggcttctcttaacaggtctagtgacttggcaggagatggccagaggctggacttagctgggactgttgactagaacacctacatgtagcctctctagcatagccatatcagggtaactggacttctcacatggtaactatattcccccagagtgaacattccaagagaaccaggcagaggcttatgtctttgttgcctggtctcagaattcacgtagcattattact

SEQ ID NO: 65069 - DNA, 1079 bp, Homo sapiens
aatgacctagcgttatgtctaatactagaatcaaagagaaaaggaattcattaacaccaataggaattttcacatatttgaattatttcatttctttgctattaaaagccaatagaattaatatttaacaacaccaggccactaagaatagaaaaaatgatatggaatcaacttttaatgtgctttcattctgtttaatgctgtagagatgtacaaaatctaagacgcaatcattctgcaatacctgatgaaagtattaagtcacagatgtaaatacatttaacttttatggaacacttaatcatattcaggcatgtttggaaaacatactcctcacatgatttaaaaggcatctctgtttaggaactgctgatggatcaatactctcattttataaatatgaaaacgaagtctggggagagaccaactcacatccagtgaatggcacaactaactgagttctaatctttgacttcttgtgctgtgttctccgtgactccatgcttttaagtgtactttaagtattgtaggtgggtaactgaataacttttggaaggtgcatccccaaaacgtaatgtcagaattacatcacatcaacagataaaacacaaactaaattaaatttgcagcatgactatgtttgaatgcaattgcctgttggagttattatattatttaattgatatatacaataatttttcctttttaagacatagccatgcccttgtattcatttatttagagacagagtctcactctgtaccccaggctagagcacagtagcacaatcttggttcactgcagcctctgcctcctggtgtgtccagagttggttccttctggtgggttcttggtctcactgacttcaagaatgaagaagccaaagaggttccccttgagtgttatatagcgcttaaagatggtgtgtccagagtttgttcctccagatgggtccagaatttattccttctggtgggttcatggtcttgctgacttcaagattgaagccacagacctcactgcgagtgttacagctcttaaaggtggtgtggacccaaagagtgagcagcagcaagatt

SEQ ID NO: 65070 - DNA, 2821 bp, Homo sapiens
tggtgggttacaagaatatctctttttgctttctaacttgatttgtaggtcacggttatcctgcatggaaaattggtcagctctggcccaaatcttcttggtagtcatttcatttttcaagctaacaaagagagagaagtaacttacctcaagaaaagattcgttttactaaaaaataacagagagacacatttcatatgattaaaaaaaatgctgagacataatcacaggaacattgcctcatatgcagaactagaaagactgttttagctataaaatgtgatgtttcattaaccagatttctaaagcaaatgtttatacattttataacccttgtgttctgtctcttcatagagctgtttgtctgctcagttgtacagtcctgtgggctctcactcagaagtccctcccagcctagcctgccttcctcttcccactgctgtctctctctccatgggaccctcctctctcacgggactaatgaagcagctgctttgttctctgcctgccacctgtcgctttttataacaagctgtgtatcttctactctgccaccgtcatttccttcctcaaaaaaaaaaaaaaaaaaaaaaaagaagtgtgatcttgtaacttcccagtttaataacctctcctaagtaattgtaacacacaggaggaaatataaacttgttataggaccaattccataggcctgtgacctgagcatttgcatggagccccacacttagaagggtccatacttggtttaatgctctgctattgccatcttgaaattcttaataacttttgaatgagggggccccacatttttattttacactgggtcccacaaattaagtagctagtcctatttgttatcttggaccatacaacctccaccagctgtcttctacgaattttctttccgcttctctgtgccatccacagggattcttaaaacatgctgttcgttttctgcactttctggttttgccaacatctgccctttcttgatagggtcaattcctactcttcaccaaaaactccacacaaatgttacctagtaggtaaaatagcactctgcaagaatgagttgctttctctttgatgctttgtttatatttattagagcagcaattgggtttacacatatctccttcatcaaaatataacctatttgagggtatttgttattgtcctcagggtgaagcctgacacatgggcactacttagtatgtatttcttgaatttattcaatcaaaacatttattgagctcctataaagtaccaagtactgttgggctttgagtaaacagtagtaaagagcaaaaaacagacacagatcctgccctcatagagcttacagtttagggagtgagatgctttgccagattgcaacttgccatgctcctgaataaatgaatgagcacctgggccttggtttagaatgggaaatctttttgtctctttgactagcagtggtggtggaatattatgatccctagagtactgggaattttgtatttggaagctgacccaggtcatttggtgacattaaagagaagggtaggctagccattgtggtttcatgcctgtaatcccagcactttgggagctcatagcaggtagatcacttgagcccaggagtttgagaccagcctgggcagcatgacaaaacccccaaaattagatgggcatggtggcatgcacctgtggtcccagctacttgggaggctgagatgggaggatctcttgaacccagaaggtccaagctgcaatgagccatgaccgcgccactgcactctagcctgggtgccagagtgagaccctgtcccactgcccactgcctcccccccgcaaaaaagagagagaagcgtgactgtcagcagggttcccaggcttctttcatcaaatctgagataccattgatcatgaagcaacaatgcagcttataaccactaagaaagaaaattcaccaattaaactgacttgccatcaattataaaacaccttgatttcagagatgaaaagtgaactaaaatgtacaccttggaatagataacatacaataatttaaaggttaattacaagcaaattgagtcaaggaaatacttggacgctaaaagcaaggctaaaaatagtacatcatgaccattgattccatggatgatatggtaatgaatcactttttgaagcagagtcagatgttcatgccagcttgaaaaaatatgcagctgatgcaaggaggtaagagttaagaatacagattatacctacagcagcctatgctattaaggaaaaaacaactatttgccaagcagccatctttgtagatattggcagatagaggagtcccccccgtgtctgcaggggatatgccacaagatccccagtgaatacttgaaactgtggatagtgctgaaccctatatacctatatgtgctctttttctgatctgataaccaagagagatactaagtgactaaagagtgggtggtgtgtacagcatggatatgctggacaaaggtatgattcacactgagagcaggacagtgcaagatttcatcatgctaattagaatggcgtgcaatttaaaacttatgaattattatgggccaggcacagtggcttacgcctgtaatcccagcactttgggaggctgaggcaggcggatcacctgaggtcaggagtttgagaccagcctggccaacatggtgaaaccccatctctaataaaaaaatacaaaaattaacagggcatggtagtgggtgcctgtaatcccagctactcggaaggctgaggcaggagaatcgcttgaacccaggaggtggaggttgca

SEQ ID NO: 65071 - DNA, 1761 bp, Homo sapiens
ttctaactgcatcccaggctcttccagtgaaccctgctttcatactgctagcagtagcatcttggaatcttaagtgtagtaatcttaagaatgatgttttgggccgggagcagtggctcatgcctgtaatcctagcactttgggaggtcaaggcaggcggatcacctgaggtcaggagttcgagaccagcctggccaacgtggcaaaaccctgtctctactaaaaatacaaaacttagctgggtgtggtggtgggtgcctgtaatcccagctacttgggaggctgaggcaagagaatctcttgaacctggcaggcagaggttgcagtgagctgagatcacactactgcactccagtctgggtgacagagtgagactctgtctcaaaaaaaaaaaagaagaagaagaagaagaggaatattttgcctttttctcccctcaaaaaacaaaattcaggtacttctgttgaccttttgtttaccaagtgcagaaaaatcaacgttgttatatgaaaatttcttcaagagtggtttgtacaagagtctacaattcctggaccaactgtagaacccagagctttcaaaaggatggagcctattcacgtcctatcaatagaacagattcacgcagcataaggtttttatttattgcaagtggttgttctagttaaagaggctataatgaaaaaaatataataaccttggcttaaaataaagaaatgcttggtttgagatagaatcctgatgagctatgattaattttttggaaaatgggtctcttcatatgagattaaaattgtcatgaatatttttccaagggcaacataaaaaaggaaatagaccattatttgtgtggcatctctgctcattgtaattaaatgggcctttataaatggagtcagatcaattattcccttctggtacacaatcaccttttccaaagtcatgtaaggcaggctttctttgttgggggatgtctcaccccaagggatagtagggatgtaaggatacggtaaggcctaggagttgtgggggaaagaagacaggaaaagaagggaagtggagagaaattggttagggtactttgtttttcttttccccttaaaattagagaaagtacaaaagacttgtcttgcatcttttaaatctctaaatactgtaaaacataattttagtgaaaatggagaggttttttaaaaaacgtgcgagacatttttatggttacaaactgaattttatgaatttatttttaagatgctaaaattggtacgcattgaatatagtgctgtttctctaagagtctcctctccccaactcattatcttttccaagactggaataagggagattggtacatgactaaaatatcctcaaccttcatatatgtgcccctgagccaagcttagagtactttattcatgagatgggatggtttctaaggtttcttataactctaaaatgtttgaatttatatgagaatgatagtccagacccgtgtatgacagatggaggaactgaattgtctctcaatgtaaccttttttttttttttttttttttgagagctggagtcttgctatgttgtcctggctggtctcaaactgcagggctcaagtgatcctcttgcttcagcctccagagtaggtggtactacaggcgtgcaccaccacaccccactctagcttatattttaatatgcctaatgttctgtcttatacatacatttcttaccagcatgtaagaaatgtaatttctatagggagga

SEQ ID NO: 65072 - DNA, 1106 bp, Homo sapiens
gggataaaataaagcagggaagggcatgaggagtgctgggggggatggttgcatttattaaagggtgggcaaggcaggcttctctgagaaggtaacatttgctcaaggacccaccagagacaagggatgtggaagagcattccaaacatagggaatggtaagtttaagtcccgagtgtacgtggacaacattctgtatctaaacaactgctaggatcccctatggctagaactgaggagcaacggggagagtagttggaggtgagttcagccaataaactcacaccgtttattaggctgttgccacagccttttggctcttactctgagtgagagggaaatctctggaggtttgtgaagaggtgggtatcatggtctgacctacgttaaataggaaaagccgggaacgatggtgtgtgcctatagtcccagctactaaggaggcttaagcccaggcttgagaccccatctcttaaaagaaaaaaaaaaatggaaaggctcacaatagaggcagtgaagaaaagttgttttttaaaaaaggcagtggtcactgtattagtacatgattctgggaaatctaggtatgagttcagaaattttaattaacctgaaaaacttgtaccagaagccatttgcttatgctaatgtgaatacaaagagcttgctttggttcattactaaataacattcttcgtgaaagtgtcattgaatctttttagcaacatatctatacaaaactctacaatgtaagtatgtacattcagcaaatcctgtgagatgcagaagagtgaatttggttcaggagttgtgagttggcttttattggtagaaaatttcctgaatgtcaatacctaatactagtatggaaaaataatttgcttttcaaaataaatagataaatttaccttatgttattcttgaatgaagtttttcatttaatcaaaggtatttttaagcttttgttttggggctttttttttcccttgtggatctgtggctataataaagtcagcattctttatttactggtgataaattctgtgaaatgttaaagtagacatgttggaccagctattgtgaaattacagctctgtctctaacttccca

SEQ ID NO: 65073 - DNA, 1082 bp, Homo sapiens
ttttatttccattgtgataagatagactttttgttttaatgtgtcacactttaaaatattttacaacatgaagacttcttcctgaagttacaaagcaccaatttacaattaaaatcacaaagccagtgatatttaaagagtatataactttatgatatgaatcatgttttattatttgtacctaagggtctaaaagtagttttcattattgatttacaaaagaagaactgattaaggaacattcagccagctctctgtgacgacattagaatttttattgcagaactaatgtgttgactctatatcatctcttagatggtctcatgattgcttaaaattatcctggtgtaaattttgtatcaaattgggtggggagaaacgtctgaaaggataatgctatcaaatgccttaatcttcactgccatgtactaattttccctgtctctccccgtttgtgttttctttttccctagaagaaaaattcaaagtggagacaagaaccattgctgttgactttgcatcagaagatatttatgataaaattaaaacaggcttggctggtcttgaaatcggcatcttaggtttgtatttttgccacatttataggttcttcttgtatttattatttgactttatgactttggatgttaagtggtaaaatgactagtgagaaaattgtcttatgattacgtaagacattatcagtgaataatatcactaggtgacattaatatatacatttgaatctgtgtttttagttctatattaacaacatacaattttggttattttccttgttatttctcttattctctgtgtatatttagatatacagttgtccctgggtatctatgggtataggttccaggacctcttcatatgctcaagttcctgatataaaatgccttagtatttgcgtatagcttatgcgcatccttctgtatactttaaatcatctctagattacttatagtacctaaaacaatgcctacacatcacttcatttgtgcagatttaatgtgtagacacactggtaaactcaagttttggtttttggaactttgtgtaatttatccccctga

SEQ ID NO: 65074 - DNA, 3135 bp, Homo sapiens
ttaatagcatatctcaattcagactagccacactttcagtgcttagtagctacatgtggccagtggttactgtatttgacatctcaactctagttcaccttggccatctctcaacctcagtttgtatgagggaattatgagtataatttattgatttgtcttagcttttaagcagtggttctcaaccaaggacaattttgcagtgtatggcaatgttctgaaacatttctgattgtccttcttggctaggggagggtagttctactgtcccctagtgggtaaagctcaaggatgctactaaacattctataatgtgtataggacagccttccacagcaaagaatgatccatccaaaatgtcagtagtgctgaggttgataaaccctgctttaaaattatgctgtccttaaacagttcagatactcacacaactttgattttgatttctagttggttgcaaatcaataataaaaatcattatagctaatgtttacataatcctttaaagtgtatagctgaacttttgcatacattatctcattagctgagctgtaagtttagttttcttcctactctaccacaaatgtctccttaatcataagatttatgtaattattattgacatttattagcacatattttacacatggattgtaattttaatttctcaagattttcgatggaactattaaaatacttctgtgagttaaattttattactaggtcatatttcaactccattcttatggttccttcactagtatgggtataaccctctagaacttgttgtggggaggtctgatgtgtatatgttttctttctcttatgattacctgaatttatagccccatcaactttcttctctcccgcatccccatccagatcccacatactctcacctctgtctagtaagggcaaaataatttagtctctttcctctgcttatgcaattctcacttttataacattctctaaaatattctatgtatagactgatttctagtaagacctaggaatccatattaagtcataggaaggaatttttttctaccaagttttaatgaaactagtaaggataataagaaaaataaatcaccagggtacaccccatttgtttgaagtgttaagcaccaaacagtcagtgcttaataaagaaaattaatattttcagaattacaaaggaaaatgctaaagcccttagtcatgaaagaaacattaagttttcagtaagataagtggaaaggaaacagccatgaattgtgagaatttatcctgaaaggtcaccataacttgatgagactataaatgcttaaggttgagaagttggattcttaactccgttacttaaaaaaaaactaagcatctactgtcttctttcaggcaaatgccaagaaatacagatttcagaaagcttataaaactttggctatttagagaaaatgacatccttactgctttgagtaagcaaacaattggttaacaaagtgtgattaccgtaatgcttacttgattccttaggagagactctcatgtgtgctccagattggtttggaggactttgcacaatacaactcagggaggcgtaatttaccaaggccaaaagagtaggcttggcttttaagtatgccacagacaatacttttttcaaattctactactatgacttttttaactttgtgagattctgtattatagaaggagaaagaaaggtcctcttggaaaaatatacttagtttgtgattcatttaaaaaatcaaccatagctttatttaagcttttattgcattctagacaagaatttccccatgccagatgctctcaaggccttctctgtccatagtgttgatggcgtatacaagttgtagcatcctcagctggtacaaggtgacctgtgttgccctactggcttagtgcattcaggactttagtcatccatcgactttcttgattctttccatacgcattgctaataattttaagaagcctcattttaacaacaacaaaatgtgtagataatagaggtcagttgattgcaaagaatcactgattgccaaagctggaatagaacttattattctcttttcttcctgtgccctttataagtgaacacttgctccactaatgttcttggtgaattattttttaattggtgtccttcctttttcagctgaatgcaaactctttgttatccttgcctgtgccaccactttcctcattaaaccttatggatttggggaagcaattgtgttgcatttttctcccgaaaacctagtgtttcccagaaggttctaggatagagaatagttgaatataaatattttatttactaaactaaaagatagtttgagcaaagatacccatcagagttaagatcagagtaactctgtctctgtgtatacttacattttcaaagtttcttaacaaaagacccaagagtattattagctacttggggaaaggactagttagcttccaaatggcaaactcctagttaattggtttgggatccagagatggcttccttataattcagtccccagagaagcaaaggaagagcaatagatgtaggcctaggagagagaaccaaggcactacaggaacagtgctgaggaaaacttttctaggattgcttggaaggaaggaaaatggagcatactaggagtttatgcagcttcctggtccctgttgattaaggaagtcacaaataaaagagtcttatttcttcagaggctttagaaatacataatgctacagattctcttcttgctgttctcaatgttataaatagttttaagttgctctcatttgaagtgtaaatacctctaaagggctaatggcacctgttatttaattcttattggaactagtatattcagtttattccttgtctacttcttgctgggtcagttggctattttagttagtgaaagacatggaaaagtcattttaaaatggagaacaatagtcttaaaaaaggaaactatgtggtaggttgataatcagtggggtgcagagatggagacacgcagaaggacaaaataaaattatgttgagagagcaccaaaggtaaacttaatgtagttagaattattatcccctactcccgctttttctctgtagcccagtatatgagga

SEQ ID NO: 65075 - DNA, 1064 bp, Homo sapiens
aaatagaactgtaagtcatgaaattggtgaatgttcttcccaccagctaacatttaactaccaacctcatgtcatctttcttcattccctcttccaattttatgtatagcaaatcttacctagttttgtaatgaagatcacatagcaatttataattaaacagtggaagtgaaatgttctgttgtgttgcttctgattcagtcttaatttttcaatttctgattaaagcactgcaaatttaaagtcttgtaaactctcttttatttggaaattgctactcacaaatgtatgaaaactgtaaagtttgcaaaatgttttacatggtgttccaaatatcatctgtcagagtatgaacatgtgctagctaaagcaatatgttaaataaggcaaagatggaatttactttgcatcactttccaaactctctctataggctgtaagagtggatctaattgaatgaaataaagagggtagaggagcaattaggagaaatttaatcagtataaatagcagcagctctggttaatggatgtccagagtccactctctcagaaggatctctccactttgattctggtcatacgtaataaaagtagggtactttgggcttgggcacaaaacaggagtttgataaatttttgttgaataaatgaccatacaacaataacaactcttcctcttccatttattaacatattactacgtcccaggcattgggttaaagattttatgtatatgatctcatttaattcttaaattactatccccattttatgtcaaaggacaatgaggcaatcactagtttcttgttaggagctggtagtagtggagctgggactgaaacctggttctgttaggactctggggtctgtattcttttagctcaaaaatttaagacaggaagtttcccccacttttggtatatacactgttactaaagtatacattttaaaaattcagtttattttgaaatatagtgaggtagcagcattttttaaaatctccttttattggccaggcgtgatggctcacacctgtaatcccagcactttgggaggccaagg

SEQ ID NO: 65076 - DNA, 1018 bp, Homo sapiens
tagtagtgggattgttggatcatgtgatagttctatttttaatattttgagaaacctccatactgttttccacagtggctatactaatttacattcccaccaacagtggataagaattctgctttctctgcgtccttgccagcatctgttattttttggctttttaataacagctactctaactggggtaagatgatatctcattgtcattttgattcagatttctgtgatgattggtgatgagcattttttcatttatctgctggccatttgtatgtcttcttttgagaaatatctatccatatcctcagcccactttttaataagttttcttgttttttaaactattcagttgtttgagttctttgtatattctagatattagtctcttgtcagatggatagtttgcaaatatattcttccattcaacaggtagtctcttcactctgttgattatttcctttgctgtgcagatgctttttggttgaatatgttttcttatagagctatgttaaatagatgttcacattttcattgtgtgaataaatagctttgatagctttcctttgctcaattatcagagacacagctgaagactctctattgtttgtttttgtttttgtttgagacagagtctccctctgtcacccatgctggagtgcagtggcgtgatctcggctcactgcaaccttcgcctcctgggttcaagcaattctcctacctcagcctcccgagtagctgggactacaggcacgtgccatcgtgcctggctaattttttgtatttttagtagagatggggtttcaccgtgttagccaggatgatctagatctcctgacctcgtgatccgcctgcctcagtctcccaaagtgctgggattacaggcgtgagccaccacgcctggcaactctctattgttaatacagtcataaccagaataacacttctctgcttgcttagttattcagggacttcctttgcttaactttgtacttatagtacatgtaaagattacaaa

SEQ ID NO: 65077 - DNA, 2039 bp, Homo sapiens
tattaaatgagctctcattctggagcggaacaaaatgcgatgcatattgtacatgacttatcccaaatcacatgttttctgaaaactgttataactagaactcaagttttcagtatcctggaccacggtactctccactctttctactgcactatgaaaatttaaggtctggagaagagttaagtaatatctccaaataacagtatgatagaggcagaatatacatatcccaaagggctatggaaagtgagaggcaagtataagttctgtcagttgctggatggtaggtacaggaaggtttaatgaaggaagagacatttaagttggacttttaaggatagattttggacagaaaggtgtggaaaaggttatgctagccataaacagcattttatataattatatatatcatattagtcttgatatctttaatgtcattattttaacaaatctttaaaatatgcatatgttactcagctaatcatcttgttctatttcagtgaacaacgtgggaatgtcgtatgagtatcctgaatactttttggatgttcctgacttggacaatgtaagtctttctttgtgtattatggtaacaaaaataatgcatgcaggtattggtataatgattcacactatgacactggagtccagctgcctgtggttcacacgctggctcttctgtttactacctgagttccctgggtatgggcctagccatacttagtctcagtttccttgctcataaaatgggcagcttcataggggtattagaaagatagaatgagaaaatatttataacctcacttatacagtgccagattcaataatagctctagttttgttattactcttatttttgtttgtgttatatcaaaatagctctgttgtaagttttatgattctaaacatcaacttaaaaattgtaagtatgttaatatacagcaacgtggttgattcaggtaaaccagctctaccaaaatgaaagtgacatccttgatgcatgcataatcctttactgaaaacgagaaaagcatatcattgaaggactatgtaaaattttaaaaattattgaaaatcctaggttcagtaatttctatgctccatactagcagaaaggaaattgcaaagtgttctatttattttagatttaatgtgtctttttacttccagattttacttgcacatacactttggattctgcatgttagcatcaattatcaccttagttaggaaaatataacacggagagtaaaatgaaatctgcctctctaccccaactcttgtcatttttccaaaatctctgcaatatctggggaaatgttcaatgcttctctagattacctaagtagatatctaatagggtcactttcatgatcaagtgtatataaaattctcaatatttttttgcaggtgatcaagaaaatgataaatattaatattctttctgtttgtaaggtaagcatccttgttataaagatgtcatccttttttggttccttctattcaaaaacactgacataatcagcttgttcacctgagtctactcttgtttagatgcagatacatgtattccagatacaagtggtctattaacttatttcttcagaaaacataaagaactgaagaccaagcaggtgcctgtattatttgacttttcatttatttttattttatttaattatttaattttttatttccataggttattggggaacaggtggtgtttggttacatgagtaagttctttagttgtgatttgtgagattttggtgcacccatcactcaagcagtatactctgcacacaatttgtagtcttttatcccttaccctcttccacccttttcctgagtccccgaagtccattgtatcattcttatgcctttgcatcctcgtagcttagttcccacttataagtgagaacacaggatgttggttttccattcctgagttacgtcacttagaataatagtctccagtctcatccaggttgctacaaatgccattaattaattcctttttatgactgagtagtattcca

SEQ ID NO: 65078 - DNA, 1220 bp, Homo sapiens
tagttctgtgaagaatggcggtggtattttgatgggaattgcattgaatttgtagattgcttttggcagtatggtcattttcacaatattgattctacccatccatgatcatgggatgtatttccatttgtttatgtcatctatgattcctttcagcagtgttttttagtttattaaatgctttttgtttattaagtgccttctatatgcaagcactgtggtagctactgggactacaaaaacttaggctggagacttatttttacaaagatttcatccacacgctatttgtcactgataaattgtttccattttgtcttccccatgattcttttcagttgaggaacttaaatgttgtgataagcattgtacggggaatatggaagtataaagcaatgggtgtgatttttaatagttactcataataactagtctggttgctagttgctaagcatgtgttatagtcatgtcacatgtatgtgccaacaaaagacaacaagccaatacctgccaaaaggaggaatacttagcaagtatgagcatctcaacaccattttttcttatattgtattagtaactacaaaaatatactgtactttgattatacataccagagcagtgaaaaataattgcctgaggcagaattctcatgggcagtgtcagatacttgaaatttgaacatactcatagaaagccaaatccattttcagtaactcatatatactagtttaaggaaattcaaagcatgtttaactcaatgtttaactttgttgttattagccaagtttttttctcatataagattcagtttaagtgaggtaaactaattataagtggacctgtgagtgagtctggagcaagactctcatgcacaaaattgatgcatttaaaacatggctaataggaatatatctaatagtcccaagatcattataagggctctcaaaatgttattgttgttcttaaactcagagctgatacagattttaataatatgtggaactatgactttattttttagcaagcaaaggtttttgatcaaaaatatcacttttagtctacaacgtatatattttataatttttgccttttgaaatgaccaacgtgtactattattttgatatatcttttctggtacatttggccaagtgcttgaaaataataagtgttaaaaacaatgtacatgtgtttcataatatcttgtgctgagttaatgataa

SEQ ID NO: 65079 - DNA, 1024 bp, Homo sapiens
ggcagaactggatatctacttacaatttttatacataagctttcttttgcaaacctaatcccatttaaaaagcactaagggagtttgctatttaaagcacttcttcatggagccaaataagcatcccttcatttatctttaatatgaatctgaattttcctgtacctttgtgatgtgtacttctaatagaaaaacaaatcaaaactctcaacatgtggaatcaatggatcatggaattaataccatctggaggcttagccaattagtttttgttgtactacatgcagaagcaatgtagttaacattgcttctgatcacagttgactagtgaccattcagatagaaaatggcttgacgggagcagtgggaggtgagtgatgtgcagtggctaaccagcaggtaagaagaggaagttagggcatgactgggcaagaccttgagtgctgtgctcaacaggctagagagctacagaaagccttcaagtagatgtaaggtgtgatctgacctatgttttagaaaggcagttctattggcagagtgacacggtaataggtattttatgatgcatgtgtttttcttacttatactgagagaaaggcattcaccttgacgaaatttgtgtgacgctcccaggtttaggactctttggtgctgctgtgatttgccctataatatatttggatgaattgcacctattgttctttagttgactgtgttacgttgccagggccagggccacattttcagtagcaatggctgtttggagccctggggtaacttaaaagaagatgaaaattggtgcagctacagaatctccaaaggttttattgtggctggacatcaggggaactggggcatggatgtctgcagcctaatgccacaatgaatttctcagaaaaggcctgtataaggaagagagcaacctcttctcaccatcaatgttgggccaagttttatctcctcactaaactacatgacagggaataactggctgagaagtgttccaggagagattggtgaaatc

SEQ ID NO: 65080 - DNA, 1986 bp, Homo sapiens
cgtgatctccgctcactgcaagctccgcctcccgggttcacgccattctcctgcctcagcctcccgagtagctggaactacaggcgcccaccaccacgcccggctaatttttttgtatttttagtagagacggagtttcaccgtgttagccaggatggtctcgatctcctgacctcgtgatctgcccgcctcgacctcccaaagagctgggattacaggcatgagccactgtgcccggctggtatatgcattcttttttaaaattttgtttagagtttatgaattatggctttggaatcattattaattggcatggagctctttgttctgaaaagttctttttcttttgataaattaatgtagatcaaaccaaatttattacaaaaggaaaaattttattttgaatgatataggattgaatttaaggttaagtaatatggagctgggaaaatggcaaggcagggctcttaactttcacaaaaacttaacattaataaaaagggaaatcaaataatacttggagatctcaaagcactcttagaaactttgtctaattaagctttccacccactgtgcaataaatattctattagctatacaggtgagattctaagaatttctaattaagttgtgttcttttttaccgcggtgctcaaattacacagtttgccaaaggaaatgtgtgctgtgtcattgtagcatgattttcaatggagttaccatctaatttctccaaaccaggcattgtgtaacactgttgtcactttctgtaattattttcactgttacactgtgattttgaaaaattattgttaatgattacagttgaaaacttgtttaaggtatttgcatctaagaaattgtttacttccaaattgtgtgggtacgtttttagttacttggattcagatcctatttatggtaagcaggtttctttggggtagagggagggcagatgtggacaaagtggctatttgtggtatcctaattctgggtatgaatatcctggattccaggggctttgcctggattctagggtgagttgttatactttattctctccatgtgtattatgataatacaggtgattaaagcatcttgaattttaatgtaatcttttaatttgagcttttgattgtctttttgaacattatgcaatcatgttttctttgtactgttctctctaaaaaatgaccaaatgccaaagattacatgatatgagaataatttgcttatattgtatcatttttcatactaaattaatgagtgggaaaatctacattggctcctgggtataaaataaagttccttctacaaactgttgattactgacgctacaggagtaaaacagaaaaagttttattcatattaggtttcttttagaaataagattgtggaggcttttctaattgtaaaaacaatgcaagattgttgccaaaagtatgagaaatatatacaaacactaagaagaaattaagtcacttttagtcgtaactgcagatggttacattttaatataacattttcaaggattttctaggccagccaatgcatttttgctgaataatctaatcatctaaataatcttaatctaatagtactgattttgattttgtataagcgaaataagcctcttatttatttcccagccagaatatacattgctataccagtaaatactagtaaatattttactcttgacattgaatcaaattctaaatttagctgtcatcaagacattcatttttcctcatatatttgtatactttttggctagcttgcatataaagtgataacaataccttaagtgtgatataacatatatattaaactatcccctttagattctaggcatctaggattttcttgtggtgaggattaatgatactgtcactgaaaatatatatgtatataaagaggaaacactttccctgcaaggacaaggatttcacactctcactgttgtagaagcacaattgtagaaac

SEQ ID NO: 65081 - DNA, 1869 bp, Homo sapiens
cgtgagccaccgcgcccggccacttttgtctacttcttaggaaagaattaaaattgttcgctatacacttttggaaacagtcccaatggggaagaaaatgggtctggaaatcatgtttactactacttgtctaatattcttaaccactgaacttgcaagttatggtaacctttttttagaagtgtgttaagaggaacaaaaatttttctggtgcagcaattatcacctgcagatggcctaatattagcattgagttaactccagaaacagcctgtgagctgtgaaatggagttcagatagatagtgacaattcacagaaatgcctggtatattcatataaataaccaaatatcaagataccagctgatgcttacagataactctactaataacttagctaaaaatcctataaaaatttggtgttaaagaaaatttaatttgatctgaatataacgaagcctcttaactaatgcgtagaatattaacgatttgtatatacatactcatataaagaaggcttgaaattcaatttattgtgacttataatctgattagaaggaaagataatttcattatagatgaaggcattaatcaatttgataaaagcatgcagatttcaggttaagttttctcaggcttttcattgttattatttgacagattaaaaaaagatgttacattttatgacaaggacagagaatttagagtcagaatgtaaaaggaggagctcatgagctatgagaaagaaattaacttttgcaggggagaacttgtgtctttgctgatgaatcctctagtcgttgagcattcagcaaatatttctggcctttaatagccaggcattgaaatcagtgtttatgtcaagttattaaaacttcttgagttttaattcatatatataaagaatatattttgaacatgtccctacataaaaggcctcttgatgaaggaaacatttaatgtttagcatgccatgatataattttgtaagtatggttttatgttatggggttttgttttgtctcatgattttctagataatttttgccattcagaaagcagacatttaatatatacatgacatgcatatggtataagggaaaaaatagctcctgatattcccccatctccctgcccccaatattccaactggaaatagaagagggactgtttaagagagccaaacaggcagtggctaccccttctggactccacttagctgctttatagttaacagatctcatttccttaatacaaatgcgcacgcacacacacagacacacatacacctgggtaaagacatttttattaccagtctccttccttattctgtttctggtgatctcagaactttggagaactgaattatagcttcccttcacaaaatgctgggggaactctttataatactttagctaagcattatggtccctgatgaaatgtgctaaataaaaaaaaaaaagttttcaaatactgttagggttttgtataatctatcctttacaataaaatacccaccactgttaatatgcctgatgtacatctgtactaccatacaaagctgttcataatacatctggattggatgttcacatagcagaatttaccttgttaaatctggctggcattttatttcttcagaatatttctaggaaaacaaaattcccttctcatcagaatgctgtctactttaattaatatgaagtattattcaagatagaaacaacaaaatttctatgcttagcatgcattgaaaccttattattacaaaacagcatctgtttcttagagaattgatgatatccaggagtcagaaattcacgttacagcctcggtatttaactgtgaggtgattttgactaaaccatt

SEQ ID NO: 65082 - DNA, 3368 bp, Homo sapiens
aatctcagtggcttaacacataaaggtttacttttccctcccctctctacccgtcattcaggatctgaggctccttccatctaggggcgtcatcattttctagggtcttggagttctctgcatccagctgacagatgaaagacaagagagtaaagatggttttaagggaagtttcacttctgcccacatttcattgtgcagaactcagtcacaggctacaactactgcacagaaggccagaaatattagctgtatgcccaaagaggagagaaaaattccaagttagcagatcatattgaaagcattcttaccttacatattataagtggtttcattatagcctgctctttacaccatccccaaatggcttatttcctatggctggtttccatagcattagtatctccattgagtaacagcagagtcctttatcatgatcctttgttgttgttttccttccactgcttccacctctgatgtgggagattttccaaaccctctagaactatagcctagggccaactgactatcgctaaacaaatacctataatcaaactaaggtattgttaccatagatgtagaaagtacataattacattatagaggaaagttgctcttttcacttccctggaattataaacattgtgtacagctggagccaggaggtggttgccataacaaccatgggaaagctaaaaatagcccctttcataactgtattgcttaaggtggaattatgacatgttatggtgttttagggcaagtaattctctttcatgtgctgaatgtttgcaaactttcttccacaaagcaatatttgtacaatgtaagtatttggattgctggttctaattatacacctgacccctatgttctaagattctttttgacatagatctctatttttataggtttctcagtcttcgtgagcatctgttacagaactgtctgtgccaatttcagtattatatttaagctttaatatatatatataatgacaaccctccccctcaagagcctgcttttgtactccttgatatgaagtggaaatgtgaagaattgggatggaatttttttttttttgtacattcttccttggctacaatcaaattctgtatgcagttagcagtccccactaggattaaccctgcagttccggttcctcatagcagcaggtctctcttcccacctgcactgtgggacagtgatgaggtttctaaggaaggtagaaaacagtgacttacttcaaaggagacctattacgtcctctatgacagtagaatttttatagaggtgtggacaaggataccacaacagtctgatagaatattaaagcacttataaaataaaggcttggcaatttttttttaatccaggtgacaattaagggagtcttattgggaatttcacaggtctgagggaattccatgagagagcatatctataggaagctgtaagtgtgagggactgagttttatagagttgggcgaatttaatgtctggcttgtgggaggactagtaattaaagagaatatgtttatatgaaaaggtactttcctgtcagcaattggtgttttctgctttgggttttttcgcaacattttagttctagtagatcctcagtaatttgtaccactgagacagcattgtgtggctgttagcaagtaagcagtataatgaattaagaatgttgcattacagaaaacattgcttgacttgtttatttggatatttgtcataacaaactagaaaatgcgctgaagtatgagcaacatgagtcttcattatagaacttcagcaaaaattcttaatgtaccttccaatcttagaattgttcccgagtccccagaaaatgagagattaaccagggtttagtttcatgtttgtttctgtgtgcaattaagcgcagcccattttgtccttctgcttgatataacagagttgtcatgagtctggctgtgccatggaaactggtttgacgtcactaattctgcttagatggaggattagagctagacaacacggttgatttaaagggcgagtcttttgtgccttgcagtcccaaatgctcagccccgtttctacatagagaacagatactgtatacagtacaaagattgaggcaggctacaccagtatattagctgtgattcagacagaactaagttgaatattattgcctttggaaagaaagagcgagagagttttacactgttgtgtgtgtgggtgtgggaggaaggtttttgttagacaaatatgtgagcttaatggtaggacagagatttgtagaagggctattttctctactgtcactttggtacaattttaaatgctactcttttatttacttaggtcgagtgcattcttgctttatcatttattagtcttagatttgttttcatgtgttttagcatgcaaatactgtattttgtatgaagtaccctcaaactctgacttttcactaattcaaagcaactccacctcctagaagttttcaataggattagaatacttgagaaacaaaatcttagttgccttaaggagcaaacaagtaagggaggatgactgcatgaatgtgacattggataattgatctgtattgtattttaatatgggaaaggaacttttattatctttaaatgacttttcctgtacttagatcattgctttggtgagtgaagttttaagggtctgttttgatcaggtcaagatttaatttttaaagtgcacttgataatgttaaattttaccttttacagatttttaaattgcattttgttagcgagaaatgaaatttaaaatgtaaggtttctgttcaagggcacatataacaaccccagctaacttgagtataatggagcatttaatccagctgttaggccaagcagtgataggctgcagcttcagtggaaagcctcatttttctgcatctacttcaaactagttgtgtcttcacttgctgtgaatgagtttggacatagctgttcccagttatgtgagaaaaggttaaaataaaacactacccatacctacaaggatgcttaggatgcaggagaagggttgacttgtcaagattgagggttacttcttagaaagcatattgtgttgcatacgatacaatagctctcttagttttcacttgattgggatctgctcccagtttaaaggtgatacattccaatatgtcataaatatttttctctctcttttcatagatttgttgagataaatttcacatactgaacaatctacccattaaagtatacactttaatggtttttagggtattcacagagctgtgcaactatcaccacagtctaatttttgaacattatcaataccccaaaaaagataaagatattttaaat

SEQ ID NO: 65083 - DNA, 1107 bp, Homo sapiens
tgggagataggaggtgggtgggatcaggttgcagtggctgaaaaaggggaatcctctgagaagaatggatttgaggggaagatatggtagctgtgacactcctaaaccataattctacactttacctaacctatacatactttttaacaactggtatctttatagcattgcttttctcaagctaattttcacttttttgtagaattagaaattcctggtaactttgattttaaactttcagtagtctctaaaagttacagtaacagttgagctttgccttttggcaaaagacacagtttgatgaactagagtcacataattttagagtcaactctttgttggtgcccaagtatctacaacccagggaaagtagaagtagacagtagaagtagaatctacaacccaaggaaaggacatagccattcactcattgccagaaagttttattaagtacctgttggttatgtgctcagtaccgtgtggaatattttgagggaaagtgggctattatatccagaagcttatggttttgttggggggaggagagaatgtttatatacatagaatgattaaatcctacagtaaagtagtatgtgacgatatgttaaaataaaggtgtatgcagggaatataaaagatctgtaagtaaaaattctcagcactgtggctagagaagacctcagagggtagagatcaactcgaggagactggagatctgatctggttatgccctgggttactaagactgggaaatgagctaatcgtgaagaagagctatttttagttgattgaattatgtctcatttactgaccaagcatagcacatactgatgaaaggcagggagagatatgtggtagaaaaacagctacattattctgtttcgaataattatatatctcaatctgtaattcacaaacaactgcatactgtggcttcactccttttacacggtacattttcctttttagatccaaaggggctattctgaacatttcatctggcagtggcatgctccctgtcccactcttgaccatctattctgcaaccaaggtaaaaaatattttcttaaatcatgtcaatatagtaataaggggtaatttttagtc

SEQ ID NO: 65084 - DNA, 2270 bp, Homo sapiens
acctaggcagatagcttagttaattagaacatgatgttaatgagtctaagattggagatttgatacatgaatgagtccacttcacacagcatagaagaaatgcatctagtcaatgtgtaaatgtacatagcaggcacaagatagactgggcgagagtgtattttgccatgttgtccaggattcatagatattctttgtcacttttggggtgagacaagaattttccagaactctctggacaatgtcataatttcatacaatatcaccattaacctcttcacattactgataggaaagtaatttagaatgagtctcctactgcctgcaggtcaatggcgtcatcttcagatacattgttgaggcattgaatacatctctgaagggaaaatgatcacttagatgttgaaattaagcaggcttttagggaaaaataaacaaaaatatgtacagtaagaacttgaaacatttcagggaaggaaaagagcaaaactccgacttctttttcatgtgaaaaaacagtcaccactgtcttttgaaaagcttggtaccacctcccagcccctacaatctactttctgtatctgggaacatactgtaggcaaatttaaaatgaatgccatgtttcttgaagggattcgtgaacttcaacttatctgttctactccatggctacaaaactatgactaattaggacccttgaaaagtcacttgattctttgcatttctagtctgaggttgcgtccacatttgaaaaatggcacattgtattttacaaatagatttaaggttgtattatcagaagaagatgggctgtcacattcacctctatacttcttggatcttgtcatcccaaagcaccaagaggatgcttgttctgttctttttagcaacaacaaaatccccatagaacagagttgaatggacttcatcttgtgtttctatttgagtggcaagtggagagatgaaatgagtcttttgttatataagagaaaaatattttttcttggaaagtaattttctgaggggagaaaaagataagaaaagccttttccagttaaatcaaaatttgatctggatattatatttggtaatataatacttcatttagtggcagataaaaacagcttgaggttttcaggtgtttttctaagttctcttctgcgtttgaaatgaaaaaaatgatgagaaattatagcattaaatgattagtttattattttgtttccatggctacaaatcaggcagattgatgtaatgtgtgtgttttcttctcactcccactcccctcccagacttttgtagatttcttctctcagtgcctccatgaggagtataggagcaagggcgtctttgtgcaggtgagtggagtttgtttcacttaagtatccctgtttttgtgtggtttccagagcaactgttgctgtcttggcaataacaaaaaaaatcatattcctaagtaagtgaatgtgacattagcacaccattaaaaacgtggtttctttttccttaatgcacttgtctagatttttaaaaaattatcccctagaattttcaagtagggatacctaaagtggaactaaatgcagtataaatagctgaagcatactttttaagttcttagggttttattttgagagaccgagactatcggcatctctctcttttttaattgtggtaaaataaacataaaatttaccattttcatcatttttaatatgcagttcaatggcattaagtacattcacatatcgtgcaaccattgtcaccgtccatctccagaacttttttcatcttccaaaactgaaactctgtacccatcaaacatgaactccccatttccccttccctccagcccctggcaacctatctatctctatgaatttgactactcttagtacctcatatgggtggaatcatacagtatttgatcttttgtgactggattatttcacttagcatgtcttcagagttcatccatgttgaagtatgtgtcggaattttcttccttttcaaggctgaataaaatgccattgtatatagaccacattttgcttatccatttacatgttagtgggcatctgggttgtttctacctgttgggtattgtaaataatgctaatatgagcatgagtgtacaaatatctcttgcaaactctgttttcaattcttttgtatatgtatacagaagtggaattgctgggtcatatggtaattctgttttaaattttttgaagaacttagctattttccatgtcagctacaccagttta

SEQ ID NO: 65085 - DNA, 1053 bp, Homo sapiens
gaaggtagcattaggccttgtgaacagacaatcaatttctaaaattccgttaataagcaagactgtctcctctctcattctcacaacttgtttccctcaaagatcttttctccagattttccacctagtaatctggtgtgactagaagctactgtaaaaacacattagcatttgtcttctgaaatattttattttgataaacttttgtttttccctaataatgaagtataaactgtcatttcatctgtcattgtgttttgtcatatgaattcattcaaggtttaaactttgaatgaatttgatgaaaaaataaagactcaaatgtttgtgagggaaagcacagtcgtcattctgtgtgaatacatcagaatgttgaagtagaatagaaagagaacctcttattaattctgatcaaaggggcaaaaaaaatgtagtctaaatgaagctcagagttaaaaatgattggtttttctttggcggtgtttatgcccacaaattttttggactaggagtatttatcagctgattctgcctcgtactccagcccacacatgtttcctgggtgatcttattaaaatacaaatcagataatgttgctttccttcctagtcctccagtggctgcccataaggtttaggattaaattcgaactccacaaggccatctcctttcttgccactccattgtcctccccgacgttcaggccagagtggacatcccagtgtctagtacatgctctgccctctgaagtgcccatgactggctcctctgttggcatcctttccccaactcctctccagttcttctcactgtatctcctcccagccctatttgcacctgaaccctatggctgctgtccctctctcaaggcttgggccacagttcccctgccctggaaagccttctctcagctccttggcacatttggttaggcctttctttgggctctcgttggagctccttgtatacctctgcctgctactgtctggcccttccctgtctccccacttccatgtattctcgagaacagggctttttatcttatttgtctct

SEQ ID NO: 65086 - DNA, 1015 bp, Homo sapiens
cctttgttttaattattatttgtttgtggtctatatcctcctactgaaatgtaagctctgtaagattagggactctgtttttattcacaatgaattttattcattaagttcccatgcctaaaacattgttctagtaggtgctcaggaaatagtttagtgttaagtgaatgccttttgtgagattacactgtttttctttttgttccttgaatgttaacatacaaattccacatctttggaggtaggttatttacaagattatcagccaacatttatcaaggatctttgtgtagagcacaatactttgaactccttcattttggatttagatgctaagatttatatgtattgttattgcagggccttttttcattgctatataaccagggatctctgcaccagcagaacaactcctttttcctaaaatttctagaaagtctaagggtttctgccaagtagataatcaagggcctttatatggaaaagctaatttcgtggtctgcaagtaaagtaatacgcactccaaaactataatataggtgtataattatttaagtttttgtataccagatcctgaaatcgtagatgaatacacagatttcaggaaatggagttttcctaatattcttcataggagccccagcttctgccttaagagtgtgtgctggctacacggttgaatttaatgctcggtaaaggcagatgtgacaccatgtatgaaatctcatactgtgcaaatacactagaccctagtgtattctgggtcttcattttcccaggtcattgtcatctgatgttctggtcatttttcagttgaaaagcatgtttagtacacagatgatgacacctgaaagatgccctaccatgttaagttccaaggttcaatccctgattcttgaatatctgccatgcagtttcaggcatctttctttccactactccatggccataagccttcctcttctgaatcaagccccctgaattgtactgtgcagtccagttatctaagcaagct

SEQ ID NO: 65087 - DNA, 1433 bp, Homo sapiens
atttccaacatttgaaccatcctgagctatgcagttccctgaaaaacatcatgctcttctgtggctccttttcttggctcctgctgttcccttatttgtttacaattagggaaattcttgcacttcatttaagacttagctcaaacgctgtttcgtctttgaaccctccactaggccatgttaactgccttgattttaaaccatcgtggaaataaatatactttctagaaaagaatttacatttcttagctggaaaaacataacccaacttggaattcctgagtatgcatctcttgtccccaccccttgatctgggggttctctagactagctctatggtttagctgcatgaagagttaacttgtggcaccaccaagtggttcagtcaggcagtgcaacttaattctcctacaagatcaaagtagtccaatttataccatgttacatacgaagggagggaagaagatggcaaaaaggatggacgaaaggaacaaaaaattataacgcagttgagaggtataatgattagaccatctctacctctagaagctcaaaatcttacaatacctttaccaggcttgtgatctatatttgggtttttttttttaatcttcactattttgtgacctttaaacctaatgcatagaaatgagaaatggtttgcttatgttccttcattatgtgagatcagagtatttacatatactctttctttccttactgctcaactttactctgggaaataaccttttctttactgacccattgtgagagcctcactgaactctgcatttcctactcagtctgagtcggagatctcaccctagtgtgtgctctcatagactatatccttgtggcaaaatggtccttaaaagatgtgacaaaaaatttttttttctaagtgagggataaatatatagtgataatcccaataaacaaattctcagaaatcaaaagttacctaatcaaagttggctcaaatattgaagtacttcatacttagtatgagtctgtggctgcagcaacaaggaaagaggaagatagagagtgacagcactccatctggggttcttggttctaatgaagaggctgaggtttcatctaacctgtcaaggagagtgggttgcattccttgacttagacttcggagtgggaaaaatgcaaagcacacacgtacataaaaacccagagacggccgggcgcggtggctcacgcctgtaatcccagcactttggaggccgaggtgggtgcatcacaaggtcaggagatcgagaccatcctggctaacatggtgaaaccctgtctctactaaaaatacaaaaaattagccaggcgtggtggcgggcgcctgtagtcccagctactggggaggctgaggcaggagaatggtgtgaacccaggaggcggaacttgtggtgagcagagatcgcgcc

SEQ ID NO: 65088 - DNA, 2622 bp, Homo sapiens
cccatccagtcaggtgtcttttagttacccaaacagtttccatattgttagactgtgtttcttctaaaaaagaaaaaaagggaggtggttctatcttatcaataaaattgtttataaaactcagaagtagaatggtgagaaactagggaagaaaagtagtaacgcaagtctgagaaataagatgtctattttagaaggatcaaagctgatagaacaagcttaattagccataaattatggagaaagttggcattatcccattagaagaataaagtatcaaagatctcctacttggtggttctgtctcaatgttgagtttactaagtgtgaaaagtatcctatcctgaatctgtgctctctggattatttaatgctttcctttttaaaggttcaaaaaggtagatttctgcttatttttaatactttctctggtctcaaactctgttttattgagagattgatttgttacaatttgttttatggtatcatgtgttctatcaagttggctttagatagccacttctcttttcttctctctctgtaaagatacagatgtttctaccactaagagcagtcaagcaccactgtacattctgagtttgtggccttactaatcaatggcatgttttctggggtgggtgttccctttctagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatggtaggtagattttttgaatcacaaatcaatactttctggcttggggtttctttcccattgagttacaggatagtatgtaatagattagcacatatacattgtccagccatagtaacaagatatctatatcttgttataattataatggtcgtatacccaagaactttaaaatctacctataaataaaaacaacactataataaaacattaaatcatatgcttcaatttagcccaaattgtaggctataattacatatctctctcattctgtttccctagggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacattgtttgcccttttttcctctcatttcattgtagaaatggtgacaccacaatgacctggacagt

SEQ ID NO: 65089 - DNA, 1018 bp, Homo sapiens
cacaaaaggtttaggaaaaattatagagagagaaaatggtagagtaaatggggtcagatgttaacctttggaaaatctatgtggaggtatatggatactttgtactgttttgcagatttactgtaaatctggaatcatttcagaatagaaagtttaaaaatagcttttgttctaactaattgcatgtggtcaaagaacatgcgagtatgataaagcctgggcaaatttttatagcctttctctgcctcagctttaccatctgaaaaatggaaataatagcacctatgtcatatattgtttgagaggaagttaagacacttaaagtactgagaactcatccaggcacaagtatataaatatatgttgtagtaggctgaataatggcccccaagacatcaggtcctaatccatgaaccctatgttaccttacgtggaaatgaggtgtttgcagatgtgattaaattggagatcttgagatggggagattttcttggattatctaggtaggtcctaaatgcaatcacaagtgtctttaatcagaggcagggagattgcagacagaagaggagaaggcagtgtgatcatgaaggtgaggactggagtgatgcagccacaaaccaaggaatatcagtagccacaaaaaaaaaaaaaaaaaaaaaaaaaaaaaaaggaagggtcaaggaacagattctctcctagaaattctggaggatgaagcatcccaccaacaatttgattttggtgtagtaacactcattttggacttctggtctccagggaactgtgagaataaatttctgttgttttaaaccactgagtttgtgataaatttgttccagcagccccaggaaacacaaatgtaaattgtattacctattagaggttttgtttgtttgtttagtgtcagggtctctctctgttgcccagactggagtgcagtggcgtgaccatggctcactgcagcctcaaactcctgggctcttacaagtgatcctccctcttcagcctcctgaatagc

SEQ ID NO: 65090 - DNA, 1001 bp, Homo sapiens
ataaaacgagcttttacctttgagaacttgaggtgtgaagctttcttaggtagaagcataaagaaatagattacagatgtggaacatgtggcttgaatttccttgttgttttggtagctgtacgtgcttctgcatttgctgtaggctaagcttttactggtacaactgtcaaattagtattattagccattatgaggtggatttatccgttagctggagacaggagtttaatataagttgaatgttaatctgtctgttgttgatttcctgagtggctttgggtgcatcattgaactttaccgtccacatacatacctgcattgtgtcaaatcttacactgcttgttataaagacaaatacctgtatccatcctaaatcagattttctgaaggtgggccataggtattttgaacaaacttccagggaagtttgatgcagccagtgataatggaatatatgcttggaaacagtcttagccgatttctcaatgtccatgtaggtgaaaatgggaatagtacagtttccttatattctactcttggggactattaagaggaatgtggtttataataggtcctaattttagaatttcttaaaatgcactttcttgtgaaagaaacaaaagtactatggtaagattacaaaaggtgaatgctaaagccagcagccccaaatgactaggcttcttgaatgaaatgttgtgatgacataaactgattttacatggaagctctattgccattgagagtcttctgcctgaaattaattatgccttaggagtaattgttcacaatcctaactaaaagcactgttttgttttgttttaataaacagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccaggcaagaatctgtagggat

SEQ ID NO: 65091 - DNA, 1030 bp, Homo sapiens
cgagtgattgagtaagtaatttgctgtcttcctgtaattgttgcccacagtgaaatgaagagcctggaatctttcctcactgttttttctatctggaagagaatggcccaataagtgtcttaactgtagtctgggatattcccatctcaaatgtctttaaacttgatcttttgagaagactttctgaatttgctgatagtattgaaaatgcaacaagatatccatatgttaaactttgacttgtgtagatttcctggccctatttcaccgatatctgtagacagtaagctaaacctctcaggcaaagacagagagggatttttcctgagtcattgaagcatggttctttgagaagccattaattgcctcttttttttttttttttttttactagcaatgctatgaaagctgctagtgctgtagatgagcttacagtccatttattaaaaccatgtaattattccagaacaatttaaatgatagtaaacattcttcttatattgatctgtgtctaaaatgttcttgtccaaagttggtgagagatgctttgactcctctttttatgcttgtcagttttcatctgatgtagataaattgtcagtagaaactattcttttatcttagcaaattagcatcagatatatgttcttgcccatgatcaatctgtttgttatgctgtttgactgcttgcagattggcttgtatatcttagaaaaagtcgcaggctaatagtctttggttgtttattattttttatttttttggaacaggctgtcactctgtcactcaggctggagtgcagtggcataatcaaaactcactgtagcctccatcttctgggctcaagtgatcctcccacctcagcctcccgagtagctgggaccacaggcacacaccaccatgccttgctccttttttaaaaaattttttgtagagatgggatctccctatgttgcctgggctggtttcgaattcctgggctgaaatgatcctcccacctcagcctcccaaagtgctgatattacaggga

SEQ ID NO: 65092 - DNA, 1007 bp, Homo sapiens
attgcttgaggccaggagttcataaccagcctggacaacataatgtggtcaaattagaattctttaattcagatttggctggctcataactttgcctttattggtgatatatttagttcatttatatactgtcttgaacaaaaaagagctaccctttctcagatttttatttatgttcattttaaatttagatatagggtcttgttatgttgcccaggctggtgttgaacacctgggctcaagtgctcctcctgcctcagcttcctttaatagttgtgattatcggccacaccccgacctctcagaattttttaaaggtggattcactaatgtatgtatatatatgttgggagtacttgtttagtttaaaaattgtcattacctgaagcttaatatcccgtacaaaataagcaatttcagtcatgggtttttaaacttgttttagtttttgttcaaactaaatctcacatgagcccagtgtataaaacagatcagagccttgactggctgggagtcccaccaacttgacctctcctttcttctcctgtagacccagaggtacctctgaggtacctagaactctatacaacactgtttgaaatccactgaataggtcctttcacttctgtgattcatattttttgtattcttttcctaaaatgtcttttaaggataaaatgtcttcactgaacagtgagataatgctgaattttaatttagacattcagttctgaggcatctgaatatagagtattggttggagagtctaaattaatcctctagttcattatccccttttttcttccttttctcactgtttcagtaccaaaaataacccagaaaaaaaatacctacttagaaacataacacaaactttatgctatctcagtattcagtccctgagcaagtcagggaagtgctaattagattcccagtaacattggagaaaaaagcccatcttcctcctttacattcttgtttttcttgttaagcgtgtaattctagca

SEQ ID NO: 65093 - DNA, 1008 bp, Homo sapiens
tgtcattttgtgtgtaatgcgactgtcttgcccttttcttggtctgtggattgcagtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagtgagtattctctttttcttatgctcttcctgcctcttattagtctgtggaaaaagtagaactcctaaaagcttctactttcagatttcgagcatgggaatacacattttgttgatgaaacattttcaagtgactacttccccatggttaacttttgacttccaaagtgctccttcattcatttacaagtccaacaagaattggctgccttatgctaggtgctggcggctcatttcattgatgataaactccctgtcctcctggagatacagtctagttggggtagataaatattgcctattactcaaataattgcaattgtgatcaatgctgtgaaggaaagccttagaagaatgactcaagctagtgggaggctaaggaagaggaaggaggctaaggaggacgtccctgaagaaacctttattttaagtgttcttcatggtaatatggccacttttctgaaagggagcattcacatatgtttgttccttcttagccttctcctgaaatacaggtgaatctaactctttcagagagaggaaactcaagccagattatcagagatggtgatctgtccacattcaggtagaaaaacagtgaccaaaaaattaataacgatataataacttcagtttccaccccagcgcttacctcaattatgtgacatttgaggaatactagggttattaattttttaaaaaatcaaaactgtagtcccttacgactaagaaagatagtaatg

SEQ ID NO: 65094 - DNA, 1050 bp, Homo sapiens
ttcaagcgattcacttgcgttagcctcccgagtagctgggattacaggcgtgtgccaggacccctggctaatttttgtatttttaggagagatggggttttgccatgttggccaggctgttctcaaactcctgacctcaggtgattcgcccacctcggcctcccaaagtgctgggattacaggcatgagccactgcacctggcccaggctgatttttgaatagacctaagccagaccacatcattattagttcttgtgtcagttcttcgtcagatatacttccataagaatacagttaacagactgagtgttttcctggtgtgtattgggtttccatgcatggtatttttaaagcatattgtgtgattttgcatatatgccattaagtaccttttgttggtataatttccattgattaggctttctttggttatgtttacataaaaagtttgatcattgttaggggattggtagttgccggtgtttttttaagtgaacttgctctctaagccttcagttacattggcaagcagccttctcatataccaaggagtaccacttgagaatcagacaaaccagcttttgctatatttgttttagatatgattatacttctgtacacagctttcactcagttaaataccaagttcacatgtgtgaaaaattcatcctgcccttagtaagactcctgttgcataaatagtagagagacactgtatcagtctcattatttaagttcagaccctcttctcaagccggatgtatggaacctcagcttgttgccaggagtggtcctgagaccgggggccgtagcagtgaatgagtaagatgaaattgtctttctcctcctggagctcatctagcatatgctagcactgcgccttcctcctagagttatccttctggcctcctgattggcaaataagctatagtatatatagcctttggtataataatggtttttagttcttcacacttactttctttgttgctcagtatttaagtattcagttactgtttctttacacacatatattcaccaccaccatg

SEQ ID NO: 65095 - DNA, 1049 bp, Homo sapiens
ctctgtgctgagacggtaaggagatctttgtttcgtaagcaccagtgccctctgattcatgcatcagctcagtcagcttcatgtagacatcatctctcggattaaacatttcactcctccaaggtgccggttttttgttttttgtttttttttttcactgtcctgtggtccaagtctgccaagtgctgctcattcattttgattttagagtaaattaccctttcctttaatgatattactgtcattcctcaggggcatagtagacttgtttaagcttgcttttacattcattccgattccttttttgtttagttcaaatcaaagactaagtgaagggcaccttatctatattctggctgttgtcaggctatattgtcttaagactgtcataaagcttatcaaatatacttcagtagaccttttttattctatcaggctggcattattaaaggttttctatacttcttgtcccaaacccagttgtacttttcaaactacattgtgttcctgtttgcaaagattagtctggttcttttcccagctagttttaattctatactgaaaaaaacaagctggaaaaggaactacaaaagccatttggcaggctgctatttctctgtcggttaccatggaaacagtgatggctggggggtgttattagataatagcaggaagtttgtgatgcactggaggtttagatgccaaaagccttgtttttctagcaaattacctctggataaactgtatccttcatcagctgaattctgcaaatgttaggggctcctattcacctcagggtgattgagctacagcaagttgagccctctaaccactcctctttttagcccttgtgaagaatgtgaatcctgtttgtattgccaggagagatgattgtaaaaccaagtctagcggtagagactatgagagcacccaatgaattggaggtcctagtgtttcctttgctaattggttgtgggttttttgtacactgctgggaagagtggagtataaaaaggtcagtcaagtcataaatactgatattttttgta

SEQ ID NO: 65096 - DNA, 1057 bp, Homo sapiens
actcatgagcctcaggaaggagcagattttgttttatgtccatcagggagccagtgaggtgtataaagcagaagagtgacacggtctgattggcaattttaaaaggtcactattgctactgcatggagcctggactagaaagaaacaaggaggccaattaggacattgttagattttgtatataccttgggaccaaggtagagaaggagaaaaagggatgattcaatggcatgagctcagaggaacagggatttttattctctgcttcagaataatgatttgaaagtgttattgaggagtaaggagaatactctatcacctggctctgtgagccactggatggagagccatgatcaccttccacctgagagggtttcagggaatttgcagtcttccagagatagccagatttcaattaggatgaggaagcagagagaaccttcagagctcattgagactgaagatataggtgagtttgctcatctttgaatgggaaatccagaggacacagtggaagggtgcaggagggaaagagttccgggggattgtgtctgatcagattatgtccaggaacagtttgggaatgagtgttctggtattaacagatggctggagaggcttgcacttctgctagtgactgggctcagctggaggtgaggtatggcggaatgtgttctcatatgctttcagaggatgaagggcatttgtttctggtgctagcacctgagatagaagctctttcaagatagcagttcttttaagttgcattttttggaaatattatattgccaagaatggaatgttcatcacatgatctcttctgatttcacatgcacattcagtgtagctggaacagctacaactgtgagtgtaaaaccaggtttgtttttgctcaaattcggtaacttcttacccccaccctatccctagtattattgcagcaataagtctgaacagtaaacgctgtcagcaggtatttcattcaatttcattgacatttcaatgtgtgcagtccagaaggaaaggcagtagtccgcctggtagtttgtgctgtcga

SEQ ID NO: 65097 - DNA, 1026 bp, Homo sapiens
tcttctctcattctcccctctccaaatattaattaaacccctactatgtgtcaggtattatactatgctcagctctggggatatagcagtgaacatgacaaacatagtccctgcccttatgggggttacaggagctagactataatcaaataaacagagagaaatagttacaactcatggttagagctctgaatttttattttagaagatcactgtggctgctgtgtgaagaataatttgggaagaggcaagagtaggagactaaaagagtaggtggttgtagtcatcgcagtgggagactgctagcttggactaaggtggcattggggatgaagagaagttaatgggtttgaggtatatttctgaggatgaatcaacagaacttgccagtaatatgttagatgtgggggtaaggatccagactcccaggtgtctgacttgagcagtggtgagtggagttgctgtttactcaggtggaagagaagctgggatttctgcatttgattttgtccctgctggaggagttccttcttctacgtgcaaaatctgaggtgcctgaggcttccaaatgttaagtaggcagtcgactgtgtaagtctggagttcagacaacaggcctggctggagatgtcatttgggaattttggaataaccgcaatagtaaaacgctaataataaataacaagtgtatagtgctgactgtgcctggctctgctctaacttctttattgaattctctgataattttatatagttgatgccattattatttccattgtacagatgagatgactgagactcagtgttaaattacttgcccaagatggcttagacaactatttgttgaatgtggaatcgaattaaaactaataatatagaccatatgtaaaactgtggaattgtacattatcattcagagaaagagaataaaaaagggagcggccaggcgccgtggctcatgcctgtaatcccagcactttgggaggctgaggtgggcggatcacaaggtcgggagttcgagaccag

SEQ ID NO: 65098 - DNA, 2296 bp, Homo sapiens
gctttcatcactttgttttccacctgaaaaatcttaatttgcttctgttggaacaaaggataaaatagaaactccttacccagattgccaaatccatacatgatcttagcccagggagatccatggactctcactgttcccgtatggttgctccattctactaagttatctctttgctttccccgaggcttgctctccaacttcttaacttaaaagggccccctatagcgtgaaggctttcctgatgcctccagtgcagaaattaataatagttactgtgtgccaggtgcttcctgtgaacctgtaaaacaagaaacaggtagcaggcttctaccttgtcctttctgctcatttgtgttttgtttttataagtgtcttcttagtacagagatggaggtttttctattttgctcatctaaggaatcagagatgatgtggaaaaccaactgcctcactgttatctgagatcagtaatttggaagcatattttgctttgaatgactttttctgattgagttaggggtgagatgaagaatgtgataattttttaaaatcatggcatttattttttaaaatcttaatatattaaacaatacagtttcagatacaaaaaaaattactgcaataaaacagttgaggtgtatttccattgtgcttcccttccttatcaggaaagtacattgtccactgagagacaggatggatggcctctcccagctctacacaaagcacaagcctactggctctcctgggccttggttaatacatggaacaggctatgttttctaaaatgttgtagcaacactcataagtcaaccatggttcaaaaagtcaaccatggttcaaatcacatatttacatattgatcaattctttatgatagacagacataaatgagatacagtaaataatttccagttgttaaaaaaaaaaaaaaaacaagtacaggcgacaaacttggtcatggtacacaaatatacttcatgtgtacagacagcttcattcaggtctaatttttttttaatttttgttttaggttaggtatatttgcaggtttgttatataggtaacttgtctgtcacgggggtttggtatacagattatttcatcacccggctaataagcatagtacccgataggtagtttttccgtcctcacccccgtcccgtcctccaccctccattattcaggtataattttaatttgaaagacctagatatactattatttaagtgataatggcctctaagatttattcagattactatcaaataataaattaaacaaatccactataatttaaaactctgtccattgcttgaaaccttggaggagcctatgctacaatcagttgctaactaaaagcaattgtacgtgtatttgatatttccccacagtttctacctctagatttaattcagtaaaggaagatgatatttgaagatgaagtagcacttgtgtcctgagcatctctcaggcactactgcatggaatggcaaaggggatgcaagaagcacatcagatgacaacggtcttagacgcttacaagtctgctaaggtgactgacaagggaatcaaagaaggcagtcatgtcatggacctatcagcagcatagctgggcaaccctggagctgaatctggccctcagacttgtttaaattgcccagtgtttttaaagacactgaattaattgcgaaaatttataactcaggaaatttcacataaaaatcccacttgtcagcttccctggaaaacccagaagagggggcagcactgggggaacagtgatctgaaatggctcattggcagagcagccaccacctttctgcaggcccctggttctgcatgggtccctctcctccctgtgctgcacccagcccacacctctcacttatgctacttgctggtgtttgtgacccctacagtatagtcagggtgccatataatcaggacaggaaatattaggatttcagaaggaatagagcttaccttggagagcagagtatagtggaaagaatagggctttagagccgggccaatctacattcaaatgctagcctgccctcctgctagcttttgccttagagaaatattttccctccagctccctttgcttatgataaaatggataatatcaccttccttgcctcccttacaaggttgtagtgaggattagcaataacggatatagagtgcctgatgtgcctggcacctgagcacatgccatcgtagatcttgtggaagaagtctggcaggatgctttggtttaagtacctggaaactgttataaaaagaa

SEQ ID NO: 65099 - DNA, 1065 bp, Homo sapiens
gtggaggttgcagtgagccgagatcacaccactgcactccagcctgggtgacagagtgagactctgtctcaaaaaaagaaaaaaaaaaaaaaaagaacttggcttgtaatccaagatctctaagtttgaatgagttgtcatttctcccctaattgtttttcgttactgtcagttgataatgttcagccagaagataggtactgtcatgttttcctggtgagattatagattgctgcagccttctcaagaaagcagtttggtaatataaatcaagtgccttaaagttcatacacttggctccagtaattccattttttaagaatatatcctagaaatatatgcagaaatgttttgcccaaaaatctgcttgcagcagctttttatttattttccctctttttaaaaaaaaatactggtgtatgaaaatcaatctccaaccatgtgctccttactgctccatccttagtactagcataatgcctgatatatacaggtggtcaaaaggtatttgtgagtttaaaggaaggatatgttcatacaaaggaatattctataaccatatttttgaaatgtatatttaaagatatagaaaaatgctcaataaaatattaaaaatggagtacacacgattgtatatctggaagactctgtgtgtatgttgtataaactctggatgataggattacaggcgattttctacattttctgtgtactcttcctcagtcattcagtacatatttattcatatgtgtgataggcactgagaatgtttcttaacaggaagaccacataaactttccctcatggagtttataagagcagaggttgaataaataattacaagtgcatcatttactttagtaaacttatgttactttttatattctagaaggaaaacctgtatgatgattttaaagcattgatgattgtttgtaatttctaagacattcttttaggacaagaaagggatgattttaagaaaactccaaatctcatacagtatgaattacctttccaatggaaagaaaaatgtttaggtttcccatctgttggatggttaataat

SEQ ID NO: 65100 - DNA, 1043 bp, Homo sapiens
ctctggaagttctttaggccaaactgaagagagctcccagatgccaaagtggccttgcgttgatgctctgctcactctcggcggccccaccacatgctccccaggtaattggtttcctaatgcactatccctggacagattccaggattccagtgccttgtccccttggggtcagttcttgacgtttcctagcctggcaagggtcgccgaccaggctcagatgcacccccacaggactgtattgttttctcgttcttgcaggccactttcaaactctgtacagaacgccttggcctgcaagagtaaacaagattaccaggctggaattctgttcaagaccagggcttttatatccagagattgtgggtcagatgcggtgagggatacgtgaaaggaagacacagtgccttccattacagatagaagtaaacccatgtggcttctattttccttggcaaaattagttttttctccttactacaaaagaggtttgtgttctttgcaagaaattaaaaagaaagataaaaagagaaagcgtttgtaacttcacaagctagacatggcaactctttacattggtgtgtgtgtgtttgtgtaagacagggtctcactcttttgcccaggttggagggcagtggtgcaatcatggctcactgcagccttgacctccccgggctcaggtgatcctccaacctcagcctcctgagtagctgggactacaggtgcaccccaccacacctggctaatttcagaatttgttgtagacggtcttgccatgtagcccagcctggtctggaactcctgggctcaagcgatccgccccccatcggcctcccagagtgctgggactacaggcgtgagccactgagcccggccagcttttcacaatttgcagtatatatattttttctacacatttatgtgctttttaaaagaaaaaattaccatcttactgaactaatagttttggggcctttttctacttaggtacattggtgcctgccattaattcttgttctatgacatcatcttgagtggctgca

SEQ ID NO: 65101 - DNA, 1051 bp, Homo sapiens
tcgggcgccctctggtggtggggctggtgcgtgggggtcaggaatctctaggagatacccagtctctcagctgcagcgcagagctctggagaagacagcagaggaaacgaaacaaagaaacaaaaatggaactacagggccggagagggtgttcttccctcggctcagagagagcacaggctatggccttggtggctgtagtatttggcccgtgtcccagtccctgagaacacgctggcccaacaacgggttccactgtggtggggtatcatggcaggagactcttaacctgcaaaggcctcagagatgtgaggccactgtgggtcgatgctttattccagccagggcagctgccaccactggactagtttgagctccacggagtgggaggaacttcctctgagcccagcctcattctcttctctctccaaagaaactccctgaggacagaggggcggactccacatcctgtgcccctctctctgtcttacctcttcggcagcagctcctctttctactcttcaggagctagatgtcccaagtgtctggaagaccttccagtgggcttctagacccttcaggcctgagatcctcccctctgcatagccttctctcgcggaagaacctccttctcagccgggcagtggttcacgcctgtaatcccagtactttgggaggcctaggtgggcagatcgcttgagcccaggagttcgagaccagcctgggcaacatggtgaaatcctatctctacaaaaaaaaaaaaaaaaaattagccggacgtggtggtgcacacctgtgttcccagctattcaggaggctgaggggagaggatcacctgagcccagggaggtggaggctgcagtgagcagtaattgcggcactgcactccagtgtgggtgacagagtgagaccctgtctgaaaaaacagaaacaacaaacaaacaaaaagaacctcctgctgccttcagcccctacctgaagggtctccttgggttaccccagccaacaacagaggttattgaggggaccatattccctgctcagctgtggg

SEQ ID NO: 65102 - DNA, 1062 bp, Homo sapiens
gccaggagtttgagaccagcctgggcagcatagcaagaccccatcactacaaaaaggtaaaaataaaaaaattaacagggtgtggtggcgtgcacttgtggtcccagctactggggaggctgaggtggaaggattgcttgaacctggaaggttgagactatagtgagccaagatcatgccactgcattctagcctgggcaacggtgtgagaccctatctcaaaataacaacaaacaaacaaaaataaaataaaatgggataataatacctgttgtgtagaagagtcaagattaaatgagagcaagtatatgaagtttttagcacagtgctactcaataaatgatagctgctattattattttctgtcccaaatataagctattctcataatgccttcagaagtcagaaagctgttacaaataaccctttaataatctttatttgttgagcatctaccatgtagatgtgaacagaaacaaagttcttatcctcatagagctcatattctagttagggagacaaacagtgaatgaacagagaaaatatatgtatactatatggtggtgagtactatagagaaaaataaaccaggttaaagaagacagagaaagatgggtgggctggggatgttgctatttagtagaaggaggtcacagaaggctattttaataagatgaacatttgagcagaaacctggaaaaagtgagggattgtgttagttatctattgttgcataacaaatgacctcaaatctagcaagttaaaacaacaattcacaatttttggagttcaggaatcctggtggatgcctcaggctcaagatcttttttttcctttttctttttcttttttttttgtgacggagtctcgctgtgacacccatggagtgcagtggcatgatctcggatcactgcaacctctgcctcccgggttcaagggattctgcctcagcttcctgagtagctgggattacaggtgtgtgccactatgcccagctaatttttgtatttttagtagagacagggttttgccatgttggcctggctggtctcaaactcctga

SEQ ID NO: 65103 - DNA, 1021 bp, Homo sapiens
gcttgagcctggggaggtgaaggttgcagtgagctgagattgcaccactgcactccagcctgagtgacagagtgaaaccctgtctcaaaacaaaacaaaacaaaaaaaaaggttgaatagtcttttcaagtgtcatttgccatcctaaatacttggtttttcttatttctctccctggtgaccaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtatctcacactcatacagcccagcccccaggagatacttgagtggccctcagggaactaaagggaagggaaggatgggaatgcttctgctcttgagttggtttcccgatgctgtcttcttgcaggacggggtgtgttggagggactgacttgcagcatgaggcctgtgtggcagcatctgcctgtgtgcccgtgaagagtagtctgccatctccggcactactgctgtgggttcccagcctcttagagtttccaaactaagcgtggctc

SEQ ID NO: 65104 - DNA, 1036 bp, Homo sapiens
tgtaccctctctgtcttgtttgagtcttgtcttccaggagggaattacttcccatctggtctctccaaaatcttccccttgacttcagacttactaactttgtgtttccatatctgtctcttgtggagatctgcatggcactagacccttggagatctttcttccctctgtcttgtttgagtcttgtcttccaggagggaattacttcccatctggtctctccaaaatcttccccttgacttcagacttactaactttgtgtttccatatctgtctcttgtggagatctgcatggcactagacccttggagatctttcttccctctgttttcttttacacatccttgccatccagatgttaagactggagattctatgctttgatgaagatcgttttttctacttcttgttttcaactaccaattcggtctccctcccatttatgtggccttgatgatggggactttccctatagcctctccattgcacagggatgctgttagacagccaggagcagccctttccagagcccttcagttgcctgccagtgcttcccatcaagcttccctctttccccatttgaagaatgcagccagcttccagtcgctttcagatcagggactcagatgtaactaagacaacacttcgatgttccttccaaattatcagtttctctcctacacacacacacacacacacacacacacacacacacacaatttatagcatgcgctctcagcttagcatattataagcatttcctcacgatatcaagaactgttcccaaataagatgtgttatgattgcataatatttcagtgtgtgaatgaatcatatcttactttctcacaatatataatattttaaatatttactaatactacagaagataattttaaaaatcagtggaggtgaagactggtaaggaaacacttactgtcataagtttaatatcaaagtttgtcttaccttgactaacataccagctgcaattttccaatcacctgtttttttcccttgtagtccacggcaatac

SEQ ID NO: 65105 - DNA, 1050 bp, Homo sapiens
aaacatgaaaagagatttgataccttccctttagggggtcttgtagaaagcctgaaattcccagacaaaataattccattacaaggtaggctgaggtaagtactgtaagagatgtcagacagtgtgccgtggtgtgtttacatagtacactagggcctaaagagacccatttgcaggaagtcacgttgttagctgtctaagggaagactttgacattgaccttgaacattttcagaaggccaacagtggtggcattgaagcaatactgaagagtagaaatattaatacaaaacattgcagccatttaaacttttcaagttttacaggtgtgagctgttgtcttttggcatttttgtgtcaagatgcctcagtattgcttggcgtcaacccttgtagaaactttgtggtctgtagggatcaaagttagtggatcagcaaaactagtttgtaatctcttgcctctttgtgttcctgcaggaggctactttctgtgtggttcttcgtggagctcggctgggccaggcagtattgagcgatgtgttacaagctggctgtgtcccggttgtcattgcagactcctatattttgcctttctctgaagttcttgactggaagaggtgggtagtacctcctagtaaactctacattagtggttctgcgtatattacaaataaaatctcctcaggtcattgtaatgtataccctggttcaagaactactacagatagtttttctctattttccattaggagagttagtacactggtctagagcagttcacaaaccaaggccagtttgcaggctggctgtttttgtaagtcaagttttattgaaacacagccgtgtcccttcctttacgtatagtctggctgttattgtgtcacattggtagagttaagtaattgcaacagaaattggatgacatacagggcttaaaatatcactatctggcctttcatcacaggggtccccaactcccgggctgtggcctgtttggagccgggctgcacagcaggaggtgaccagcgggccagtgaacattaccatctg

SEQ ID NO: 65106 - DNA, 1073 bp, Homo sapiens
tgtgagctaatgattaactagttaatttattgaatccctaatgttttttggtggggggagagattataggagataataaaaaaaatctttgatccccattcacaaagggcttgtgttggggatatatgggtataagcataaagaaagttgagaagatgatgccgatatttctaggtacattatgggtcattaagggtctgaaatggaagggagaaagttggggctaaagctgtcaggatgaatttcttggagatgtagaatctgaggtaggccttgagatgggagttccatcagccatctttcttatgttggaaggcaggcagaagtatgcagctaaatatttttctgtagtcaaatggaacattcatattcccagtctcccctgaatcacaaagaaaaagtacacaatctgggatctcagaaggctggatagacactagactgtatcgttagaaatgtttgtatggatagggaggaaggtgtaaatggatccccagtttatctgttgagtagaatttccaaacattcttttattggtcagtggctccaccagcagtgacctctaacctcagccacactaggaggtggaagtcaggagcctgacttgcctttgaactcttctttgtactcaattgactagaagcctttgaggtggcagaaacattcagcatcttcttttctctctagcctttaacacttggggtacattaaaataccagtttcttttcagtctattacactgatccatctcaatgtgccttcatatttttctattaagcaaaccaaatattggtgctgcagagaagtacttgaagatgtagtgggctgattaggaaaaagacaaaacaattttatttaagaaaataaaacctctagactatagttgggcctagtagtgatcaagaagagagtagaagaggctacagaacagtaaatgtgtgcatacaccgaagttcctgtactttataggagagcccctatcaggggcctcttattttatcctacttgcatacaatttcaacacatttgaattatttggtttccatagccgtagtagtttggaagagacacat

SEQ ID NO: 65107 - DNA, 1025 bp, Homo sapiens
gtaggtgtggatcttggtcagtaaatcaaggggtggtctggggttttcagagatacactcttagggtctccagccatgcacagagcttgctcagactggagaaggagaggtgagagttcagagtcatattttggctagatgcagctgccttagtttaatgtaaaaaaaaaaaaaaaaaggcctacgtgtgtcgatgattatgacagtgagaggtggccttgcagagtattcatgtcactagatgctttgtcactcttatctgtaaaactagggtgatgacattatccacgttgcaccacaccctcagaacctgaaaaagtttgacacagtaaaacttggaaataatgttaaagtaatacacctgtctaaactggagagattgaccttttgttttgaaaggaattctttttgaaaggaatttatcaccaagttaaggttctttattaggggaagtgtgcatgtttttatattaattttcttagctgttcatgttaaggctgcctatatttttatgccttttcagtctcttcatgcttttatttttctctcctttttgcaaatatcagcaaagctttgtcatctccctaaatatcctatattacttctaacttttatgtcatttctggtcttgcctcttggcagaccttcatccgcacatctggggctagcctctatagctagggttctccttggacaccctcctcattttacttctgtttctctgccagatgtgaacatatgtaggaggacagagacagagacaagtgagcttcaaacagtgaattcatgtgtcaccaaagctatgtcctctcagtgacagctttttaaaaactaaatgtaatatagtctgaaaattatgtagagtggagtgttttcccatgttatttttctatgatgtgatttaaaagattatactgcatcttatcaatgttataattttatttacatttttgatagatggttttttttccaagtttgctatcataggtaacactaataaagataccccagatttttttcctttc

SEQ ID NO: 65108 - DNA, 1060 bp, Homo sapiens
atatggcagtggtttttgtttttttatttttgtctttttaaaaaattcactgtgctgcttctgttaatcctttgcaatctgaaaattcatgcctcttatatcttaacgtactgagaacttctttaatttctttgatagatttacttctcccatagtctgtgttttcttttctggaatctcctattaaatagatgttggaccttctagattttctcattttctctgtccttatttttcatctctgcctttttgttcaccagtctggaatattttgtcatctttatcttgcaatcctgaccttttttcccccgactgacaggaccaaccaggtagcaatcctgccctcaaaaaataatttaaactattatatttttaatgttgaagagttgtttctgttctttggtagagcttttaaaataaaaatagcaatttattcttgtttcatggatgaagaatcttatctgccagtggctacaatttgttgttgatgctgtttgaatttccttctgctgcttctgttgtttctgttacttctaagttcctttttttctttattcatttggtttctgacattcatgctgaagatgctcttgaaatgcctgtgattctagaatctgctcatgattgagagggaagcgctgaaaagctgatcggaagttctttgtgtgaaggccagcttgttgcctggaggacttcactgtaagatgttggggtgccgagctaaccacatggctaccaatgctttgggaactaaaggggaaagaaggctgtagggcccaccattcagaatgtagatttttagcctgtattttcctctcctctgtgcctgtatttccctgtctagagcttcagtttccttggagaggaaacctcccttctctagctggggtgagggaagagtcgtttttctggctgagtaggatcaagggagggtttgtgaatctgggcctctaactgctccttaaacagatttttaacagtcttcctgttttcaaccttaccgcttctcttacctcacaaggtatctgtgagtttcattcctgaaccctgtgaattccca

SEQ ID NO: 65109 - DNA, 1050 bp, Homo sapiens
tcgtaataggcccatcagctgttgtctcttctcccatctctttgtccttgtagatttatattcttttatattcatcaactgcctttttattgggtttggggagagaatggagataaacgcatgctttaatctgtcatgtttaactagaattcttttctcagctgcaaaagttctcagctccttttccagtgatatcagaaccaaacttaattagtccatgcaaattttgaggaggggaagactttgagcagttgcttagctctgggatctgtcctggtaaaagccaccaagcctgccatgtttgggtttgctgacgatattgggtcagccatattgttacagctgcttttctgacccgtgttaatctgtcctcttgtagaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaaggtaagaagccttagtgcctctctcagctggatcaattttggatggccaaattattcacatcctttgttttaaataaattttcctgctttgtcaatagcaataccatttctgagacagcatgcctccatttttctcagtcatctcattcttgttctagggtggcccatttaactccaagccctggcatactctgtagccacaagtgtttgagggcttaggaatcaacaggatcaaaggctatcagccttaggaaaacagatctcagcttccctcagccatctcagctgatttgtttacatgaaaactcagtttaaaaggcattagttttctcctttcttatctctgctctgatgctgtactttctcaaaaaaaaaaaagggatggcctcacttctgattggaaaagtcagcagcaaagcataccctgtccagacttcaagtcaggtccttaaagagagcaatcactagaagttcccattggt

SEQ ID NO: 65110 - DNA, 1023 bp, Homo sapiens
tttattgcctgacagtagtatctgcactttttatggctagtctcttttaattggatatactgaagtcgggaaagtcaaccttgaaaattgccagtagtagatctatagtctaggctggaagaagtccatatttctggctctgttaggcaaatcagaatttgccttgagaaaattctttagtttctcctttacttcatgggatgtttgttctctgagagaatcatatgctttctttttagatttagggagccacagtttgagtaaataaaacagctattttaaatgaaggtcctgtattattccctgatttttaaaaattaactttctatgccaagatttgttttctctttctcaacactataacatggccagttttctggatttttgttttgtttgatacttaataagggagaaggaaagggaggggtaaaagaaaaaggaagatgtgggcatcatttaagaagggaggatgagaatacagaaaggaaggaaaagagagacaattataaggaactatgtaaagaaggaaattgttgacttggatttcttcataccaattgcctttctccagagtgaagtgaattggatggtattgcattgctaattagtcccttcgtttataaaggatgggctatgtttgcagaaggaaggctgggcctctcattgggtctggagtggcctgttgtgtcttgcagtagtcacaggcctgtatttgctcctgcatggaaaggccaccagctttcagagagactctcagcctgctcctgcaatcctgcctgaaaggcagagttgcaaattctagtgctaaatgcaaaagaggcttctccttattactcctggttagccactttaggcataaggtgagttatttattgtgaatttgtgtcacttctttggggaaggtatcattgcaaactgtgagaaaggatacatttttttttccttcttgatctaagcctctacactggcacaactaaaggcagtagcaggagcccagattttggagttgggtgttcagtttta

SEQ ID NO: 65111 - DNA, 1076 bp, Homo sapiens
ccatttagttgtaggaaaatcatcatgtgttgtcagttctttgatttgggatcatatagaagaactagatctttgtcagggactcagagagacagaaaagtaaatctatttttttgaaaaaactaatgggaaagaaaaatcctcttttctttttcacatatgtttttctttcctacctcattctcccttctccttctactgctccagtcctaatttttttaaaggttacctttccagaatcaaaattccatatcaggattatctaaaggcaggatataattttaatgcttattctttgattgctaccctctcatttctggcctccacgaaagggatactgtcagaagcctgagagaatggtacttctctttcatggaggccatttaatttgacaaagggaaaacatgaaactgagaattctatttagagttctgcctggtggtagctgatcactgaaatggagatgccttttgccaaagccgacttttggctactcagacctaacttgcaacagggaaaagtaaccatgtatcttaaaaagccatgattcattctatatttctacctgcaccccatatcatcctcctgggtcttcattgttctctaaaacttccccttcaaagactttacagaggcaagttagttctttgtggacatggtctcaagtaattctttggacatatatagatgaacagtgcggaaagctgtctatgggttgaatatgctatacacattcgccaattgtaagtccagattccatccagtatagaggtacgttcatacttaatcaaagtagctagcctagtttctctacatagtggaaagaggagctgcttgttgccttgtggaattaacatgaccaaagttccatgttcttttgttttattagtgtgtgagagtttagaggattcatggcagggatcttgcttctctcaaagtggatatggaaggcctgggccaggggtataccactgggttgtcagggtgatgtaccagatctcaactgtaccactttgacactgctacctagggttcaaaaaatgctctggttctgtaggtagacacagactttccag

SEQ ID NO: 65112 - DNA, 2571 bp, Homo sapiens
catctttactgggtcttagggagcacagaattagaaaacccacgacctgatcctgacccatctcttcctcctcctcccatcccctcaaactctcatctctccttcccttcttattatctcccaagagattcattgcctcatgaaaaatagtatttggggttaatctttcatttagctgctttttgcttgtgtttccttctctgcctcagagcctcacagattacgaggttccagtaggccctcagatgtcagatgtggagtctcactagtttgctgcacagctgactggagttctttcttttaatggtgtgagcatatggctttctttgctagatggaaaccacattcacaaagagcctgtagcttttagaaatgaagactgatgggagcaaagggttttttcgtgttccctgcctcctctccctacctggttctattctgaatctggtcattcagcaggcacctgtgaccctcttcatatctgccactggcaccacagagctgaagaacattgaccctgaatgtcgtttttgacatcataatctgacttctttgttttcaggtgaggggctgagcttggggacaataaggtgctttttagaattagcatagtaggaagtcagatgacttcatgaatagaagattggactgggagttcgggccaatttagacttgacccagcactgtaaccttgggagaaccatgtctctccaggtctcagttttctcatctgtgcaatgagggaactggaccaagtcacctctgccttctacatgatctctgaggttgcagatctctgagatagcttggacagtggtcatcagctccaactgccaaagtgtgagtcttcttattatccacagaaggctcatggttatgctgtccagtgagctggtacagatacaaggatgaggcacatgtttaaagacactttctttggcagtatcttcctagtagtggtaattattgaaagatttaatggcacagatttttttatcaactatggccaaccccagtctgtctctttgccatcttcatggcacctggccttaaaaaataacttgcaaagaatggagatcaggtgccccagtaccaaggtaccaacctctagccagactggagcaaatgggaatgctgcccaaaccccagaagcctgcccatgtaattggttttcctgcgtggcttattttaagcaagctcctgcctggggttgggaaggtctctcggacagactaaagtgatctcacaggtaaatcttaatccataatgcagtttgtccatgtgtttgtcaaaactagtcagcattagggaactctacatgacaacttctgggctccttggctgtagatggctagtatcagcattgaattgtgtcccaggagtgaatgaaggctccttggcttttctcaaagcacatccttgacaaaaactgccaactaccactgtagttaaaagcataagctgaaaatgaaggcagtcagtccctccattccacttcatttcaggaaattccaaaaataaaaggtgagctttgttcccagagggctgagagtgaatcctataactggctcctctgtggaaaccagctcggaattggaagccagccagctgcccctttcccatctgggcagcatgcaagacgaagcctgaagggaagaagggccactaattcaaagatgcttttgcatattggattccttgtgctctgtcttggctgacccagccatgtgacagcaaggtttgagctggttcatagagctctgttgcactttaatggttaaggattgaccaaactcaggcagtgtgtgcaaggaaggaaatgaagccattgccaaatttgatgtgccttggatctatagactgcacccccaattccatttctctcactacttcttagtctgtctcttggttcatgagtcctgatacattgctcacccagtagcaatatccctgtggaactgtgcctttgacagtgtgatgactgtagaagccacttcagagtggcttttctcctagtgctggcccgtgatttcataactgaacgtcccagatgggcaccacctgttgttacaccttcccccttctccccctagtctgtttccggaatctgactgcggttagcacacaccctgagtttaaaatgcactctctaagctggcttagaaggtagtgcattaacttctttttaggaccatttattgggtacttctatgtgtatggcattttaaacaaagttagataatgcagcccatgctgtttagaaacttacaacttgaaacagatcacaattggtgggttagttccctgggaacaggtcagtgaggaggaagataaaaaatctcagctgttaaaggacatcagaattcacttaatccaatcccttattttatagatggcaaaatggaagcaagacaccttgaataggtcagttgcacaatgcactagtggcagagcttcctggacctactttaaccatgtgcctctggtccactttctataggatgtgagactcaatctaggctgccccctgtgggcttttacacaaaggtagaagatatttgtttgatccta

SEQ ID NO: 65113 - DNA, 1084 bp, Homo sapiens
aattattatggctgcaaaagtggggcttgtaaagaagaatccctagggaaagcgatttgaacttttcttagcatggaggagagagctgtgttgactcaaagtaaacagggggagaaaagcaacttccatcttcagcagaagtgccaactgaattggatgccccctccccatgccctactccttttctttcactttggcatccctggtgtttagttatgtgtgcttggggcccttcggaaatctctttaaccccatgaatcagtgatcatggcattggtgtgacttgaacaggcaggtgcttggtgctgagaaaaggaagctggcagcacatttcatggcatctgcccaggcccacaaaacaaacagaagttatggctcacatactgtgttgctgctctgggctctataaaactgtaatagtatcatattattttaatctgctgaaatacaaatcccagagtagagagaacacagcagcagcattacacgtctgagaaaatgtttgacatggattcatttgtctgcagctattatgacgatgcctgcggtcgattagctctgttggttacaacacagtgttaatgaagccaaggttgtgggtttgagagccctgttaggtgagctggtttcacacaaatgaaagctcttttcatgatcccagaccacgcccaagacctaggtcagacattccataaaaacacggagatggtcacagtgaggactgggcaagacagtgcagtgtctcaccaaaaatgcccctttacctgcttctggaaaaacaagtcacaacatgtgctttagtggggaattaggactgtggtcttcacacagaatggatatcacgttattattcatggtaactgctggtcagtactgctgcaggcttccttcctgaattaaggaatatactggctctggtaaatattttctctgaagaaaagagaaggatttttggtccccttcattcttggctttttactcactgagattctgcccattcgtgtgttagacaactgtgtgtggaatgttgttgcataccaggcactgttctttgtgcgtggaataccacagtgtataaaacagt

SEQ ID NO: 65114 - DNA, 1034 bp, Homo sapiens
agtagctgggactacaggtgcacgccgccatgtccggctaattttttttttgtattttagtagagacggcatttcaccatgttgcccaggctggtcttgaactcctgagctcaggcagtccacccgcttcggcctcccaaagtgctaagattacaggtgtgagccactgtgcctggccccaaatttgctttttaacatgcttcaacatgtttttagctgtggctgcttactctggacagtaatgcccagtgtctctatgcttcttagcctagacttagttatctagctttctttcccttccatctcttcactgtttatttatcttcactaggttgggatagcagcttcccctgagtttgctagggagatcgctagttaaggtttgagagtgtagtggggagtcagggaaaaagattcagagtatgagggacgattcaatttttttcttgactcaagggaattgcaaaatagcttggcatcctcaagagcatggtgctgctcatagcatttgccattagctggaaagaggagaaagagcgcctgttggaactaaggttacggtgaaagttatgggaagctgtatttcatcgcccttatggctacaagaacaaatggtgtttatacaaggaccttggcagtgagaaaacagtcattaaacaggaattaaggagcttgtcatcaccacttctttccagttacagaaggcaaaagccctccaagccttttttattgggcccttgtgagttctgccgttggctgagccagacagagttgaatggaggaatggcgaggtgtgtgtgtgtgtgtgtgcacgcgcatgcaacatctcagcttacaacacaaaagaatgcagtgtggtgtcacaagcatgattttattgtccttgacactgacagccaggtatgtttttgtcctcctctggcaggtaaccccacgaaagaaattcaagtgtcctgagtgcacagccatagatgggctttcactagaccaaacacacatggtggagaggtaagtgagcctccaaccaaaagtgc

SEQ ID NO: 65115 - DNA, 2611 bp, Homo sapiens
ataagtacatttgtatcatctaattaagacttttgcctcagaagccagaatgcctgctttggctctagctttttctagttatttgacctttgaacatgttatttatcctctctgtatctcagtcttcccattataaaatgggaatgatagtcctaccccatagggttgttgtgaggattaaatgcattattaatgcatagaaagcaattttaacacagcttggaacatacagtaaatggtagttgttgctttgtggtgttggtggacatgatgatgttatgagttaaaagctcaaaatgaaataataacaaatttttttagaaacataatgaccaagagagaagtttgttctttttgtagtgctctcagatgtcctgggcccgactgaggcaagagtgttgacctttctgaaatccatccttgaggtccccttgacttcaaaagcagcttttccaggcgttttccctctggcctaatgctgaagcgtcctcattacccagctgtcacactcagttggcctgattgaccagagccattcccgaacacatgcctgacctgctcacctctgagaaggctgactttgggggtgaggtggagatagggagacagcctctcccctcctctggcggtgctgtgctgcactggcactgaagtagttgttgctaaaagttctgacatgggagtgacaaaaatgatgaaaattatgaaggctgtcctatgtgaacttcagctttcacagaagattgtgcagattgacataattcccagaaattgccacttacaggccctctgtcaatgttggttgaatgaatgaagtgtttattgtttgaaatttggccctgtcacctttttttttttttttttttttttttgcctttcatcattttgtgagcaagatctctcctctgccttttaaacttcagtaaactgaagctcagatccaagtagttttttttctttccatcctttgccttctcttagctggcagagatggggttaagaattgttggcagctaatccaccttggtttgaggccctctcacactgagctggaggaatgactggaatttgagggggaggggaaaagatactctgacctttgcaggcccgtggcctccaagcagcatctcctgttcacgttctcccactgaactaatagtccaagtacccccagttcaccgcttttttccacacctgtcaacctttttaagaacctgggagcagactgtggctacttgagctttttttgttgatgttgaacattatgtattttgctgttatctctcaacctcttgaacatactatcttttctccctgcccccatccttctcattctgctcaaacccctcctccccacctcctctccaaatcccacaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacag

SEQ ID NO: 65116 - DNA, 1007 bp, Homo sapiens
ccctccgcccaacccaggaggcctttctgtgtccacgaccctgagcatagtgggcctggccctactccatgacaggaatcaagggagaaggtagaaaaggcgagcgcttcaatgcggggcgctgcctgctggagggaccccccacctggggtctgacaggcctgcctctggacggttactgtgtactcccagctgaggtgagggctggggctcagggccagacccaagctacaggggtcgggcaggcaggcacagagccccgcttcctggaggcaggaagcctggtttcaggagggcatcctgacagccccatttgcaatagcaaagccacaccgaggagcccaggccaggagcccttccgcaggctggagagagggcagagagtcctggtccctgtggaagaagtgtaaggacggagtgtggaaagctgtgtggagaagagcaacacctcctagtgcctggagggacacagagcccccatctgccgtggaaggctctgggcagcgatgacactgacagatatggcagggaggacagtcagtttgaggccatagcagggcctggaggccgagcatggccacacgtcctctagcaaagcctgcacgcagcttttgaccctctgccacccggcccccaagctctagcttatgtgttccgaagttgtgagtccttccatgccgggacactgctgagcagccccagggaggggccagggtagggcagggaagagacgagcccctccgcatcctcctggagggaacctgactgggctctggatggagaacaaagctgcccagacctccccgctgtaccagatgccaggcaggccggagagcgggaggactgcccgggcccacgccccacccggatgcctccccctctcccaggacctttccttcttctagcaccatgggagcccttgtggcatctgtgttctcagcctccctcaggtctggctcctcccctatagtgtccagtgaggggctggcccgtgtctcccctgggga

SEQ ID NO: 65117 - DNA, 1110 bp, Homo sapiens
cctagacaatcacacacagttttgccacagttttccaaaaggttcatggctctctaaggcttattggtccagattcacaatgccttcctccctgcatcctgtctgcagccttcttgttggagacagtctcccagctcagaactcccctgtgttaaagggagaacaggggctctgctgggcaacagaggcagtcagggaagacttcctggaggagggacaggagctgggccttgaatggttggctgaaaggaggaaagccaaggcctaggtttagaaacagcaaggcatactccaaaaacctaaagaggtcaatttgaaggaagcggtgggagagaaagaaacagagtcagatcgcagggggccttgactgccaagtgaagggtttttcccttggtgctgtctgtagaggcagttgctataaaatcttgtgtagaagcgtggcctgatggtgagaggaagtggaggccaacccgtcactgagcacaagtggatgggatgttggcctgattgggagcccaacgggggaggggaggtctctgagtcagctgtgagcactggggtttttggtgacggggagtattgggtccttttcctttgcacgagcatttctggaaggctgagaactttcccaaggctcaagagcaagagctgccctacccctggcccatgacttaggatctggagaaggggtgatggggacggggtgggtgagagagggagagtgaggagggatcagcttccaggccaggaatggctttaggctgattcagagatggaccgtggtgctcctcagagggaggcctctgccagcttgatgtgcacttgtctgctggctttgcagactcagatgcaagtgggcacacctcagacagcacgctgcagaccgggagaacagagccatgacaatagcctcagctgcagagccataaggagccttgccaggcccttccaggcccaggcatcaagaaagccaactttcctgaggtccagtccctgctctccaggtggaaacatttctccatccatcacgaccaatgcagctgctgagctaaatataggagtcagctctcaaaattcctctgcctcagagcctttgagcttcctaggaac

SEQ ID NO: 65118 - DNA, 1091 bp, Homo sapiens
tctcccggtctgaatgtcatacctcaggaccaccccagcctgggcccactcagcacaggcctctcccgaggaccgggctgtgcaaggaaccaactgtcttggcggaggcctcgctaaccgcagcccatctggggccagggcggggtggcccagggcggggaggcctctgtcttattgtcttcagacaccagctgcagagattggaatcccagacagcagagagaggcccctgcagccccctggagcagggccaaaccctaggcttcttcccaggaaaagtccatcttggggcccccattgccccgtccctgtccccaccaccactctacgccaggcacctggcttgccaccagctgagtatgggccctgaacaaacacagcagaggcaggcagggggttccatcaccacccccttacccccccagggcactgccaggcttagggctcaacccagaggtctgacgcacatgaagatcccacccaccctgctgcctttatacaaagaaaagcctctgaacaatctggcatgtgtccttgtacagcaaactaaagtcaaagaagcactaggctgcgactcaggagtcccggattccagtcgcagtgctgctactgagtggctgctgttaacttcaggttatgacttcccacctatgggcctcttcttcctcgtctatcaaatgggaagatggggtgatcatttccagcactaccgttctatagttctgtggtcctcccactaggtgataagatatgcagcacgtcagagtttccctttctgccttggctgccaggaagctccaagttgaagtttgtgctcaatggcaaccatgaaccttagcctaaatttttttttaccacattacctctgcatttcatgccattgttcttgtttttagattgaacaaataaatctttaattgtaagctacctcaactccattttggaagtaggtataagtgtgtgtgtgtgcgcgcgcatgtgtgtgtgcagagaacactctgttttagttgtatggtggcaactgaaaaatgctctgtgcgcctttgttttcatgttttgtactcaaggcgtcattcttctttcagtactta

SEQ ID NO: 65119 - DNA, 1035 bp, Homo sapiens
ccacacctatgcttggtactttgcctgcctcatcccatttagtccttgtgatagccctgtgagttggggattttaattatccccatttacagatgaggaaactgaggctagttccttgatggaggttgctcagctggtaggcggcagggctgggattgtaacccagtagcctgactttaaaccctgcactgtgaactgtctgccgtccattctccttgtgccctgcacacctgcgctccttcaacttgaacttccttcctactctgctttgtatttttgctggtcctggttttgatttttctgctgtacttgtagtttatgatggttcggctgggaccaggggcctggaagtggcatatctcagtctctgtcctggggaggtcctccctctgccaggagggcagcctgcctagggtgagccgtgagcacaagcagtctgtcccctgccttgcccaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggaggtgtgcggggggctgcggatcgggggcggggctccgagggcgttgggggccatctgggctactgctcagcaattccttcctgcatttagttccttcccttaattcatctgtcatttgtaccttcatctacttctttgttaatgtatttattcaaggaacaggcagagccctctgtaggggcttccgggctgggactggggggctctcggtggttctgcatggcggggtgggatggtgcagagcggggtgatgtgaccgcattctgcccttgcagggctgcatggagaaggtgcaggcgtggctgcaggagaacctgggcatcatcctcggcgtgggcgtgggtgtggccatcatcgaggtctgagccccctcccc

SEQ ID NO: 65120 - DNA, 1028 bp, Homo sapiens
cagctccaagatggtggggacagtggagggacccatgtttggggagagtcatggcggaggcatggggcacaagtgagtctttcactcactacccattgattgagggcctgacacattccagtccctactaggtgttaaaagttattcactggtctatgaaaccaagtttctgtcctctaggaattcagcctagtaagaaaagggagtgtatgcagaccacaacacaagtgagtgttcgtggatgtaaacagggcaggagcaaaattcacacaggcagataaggcttttcagaagacaagtcgacagagaagccaagaaaggatttactgaggtggccttgaaggactggggctgggaagatgacattttgggtggagggacagcatttgccagtgcttagatgtgggaaagcatgggttgggggggcattttttcagcaaagaaggtatcctcccttcgggtggggattctgggaacatgtacaggagtagggaaacattaaatcagagagggaggttgaggccagagtacagaagttcttgaatgctgaatttggatttaattgttctgtcattaggagtctgaaggttttggaccaggccagtggtctggagatatggctctgagagagggtagaggagggattgaagaagtgagagactggaacaagttgtctactgcaaggatccaaggagtagaagctgccgccctggagtggagcaggggacactggggtggagacgaggggctgatgcaggaggtagcaggacaactctataggactttggaatgaattggatggggcaagaacagaaatgctctgagtctctgtgtatttgagctgagatgcttagattattgaggctactaagaaaaatggtgggaactcaaaggatagaggaaaagctagtgagaggggccagagagatgataaactcagcttagggcaaaaatgttatgattcttactccgtcagccttccaacatgaaaaccccattccagcagtattctctcagcacttggatgg

SEQ ID NO: 65121 - DNA, 1049 bp, Homo sapiens
caacacttcattgagcacttactgtgtgcctgggcctctgagaggcacgtggggtcctattggataggatgctcagggtccctgctctcggcagctcaggtcttcaggctgaggccttggggaaaatcccaccccagcttcccatggcacccgaagctttgttcaaccctcccttgccatcttgggcctaaggcctgggtgaaatgccagagcatccactaaaatggactggtccagtgttgcacatggaccttatggggtggattgccaagtcccagttcagcatcaggaaaactaagtgtttcacggggaagatgggcttgccctgggtgccaatggcaaggtcctgtttcatttttcacccccctttgatgcttctttggatcctgaactgcaaagggttttgattatttctggaggacgccaagcctgtacatggaaggtgctgggggtccagtctgcccctgtgtttgcctggcggtctccttgtgggtatctcaccctctctggtctctggcagccagcagagcctgccatgtggggcatcagccagaggttggtgaatggatggatgggtggaaggatcacagtggatttactggaatcggtgttgtcccagcctcagccggggtggttggacataccaatctcttggcttgtttttctgtgacaatttgattttggctcccgtggaatataaggaattttcaagtagtggaatggactcaaaacaaatggcttttgagctgattaagtttctcagtttgatttcagggaggcagcctggtgtgtaccctgatttaaggacagagcttgcaaacgccagctctgaggctgggtgaccttgggcgtgttattgagtctctctcaaattctcaactctcatctagaaaatggtagcactaatggcatcatagggctgcgatgagctttaaattaaataatgagtgttaaaacagttgcagagctctgggcacgtggtaaatgctcaagaaaggatgatgatggtgtatttaatgaacacccttaagctatttgttgcatcttct

SEQ ID NO: 65122 - DNA, 2334 bp, Homo sapiens
gagcaaagtcagggagacggccacaccagcgctccgggctaggggggcagcgctgggacacatcccctcctctgaccctgtggccttgctggactctctcccacagtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggct

SEQ ID NO: 65123 - DNA, 1051 bp, Homo sapiens
cccctgccccaggcttggacagaccctccccttttctaaacctcatttgccccatgaatccaggctcctttcctccccatccccccaggaagcttggatgtggccgccatccagacccaaatgccctctcctgggccctatgcctccagggctggctctaaggcaccatgcaacctgtcagatggggtgtgctgtgtccacctacagcagaccagctcccagagcctcaggggcctggagagcatttcctcaacccatttgacaaggaagccagctgtactccccctactgccctgggctcgtggggaggcctcagcaggcctggtgtggggtgtggccttccgctagtcaggccccttcccctagggtctggaagctgggtaggaactgtggcctgaggccggtgtctcccctcagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaaggtggggtgcagagcaggggcctccggcacccactggggaggccaggctgacccaccattaggggagaaggttagcccaggcccaggtagccgcaggagttctaggacttagctgattttcctagaaatgtaacagcaatgccaggggaataacgagatcattagaattaagtgcctattacgtgcccggttttccagcagttgctttttaaatcttcttgttggcactagaagatgcagatactgtaaaatcattcacccattttatagatgaggaaacaaaggctcagagaggttaggcaacttgcccaaggccacaccggtaagtggcaggaccaggcttcaagtctgcatttggcagagccctgagctttcatacgtcaccatcatattttcagcttcttttaaatcctagtgtcaaggggaagcaggagagggggtggcctcatgtgaccctccccacctgggggaacct

SEQ ID NO: 65124 - DNA, 1035 bp, Homo sapiens
ctgctcaatgacaggagccagcctcaaaaggttctacgctttatcattccacttacatggcatatttgaaaacacaaaagccatagtgtcagagaatagatcagtggttgccagggtggaggtgtgaggggagggagtggccagcgccagggagtttttggggtgatggaactgctcgttgtcttgatctggagctggtggctacaaaaatctatacgtgtgctaacattcaaataactgcacaactgaagcccgtcaattttgctgtatgtattaaaagataaaaggccatggggaggctggaagaggaagggcgtgggccaggcaacatccttggctgaggaacaggtgaaggacccggttctcaccagtggcttagtgactttcagggcagcctcgcctggccacgggagggacgtggctaattgtagcttctatctgggttcaccagaaggcagtggctagcagctgaggtgtcaggacggcgtcctgggccctccaggagccgggtgatgaaaggttaggccctggcttccctggcagggtagggttggcctcctgtcctgatggctggcacacaccgaagcattaaccgggagtctcttgtgtgccgggtgtgggactgccgtcacagttaccacccgccgctgtctcctttcaccatggggcctgtgtgtggggaggagaaaggcgtatccactcctttttgtggatgaggaactaaagccagggggcgtaggagggtagtttggcctggaaatgacatcacactcactaaagaccgccaatagcaacttttgcagttttttttcccaatgcgacatggtatactgcctccctagttgatccggtctacagccacattattcacagaccccacagtttgaaactgtgttctgatatttgttcgggtgctttattttaagacaccaggaggctcaaaaatgggaggtgacccggggacatccccgcactctgcctctggcagccctggctggggcaggagggtgagatttgcctggggccacagggcac

SEQ ID NO: 65125 - DNA, 1050 bp, Homo sapiens
tctcccctgcgcgctctcccctcgccgcccctccctctgactcggtttcccctctcccccggctccgcggtcgccctcctcctggactgcttatttcgtcctcggccactgcctctcgggctcgagctttctgcttcagagcaggagagaaacggagcgaaagcagtttctgtctccccggggtctgactcggtcccccgcgctcggttctctgtcccctccccctcccgccattgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggtgagtgtctggagcggggacatcagggacagattgcagggggaggggcgaggctgagagagtcccccgtccccaggctggaaaggggcgggcagaaacccaggccgcgccttagcccagttagggggtgggtaggggacgcacaggtggagacgccccccactctccccaaagtcgcgcgatctgcaggaagggtacagtgtggggccactggccgggcgctgggtgggttagggcccctgccgtgggcagaacactcgcacctacccgggggaggctgtgtggaggaagggccagaacgccgcgcccaccccggcgcgccccgctgggcggggcggggcggggcgctcgccttgggtcccctcgctctaccttccttcgccctgacccagtctcgggcttccgcctcttcctggagcccggggggagtgggtttctccgccggagagatggaggctggggcaagagcagcgcggaggccaagaacccccaggctcctccaaagcccagagcggctggccaaggccccctcaccgccccactaccctgcacttcctgattggtttctttcaaacaaacttc

SEQ ID NO: 65126 - DNA, 1102 bp, Homo sapiens
tcactgagcaagtaaatatggaaccgcccccacaatgtcagctttcccggagtggcttctcccactatctctcactttccccaagggaaaggggtgagggccaggaaaggatctggctgcccgatgccaggggatggagatggccggcttgggaggctccacgatggccaaggggcatggggaggagcccaccagaccctcagccccagaaggaagtgagcttctcttgggagcagccaactgggacccagccagggcggactcagcaccgtcatggcccaaggtacagagagggcgggctctgggggttgccgggaggtggttggctggggcttgtccctgacctcacagccctttactgttccaacccaaacagagtgtcattttcccaggggccaggggtgcccctctttaggccggctgtgttccaagagaaagaaagaccagccagagggggtttgcatttggagagggggtgcaggggtgcctcaaggaggggtggagagggaggaaggaaaagccccttagcctgagggaggcagagggcagggaggtgaagtcctcaagggaaatcagcaagcttagcagccagggaaaccggcagtctctcttgaccccagagaggagatattgggtctccagaagagcaagcagaaaaggaggatccagggcagagtgtctggctgccagaccctgggccttttataaacatcagcgacagccgagcccaaatgagtgtggacgggcatgttccattcaaccctcatagctgtcccatgatgctagtgttattaggtgcagtttacagaggtaacattgaggcccagagaagtgaggtgactcacctaaggtcacacagctatgaaaggctgagccaggatatgaacctaggtctgtctgattccagagtctgagctctttatcacagcatgggactggcttgctgggactgcagtgggagataaggtcagccatccatgctgggcaggagtttggatggctaacttacagattccaagttccttcccctgagatgatgggcagtgtaaagaaagtacagcatatgagccactgtggctcaggcaggtcaccctctctgtgc

SEQ ID NO: 65127 - DNA, 1054 bp, Homo sapiens
tcaacatgcctcattaactaggtctccagagtctttttaagcagtaaaaagaaggaaattctgccatttgcaacaacatgggtaaacctggagtacattatgctaagtgaagtaagccagacacgggacaaatactacctgataccagttataggaggaatctgaaatagtcaaattcatagagacagagagtagaatggtggtttccagtggctgggaaagagggaaatagggaaatattagtccaagggtataaagtttcagttatgcaagatgagtaagtcccagagatctactgtacagcatagagcctatagtttactgtattgcatgcttaaaaatttgctaaaagggtagatcttatgttaagtattatcacaataataataataataagagcaggaggaatcttttggaggtaatggatatgtttatatcatagtttgtggcgacggtttgacaggtgtacacttatttccaaactcatcaagttagatatgttaaatacatacagctttttgtatgccagtcatacctcaaaaagcggtctaaaccgaaaagaaatttgaaaaaaggacgagttcatgtcctttgtagggacatggatgaagttggaaaccatcattctgagcaaactatcgcaaggacagaaaaccaaacactgcatgttctcactcataggtgggaattgaacaatgagaacacttggacacggggtggggaacatcacacaccagggcctgtcgtggggtgcggggaagggggagggatagcattaggagatatacctaatgtaaatgacgagttaacgggtgcagcacaccaacatggcacatgtatacatatgtaacaaacctgcatgttgtgcacatgtaccctagaacttaaagtataataataataataaaaggaagttttggattaataaaaggaagttctcatttccttatcagttaaattagggcagatgggttaaatcatggttcttgagcttttttgaatcacctaggaagttatactcacgtgccaatgttcacaaaatgttgcacacatt

SEQ ID NO: 65128 - DNA, 1078 bp, Homo sapiens
atacattgtatttcaaatgctaagtttcagaacaacaaatacaacaaaatctgaataagcattgatctgcctttgaaaatactttgtgatttatacaacgccttgaggttagctttccaaatattgattcttgatggatagaaaaagaccagaagatggaaagttaaattgacttgagtctttctaaaccttttgacacaccctagaagttgctcttttgaataaataaatcccagataggaatgtatttctcatctagctttttctcttgatgtcaagtgtcagagaaataattctagcttttagaggttggtggttgtttagaaactggaagaaaaaaaggagaagacagtattctccaatcatagtgctatgattcaagtgagtcttgtgagaaaaaagacgaatgaatggtttcccttttgtatctgggagcaggaaagtttggaacaacttctattctgtgctaaccgcaaggttgattatttttggatgtcaaatcctagactctcactaaattggggactggaaatattttgcatattcagaagaaatctcagctatggagaaaagactgactcacagttgtagaattgagattgggaattattaatttggagtgacttctctcactccaaattaaaggaaaaggggctcttttcctttctcttaagtcctttgttaataacatcctggctgggtgcgtggaaatcaccctgtggtcttcactactcagggatagcgatgcttatatccgatgtgataagaacaccgatgtgttggggctaacagagaacacagacctaggacaagatgcaaattctggcggatctaagcaccgtaaatcttgcaagttctacacctccatggtggagcctgtggcttgcttctctcaaaaggttgaagcagccaaagccagcatttgctctcccatctgccttggtcttactccttctgaggtcttgcagcatcctgttgccagaatggattgttccctggactccagtgatcctccttggaaggcaacagcctcctcccaggctctccagatgagcaaggcaggatatagatgaggggc

SEQ ID NO: 65129 - DNA, 1061 bp, Homo sapiens
tcatttgtttattatccatctgaattcttctgtgaatttttgtttcccctggacttttccagatataattcattgggctacaccaatcagacagactttgatttttgtcccttgtttttgagacaaaccataacataaagaagtttattttttactacaaatttcctaggtgcttgtgtagctcagaaccctaaaacgtcaactaatttcctcttgccctctgatctgtacaccttcactcctcggcaggtgttccctcatcccaccttttggaggtgggtagggtggtgggctggatgtcgcacatgttgtttcagtgagaatgggcgagggccatagattctgagggtttgacagaactttaaaggttttctgggcattgccgagttggtgctttacatgcccacataggagccatgagttacagtgggaaacgtgcataggactcaaagctccatctcccatttattagctgtgtgactttgggcaagttgcttggcctctctgagcctcagtctccttaccttaaaatcatttagtaagattaaccagtggttgtcaaccttttgtagtctgttatttaccttcctcccctgtccccactggagcccccattttttaaaagattttgatctttagcatttattaattgatctcttggacaccttgtcacaggggctatttcagcaaggctttgtgaaatactggaaacagttgaaggaccccagccttaccaccttcagaggcctgtgggtatctgggaaccccagtggttaaaagttagtgaagagtagaagagataacctttcagtttttcaatcacttataatatttagttgatatattttccatatggtgtgaggcaggcagggcaggtgtcatatccagtctcagaaaacagagattcttagaggtttggagatctgcttgaggtcccacaacacggtgacgttgggacagggatgggttctggctggtgctgcttctccggacagggcagctgctctgctgatgttcacatgggcccacgtgcctgtggacttctaaccatccacacttgc

SEQ ID NO: 65130 - DNA, 1056 bp, Homo sapiens
ggaggatgatgaccaggaagtcgattcagcagatgaatctgtctccaatgatatgatgacagcgacggatgagccctccaagatgtcatcggccaccgggcgccgaatccggcgctttaagcaggaatggctgaagaagttctggttcctgcggtactccccaaccctcaatgagatgtggtgccacgtctgccgccagtacacggtgcagtcctcacgcacctcggccttcatcattggctccaagcagtttaagattcacaccatcaaacttcacagccagagcaacctgcacaagaagtgcctgcaactgtacaagctccgcatgcacccggagaagacagaggagatgtgtcgcaacatgaccctgctcttcaacaccgcctaccacctggccttggagggcaggccctacctggacttccggcccctggcggagctgctgaggaagtgtgagctcaaggtggtggaccagtacatgaatgagggagactgccagatcctcatccatcacatcgcccgggccctgcgggaagacctggtggagcgcatccgccagtcaccttgcctcagcgtcatcctggatgggcagagcgacgacctgctggccgacacggtggctgtctatgttcagtacaccagcagtgatgggcccccggccacagagttcctgtccctgcaggagctgggattctctagcacagaaagctatctccaggcacttgaccgggccttctcggccttgggcatccggttgcaggatgaaaagccaactgttggcttgggtgtagatggagccaacatcacagccagcctccgtgccagcatgttcatgaccatccgcaagacgctgccctggctgctgtgcctgcccttcatggtgcaccggccccacctggagatcctggatgccatcagcgggaaggagctcccatgcctggaggagctggagaacaacctgaagcagctgctgagcttctaccgctactcaccgcgcctcatgtgcgagctgcggtccacggcggccaccctttgtgaggagacagagttcctggg

SEQ ID NO: 65131 - DNA, 1054 bp, Homo sapiens
agaaattcatgacaatgagtattactatttgcctaatggcaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgattccacctcttgcaccaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggtcagctgcctggtgttttctttttttccgttttacctaatattttggcatataaaatgcagaagaaatcatctgataagcacttatgagccactgccatgtttaataaaacttgacaactacaattgaagtaccctcagtgccctttactcagaagaccatgaccttggatttggggtttatcatcccaggcattccctcatactt

SEQ ID NO: 65132 - DNA, 1046 bp, Homo sapiens
gcggagaatctaaggaggcatttgaggggtctgatgcacatctgagggtgtgattcttctatccagatgtgcatgcaatgccaagaacagctgtgcacccatcctctaattgttgaatgcctgtctccactggaaatcttccctcattcatcctgcagatatacttcccaggctctattcctgggcttcaagggacacgtagacagagaatatctgattctaagtcctgtccctcctgcacccatggtggaaggctggagcaaggtctctctctagggccctgctaccctgagcacctccttcccccagacattcttgttcttcacctagaaccctctcccaggctccctctctcaacccctgaacctattttctgtttctctggcactgaagtttcagctatttaagtgcaaatatagatgcatttgaaagatgtgatggaaccaggtttgaaatgcaataaataagattgcacaagagaaggagataggtaatcagctgctgcttttgctccttgaaaagactcatgtagctgtcatcagactctgctcttggcctgggcaaaggctgtaagtcattcccagctaaagccagccatttgccacacaggataaagtgggataagaataaacagcaaatgaggatgccttgggctggatgcagagattcaagagggtttctttctaccctaggcccagtttctctacaccagggtcatgatctcctgtgatgcttgaaaaaggcaatgcatcagtttgggatgctcttggctgcaaggcacaaaaatcccaattcaaactggcttaaacaataagaacagtactactcacgtaacttgaaatgcagaagcaagacagattgctggattggttggctgagcagcttaatgacattgccatcaaggacacaggttctttctgtctctccactctgctgccccaaggctgactcaccttgcagtcacaaggcagggccacccgcttcctgtccagggaggaggggacttctactactgtggaatccaagtccctcccttccatctgggt

SEQ ID NO: 65133 - DNA, 1026 bp, Homo sapiens
aaccatattaattttaattatcacaatagccctatgaaatatgcataattattatttttcattttgcagaagaaaagtaaaacacagaaagcttaagtaacatattcagtgggagagctgggaatcaaatttacaaaatttggcttcagagcccacacttttgacgactaggttgaagattagcagaaaaaagtagtcaaaattttatttgagccattgtgtttccccagatatggcataaaagtgtctataaatacacatctttgtaggtcaacttcagaaacctttcccaatgctttcgattgctttgctgccgccatcacacttcaggcattgggtgcagcccagggccctccacagaaattttacacagtaaacatgtttgggctggttgcttagcaacgtggaagacagtatgaatttttcatcaagaaattagcatagattctttcagggagatgagcacatacccgctggaaatactcttcaaagcactcacatgtggacccctaagcctgtgtccctcagtcttttttccagtgacaggtctgacctgtcccatctcccttcctcccctagttccttctttgggtacagtttgtagataattcagatacatggctcttctcttcatggaattgatgattcactagcaccttttgttaattctagcagaaaacagtgctgcatcctttccagattttcagatactagtcaagttgtgaggaggtacctggggcacaggaggagggatagagaggccattggatcatgacgaaggaaacacctgaaagacaaaccagagggggcccaagcaaaggcagaaggaagagaagagaccagcaggagagggaagcatcagacccagaagacaaagaggagaaaaaataagacacaaccattccaggatcaaagacctacgagagcaatccgaatatgtggagacagtccctttgttgtccacactgacctacaatctcccaataaccagcagcagttcacctcccgcttccaccttcttcttac

SEQ ID NO: 65134 - DNA, 2053 bp, Homo sapiens
tgaggggacccggggctgggtggcggggacgcagccaggaccctgaccctggggtgaccggcgaacagcacgatccccccaaccccgccacggctggaaggccagaggggagaagccgagaccggggaagtaattcgtcatggtcctaacgcgccggtgggccagggttcagcctctgacaaagcgcgttcgcactgttacccctttgagcctcacaactgcctgtggaacggagatcatgatccccgttgtacagatgagacccttgagccctggagacccaaagtcgacctgcccaaggacttgtagccagtgagtggcagaacaggggctcctggtctagggctcttacggtctactcagggaggggcggaagggagataacgtagtgtgagggcgggacgggtttttgctcgcattcttcaagagcccgttgctgggctcggggagatcactccgaagcctctggctcgtttgaatccgccctaccacccatcctggctaccctgcacccagaccgtcctgcctctaggggtgtcaagtgaccctggcttagcattaaataaggtcttctcccctatattataaataaagaagccaaaggcgtcttcaggtggagtcgctttatgttcaaagctccagagaatccaggggattctccaaaatgttttaagccctgctctggagctttgacctcgatagaaaaatttaaaagaatccaaagtgtcaccccgtcatcctcttgtcatgattttagaggacagtagagccattagagatgagacttttatgaactgttgtggtaaggttagggagcaggaaagccatgatatcaagggcccctctgatgaccccccaggagatggagtcgacatgatcatggaaaaagatgaacaggtcgttagtgtattttcactgtaaacagtattcaaactaaagagttttgagacataatgtacccatcgctcttcagaacacctagtggcagtcgctcggtttgtttgcattgttctggggaatgtttgcttgtggccttgttgcatcgatggacagggttatttccaggataccgtggctctcggcacaccattcttttctctccaaggtgtgtgccctgctaagagagtgagtgctgctagcagtgggcctgttcagtgtcccctcctgcccagaaggaacaactaaggagtcctgtggagagcctgcccacagttttcaggctgccttattgctctgtctctgctccagttttctacagataggaggttgggtttgacaagcatcatcaaatgaccatccctagtgtgcacattaagccaagcctcagactttgccctgcaccagtcggagccaggcaaatggaatccgactaccttcttgttacattgtcacagagtttcttcttttattgggttttgggggacattgcatagtactgcctactcttttttgatagggaagattaaaaatcaacaataaaattcctgttgattaaactccagtttgctaggaaccaggtgtttatggatttttgtgggtcatcattttgtgatcgtgctatcaatctagtgaagaagaaaaggaatgtggctcagatgcctgagtcaaatcctgaagtcagaggctgtgtaagaatgcagatattaattgatcacttaataagtgcctaatatctgccaggtactgctctagatgttgctagggatacagcagtgaataagcagatgtgtctgtgctccagaactcctggagcctacattttaccaacaaacaaccataatttagtgaaacgaagtgccatgagaaacataagataaggggacagactagagcagtggttctcaatcttggctgctgtgcattggaatcccataagggtctttaaaagatacctgggcccctttcccccaattctatttttttttttttttgagacggagttttgttcttgttgcccaggctagagtacaatggcgcagtctggactcactgcaacctccacctcccgggttcaagcaattctcctgcctcagtctcccaagtagccaggatt

SEQ ID NO: 65135 - DNA, 1048 bp, Homo sapiens
ctgtctattgcctccgtgtggtggctgtcctgagccctcccttcccgggttgactcgggagggaagttggaagaagcagagcatttctagcaggccaaaggggaggcagaaatatggatgctcaagagagaaagtttagtacaaacaaactagaagcaaagaaaggcaacttgtaacagagactagaagtaaagttcagttttctagagtagtgcttgtgaaactttaatatgcaaatgaatcaccaggggatcttgctaaaatacagattctaattttggaggtctgggttagagcctgagattctgcatttcaacagactcctgggtgtttcacagccaatgctgctgattgtcagaccacactcagaggaggaaagatctggcagcagaggtgttgctggcctttgagttggcctgtggtgctccctaatggctgagcccagggcagcacagcctcagtgctctgtttgttgagaggcagtggctggctaaaaacgaacatgtcaagcctgacagattgcctaggtttgaattctggccacttactaggtatatgatgttgggcaagtttcataatctctctatgcctcagttccctcatctataaaatgggaataataatattacctacttgattgggctgtttgagaattaaatgaggtaatgtatgtgaaacaagtagaatagtgcctgtcattgtaaatgcttattaaatgttaatcattgccattattatcattatttttatttagttgctgggttcagagttgggccttctaccagcctcacatctctgcttcctgctataaacatcttttgtgaaagaagaaaagggctctcataggattagctgtactttagagatgctacgaggaatctctccttttagtaaatgaggtctaaaaataaagttctatagaaggcagattgctacatgttctggaacctagatttcatgtgcattccaaccttatttatagcttcaaatcaaagtcctatgcagcctggtggactgtgaaggaaaagacccccaaagcgcatggcaa

SEQ ID NO: 65136 - DNA, 1078 bp, Homo sapiens
ctcccttctcccctcgacattgccctttttctcccccagcaactcagaggccaacccacttatatcccagagatatagctaggtcatccattcagtcatgtaatgtatttttattgagcttctgctaggtactaggccccatactaggtataagggtaatgatgatgagtgagacaacatggtttctgctctgagagttcacactaataggggaaacaggcaagtgtatcattgtcatataatacatgctgcagtggaaaaaagacaaggtgcagaagaattatattgaaggaggaggtcaagaaggcttcttggagaaaatgtaatttaataatattgttattcacaggttacaatgagtattcagtgatgtaacctatatgaactataagcatggtacctggcatatagcaagggctcaatcaatgtttaatgctgatatcctcgaatgagggataactggccctgctaaggacccagtccccgggcagggctgagtcaggaccagaccagcctgtgcatggctaggacatttgcccctgtggttcagagctttcagagactatgaccagagactttggagaatgtgtttttcttcttgcaagttgcatgctctagggctttctgtgggttgactgtacaaccattcactgggccagcttgctatgagatctagaaattcctaccagaaatgactaaaggcttaggaaagaacttcctccttttcaacatgtagcccctctggtcagtttcctctgacctccagactaaggatcgcttcccctttcctgactctctcagggctggaacctattagctctgtttgctattggcctcaggagtgttgctgtggaaacaattaagacacttcacatagcacaactctgccaagaaaactaggccacaagtctgcagggctgtgaggagctctgggaaaagcttgctgagcaggcagaaggctgtggtcctgtcccacctgtgagtcagtgccactctctgggactgggggtttcccaggagcgttgtatttatggcctcctgctgcattctcctacctcaaggacacagcaagtgcaca

SEQ ID NO: 65137 - DNA, 1038 bp, Homo sapiens
ccacgtcactccagcctgggtgacagagcaagatcctgtgtcaaaaaaaaaaaaaaaagagttcccaggttctatgactatctgggtttccaggccatgttgcttggtggcggggagggctctagagatccctgcagggagctgctaactacagaggagcctcctcccctggtgacagcctctgtgctttcagagattctaggaggaaatcctctcctccccttccctgccatgccagagctgtcaccctcctgctgctgctgctgctgttgctgctgctgccaagccagcagccgccgccgctccccacccccacttcccaacccagtgctggctgccaagaagccaggtcacacagctgtgcacgtgagccgggccctcaggaggagaggctgggtgtggagatcctcctcctgctgcgtgccagaggagagggaggcatagcagaggcagcagccgaccatatatctccactaacgtggggagagcaaactgagaaatgaactcacccagccagatgggccttgcgtaagctacttcttggccaagaagagccccgggaatgtggctccataccatcccaattcatccttatataaacagcctccgttctcttcttcgccctctgatactccttccttcttgcatgagtgcagttatgttttccctggtcatgaaaaatactttgtaaactacaagactctctttaagtatcagttgtggctatgaactctagctccagtctctgaatttgggaggataagctgtcttccacctctctgttcaatgttctaataaatggaggctaagaaggggatgattttccaagaaaggaacatgtctgctattccttatgatgttagagttaaaaaaaaaaaaaaaaaaaacatgtcttcagctcttatcaaagaactttctccagggcttacatgggtggtagaggcctatggggattcccttagcttggacagataggccaagtgccaagcaggctagtagggatttttctgtgattagagattttgtcagtctctgtct

SEQ ID NO: 65138 - DNA, 1073 bp, Homo sapiens
tccacagaagattggaaattttgttcttatttaatagatacgtagctgagggaagtaacaacgtgttcacagtcaccccacaaattaaagagcaagtcagagaatgacatagactcgttgtttggtctgatggtggttccgtctcaaaatcggctggacaagcacagtgttccatggctccatggctggctgttctgtgaccgtaggcagattccttaaccacccaatgcctccattttttcctctgttacatccaagcctttccttttgccaccttctctttctgctgtaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtaagggggacatacctgcccacattgcacctaaggcctgcagccaggccttttgggcttgtcagtcaccctaaaaaaggcactggtgggtgggggttgggctatggcccctggaagggcctaagtgtgtgcagatagtccggaggaggagagaagactcaatatccaagagggcagagccaagcacagagtgaactgcccaccagaatgaagcccagaccatcatgtagagcagaaggacaggcagaaaagcaggcctcaggtgtgaccctagaggtggcatatcctctggcagctggtggacaggggcgaggtccccagggtgagaggcatggagagggtgaggctggagccagtctgaagtggaagagcatagctgcccgctctggagctgtgtccacagcattcaaaaggggagtccaggaacagcagttgcccatcagtgatggagggagtggtgtggaggggctgcacacagggctgtgctatacagacaagaagcaaataagcctgtgttaactgtccccagaaggagagagggcaacacagtcagcattcagagggatcacctcatcttgtgcctatgttttttgtttctgttgtttatttaagagacaaagtctagctgtgttacccaggc

SEQ ID NO: 65139 - DNA, 1034 bp, Homo sapiens
gaggaagggccttttatgccactcttggggaaatgtaaattcctgtcccctctgagtcatcatctcaagctgttccttatgcaccatgtcttcgtcattagattggagggtgatttttctccatggagctgataggttctttttatcagatccctcttacttcagggccaggccgcagccatctggtttgagtgtctggatttgtgtgctcactgagatgggcatttgatgcctgcacccttcacctttcctgggctctttgacatagacattgctgatggacagatgtgtgctatcttgttcctgggagtaccagcaacctactactctctcagttatctcttagctctgtgatactaagcaaagttcatcctgtattacaaatttggaacttgccaggctgacactctgattttcggatgagaagaccaaagaacagagaggttaaatgtctgggtcaaggttgctcagtaagctaatggtgtccaattcaacatgaaattgttgccagcaggtgggtgaagaagggggagcattaaacatataaaatgtgatgtgctgtccatccataaggattgaacagtctgcttagataaaaaggaacaataacctagaattcctggacaaatgatacagactatacaagcttagcagaaggctgctggtgtggtctggaacaatcagggaacatatcacagaagtttgcgctagggggcctgaaaagtgaattggattcaggcagtgagcagggcgcttaggacaagaaaaacagctgaaggtttatgtgatcttgtacaaatgacttaactgctatgggactcagtttcctcacctataaattaggttgctgttgcaagaattaaatgattaaatctgggccgggcgcagtggctcatgcctataatcccagcactttgggaggccgaggtgggtggatcacctgaggttgggggttcgagatcagcctcatcagcttggagaaaccccgtctctactaaaaatacaaaattagctggcatggtgacgtatgcctg

SEQ ID NO: 65140 - DNA, 1871 bp, Homo sapiens
taaacctatttaaacagacaactcagcattgtgacaggcgcactctgtccttcctttattatcagggatgaagctgtttcttctctttgccccagattccggatgtcataaatctttaaaatgagtcatccttgtgtctcctctctccctcctgcccccacaatcttccagcactgtgccagggtgctttcatctatatgtggaaatgtgctcacctgctgattgtaaactcagtcattgccttactcttcaaaattactggtcccagcgggcttctcttccagccattttttcctgattctccatctctggcagcagctgctgtgccttgattcagaagctgcccttgtcatatctgagcaagtatcccccagggcttcacgtgactctcacatagccttgtcctcctcctcctctgctgtccgcagccctgggtggagggcctgcagtggggagcttgtcctgcatcagcacctcagaggggcagtattccctcatcccagtggcatcccagcaacaacctgtccccaggtaccgtggccctttcagctcactctttcagctcttctcaggtcccgctctgaatgtccccagagaagcagccagaggagcttgtgtccctgggcaactgagcagcctcctgaatgctccttttgcacttgtttttctcttccagctgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagaacaccattccttccaggagcagtaggtgggaggtttgacccagaga

SEQ ID NO: 65141 - DNA, 1050 bp, Homo sapiens
tctgcagtggaagcacatggggcttagagggacctgggttcaaatcctagctccactactttctaactgcatgacccaggcaggtttttgtcctctctgggtgccatctgttaagtgggctaattaatattgattcttgcctggaaaggagaaaaagcacatcaggtcagtgttcaacaagtgtcagcccccacactagcagacaacactacggctcgctgctgtccagagtgtcttcccaaggcccctcctttaaccctcataactgccccaagagagggtagtgacctgcccattttatagatgaggtgattgagattaacaaaggcagggtggctcatctggagactacaaaagagtcagagactaaggctacactgggacccaggtctgtgcgtgtttagtccactctacgtcccagccctgcctctggcccagtgggcagcttttcttcctcgacctgcttccccaggtgtcatagatgctttaatgagaggagctgaggaagcagacaccagccagtgaatgtgtggccagctctgcggcatgtgggacaagggtggcagtaggccacgaggctgaggtgtgggccagcactccagaacatggtggcctggctgcggagacaaggccagtgcgtgggaataataagcgtcagtgtctcaggccctgccggcctgccccgctgctcccaaagcccccgctgccctttctcctggcccgcctctcactgtgcttggccaggctccacttaaccctgggtgggtagatagtgctttcttgtggctctttggtggagtcatagatccaactggcctgggtttgaatcctggctggcccttcttacctgtgtgccctgacactgggcacttaagccctctgagcctctgagatgccagcactggcccctgctcaggatggtcctaagaatcagatgagataacacgtgttgagtgtttcaagggctgaggagagccgcctgtaggcagggctgtgtgtgtgcacacacacacaggcgccttgacccccagtgccactgtcagctcccag

SEQ ID NO: 65142 - DNA, 1678 bp, Homo sapiens
tccctgacagtggagacgcccctaagaggtgccccaagtccagccttcaggggcttgtcatcccaaaccacatctgttcaagggtgacttcagttccatcagagccagctgccccctaccacccatgccctcttttctctctttagactatggcatcctccccaagcacccaaggccgcgagggcctcgacccctcctgtctagggcccagcagcgcaagcgggacgggcccgaccttgccgagtattactatgatgcacacctatgacccaaggccctcataaagataccatgtgtgacaaaggcttggctttcctgggctgggagcgagacggggacgggaggggcccatgcagatacatccactgcagtccagacaggaaatggcactttaatagttggggccagggtgacaggaccaagatggggctggcctgtgtcagtcaggaagcctccctcttctgctgggacagggccttgcggcagctcctcctccccgcctgaggtcctaggcctgccacaggccagcatgccggtgaggtcagtggcaggagccacccagaagccccgcagatgacggagctgagaacagggacttcacctccacgtgttgccatttcctcactggaaagtccttgggaggtggctgggctcagcctgagctcagggctcttcggtgggggttggggcaggggcagggcgggcacttgcaggtggcacaggcttcatcaaggcaggacacgggcttcatcaaggcaggagccacagcgcccgagccctggcaggggaggtaaggcccaggatggggcagggccgtgtgctcctggaacggacatccttctctgccagagacctgctccccaagccctgtccctcccaatccccaggcagcccactctgccctccatagatgaatctaatcccatatattacaataaactgcatttgcctctccccattgccccaccctcccctaccctgggccagcggcccccacttccttgtcctctggcggtggcaggtgcccctcctcaagcagtgccacatcctgtcagcagccagctgtcctggcactggcctgagggctgggggacgcagagggcggggctgcacagctactccaggtagatatcttctgtggggcaggtgtactccacaaactgcttgtagaactgctggaatgctctcctagaagccaggggacacacagatggctcagatcgccactggcaagggaggaacaggatcccgacccagggttttcccgctggagccttggggcccaagtgcagctctggttcctctggctggggccacttggctctgttctctacagaattgccatcgcgtttcccagtaagatgtcagttgaagacatggcccaacagctaccaagcttggaagctgctcctcaggctcaccctgccgcgccaccctccctccaggccacccgcactggggtccggagatagttctccagagctgcgggggaaaccgaggggcaaagctgagcgccaggaagcagccccagggcctgggattgggcgtgctccctcgggctgggtgctcagcagggtgtacacgtaccccacggactctgccagggctttggtggagtcttcagacacaaagacgtggcaggcaaaccggtggtcggcggggtgcttggtgatgaacc

SEQ ID NO: 65143 - DNA, 1050 bp, Homo sapiens
ccttagaagggcagttgtaagaacatcctgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaaaaaaaaaaaaaaagaacatcctgagccgggcgtggaaaagctctttgcagatggcgcttccatctctgcgcccctcggggtgggggctgtcccatgttgctcctgctggggcctctcaggcttcctctttgcccacccaaaaggaaaaatccactgcacctccacttggtgactgacgccgtggccagaaacatcctggagacgctcttccacacatggatggtgcctgctgtccgtgtcagcttttatcatgccgaccagctcaaggcaggggcccagcccttcccccctcccctcagctgtgtccaccgctctcctctctccaagacctggtggggttggagaagagaatcatcagtcccccctccacctactgaagcgcaaacccctctcttttgggggtttaccccctctcctctgtgtcactgcaagcatgtgttctggtgctcataggcccctctctgccatctcatctcctgcctttcccccacacagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctggtgagaggcctgggagcctgcctggcctgcccaggatccctgcatccag

SEQ ID NO: 65144 - DNA, 1027 bp, Homo sapiens
gatcctcctacctcagcctcccaaatagctgagactataggtgtgtactaccatgaccagttaactttagtattttttggtggagacaggtttcgccatgtcacccaggctggtctcaaactcctgggctcaagtgattcacctgccttggcctcccaaagtcctaggagtacaggcatgagccatcatgcctggactgtagcacttcttgggggaagaaaatgagatgtggtatctcatttatgtaaagccagacccaagccactgacagttttagcatactgtacacagaaaaaggaaaagtccaggtgggcagattctctgcactgggttgtaggactcatgggagctctggggaaaataccttctttggcaggcattctgagcacagaggacatttcaaagaattaattgtcaaaaaccgttcctttttttttttttttttttttttagcaaaagaagaagagaaacagaagttacttaaatggagttcagatttaaaacaagaacgagaacaactagagcaaaaggtgaaacagctcagcaattccataagtgtaagtaaacctcatgccttcagcagtcgatacataggtgcagagacctaggcctttccaatatacgtaacagtacgtgtgggccccaggctgtttcgggtccttctgtttattaacgtgattaacttgggcaaatgcagtttgccatccagttagagttcagacctcaggtacaggcggccagttggtaggtggtgccttacccaagctctgtaacatcctcttggctttaatcagagagaggattttcagtcttcaggctgaataagtaacagctacaacagtgtagccatggccctgcgtattcctgacagtgtgtggggggagtgtagcgcctcacctgacactgagcagacacagaccaggtcccctcgtgtgattcttcctagtcacctgagcgagtgggcccatccgtacggccctccctcgctctttcttccacaccatgctgattgcatttcccggttttc

SEQ ID NO: 65145 - DNA, 1098 bp, Homo sapiens
cggaggtcacaccactgcactccagcctgggtgacaagagcgagactctgtctcaaaaaaataatactaataataaaacaacacccatttcacttttaacctattttgttatatcaggctcagagaactaagtgtaaagtgctgtcgatattttatagacttaaaaggcaaacatattagtaactgtcctagcctccctcgttctctctttggtttctggtcgccttttctcaactatgcatgtatatttatgtctttatgattttattataagctgtctcaagtcttttttagaggtaggcaaagtataaataataaataagcaagcccaatagctcagcaagtactgggattctgctcagttctttggaatcctgctttgaacaaattctggttttcccttgtaatattgtcctcatcctgcagcctgtggtgcagcggaacacttctctcagtgtcctcctcctgatgctgctttgtgaccttctgacgatttttgacatagggtctagattatactttagtatttggaactaatatttaattttcttggtcaggctgtctttgagggacatcgaaatctaaaattgagacaggcagcccatgtcaggtcaaggacgaaactgccagtggctgctgccatcatgctgatgtgcagcttttgtgttggtggttctagctgtcgggagtggttgggtgtcatgtggcgtgtgtgaaaagataggaatgctcagccaagtcccagctccttctaagcctgggctcaagtgtcctggctcttcctgccttgaacttgattctcctaagctgatatttggaactttttagtccagaaactatagaccagggttttgcaacactgctaccataaatccttcctggattttatctgccagtagccacagataccactgctagctgttacatagaggatgtgtgtttaaacctccttctcaaggtaaaattctaaaaatcttttcagatgctgaagaaggaagaagcaattccatggcctggaactttagcaattgttcattcctatattgcctacaaagcaggtaaggagttatccatacccacttttttgtaagcttcccc

SEQ ID NO: 65146 - DNA, 1040 bp, Homo sapiens
tgtctcgctttcctgacttttggcattaataattgacacaggtttcctaactgtcctgttaatgagcagcagggtctctctcagaaatcttgtttgctagcgccaaagattgtcccaactttttctcagttgaagtattgccaaaggatcaccagctcattggcctcttggtagagctctccctctagggtggtacacaaatgctaggggacagttgattttgtggttctgcatgtgagtctctctcctaaacagtgttgtttttgttgtattttttgggtcaattgggattatggttttctttgaaagattgaacccaaaggatccactcatcaactcacaaactaagagcttctgccaggtttttttaaaaattgaaacattctttttcttttcagaaatctacaggtaaaagaaagcttttctaaagaactccctaagttaaactcagcagaaggtatttttaagataattgacttctccttttacagtatcccagtagtggcagtgattaaaatcaacacacaggtctctgtatgtttgctgctgggtagcataagttccaacaacattaattaaacaataacacttgagaggcaggcatttctagggatcaataaccattttgagggacttggtataatacaaaacctaccagacactaatcctctggatgtaccgtgttgccactatcatcatttttatgagaagggaagatacgttaacataattataaaaattgtttagcacatgatgaaattgcagttggtattgccagagtgcttcctaaaaacatacgtcctcagcgcctagcaaagcatcatgggccagctgtttttcaacttacctaccgtctggtttatagtaataatttggtcagtcatcaaagcctaagcattttgacctggtatggtgcctccgtaggacttcctctgctctttttaggcaaagagccggttctgtatgggtaaaatgttttggcattttatattcatttctatgggcagcagttctcaaagtgtagtctgggagtccccgag

SEQ ID NO: 65147 - DNA, 2012 bp, Homo sapiens
gactttactaggattctggcaaagctgactcaggggaatggcttaatgtagcatttctgccccaagcctgccaggccatccatgaatagcacagtgaacagaaccccatgtaaaaggaagcatttgagagtcattaagcagaacagagcactgccattgccaaggtgttcctaatagcgtcttggttgtcctgctgccggcaaggccagagtgtgacgctgagtttcttggagctgcagactttccaggaaggaaagaggtagccacacttgagaacttagaatctttgagaagagggcatctccaactaaggaagaaaaggtcactctcaaaacaggctccctaaagaacagattcctaaagagctccaatcccatatttcagaccttcccatggacattccagaatcttactcttaggcagagcagaaaaaatagcagtagcagcagcagtgtctctcaccatgcaagtctaaataggtcttaacagctcagggtttgagctcataaacaaggtactgaaatttttctttgatgtcagtaatacatcccaagatccttttctccacatggtaatgtgtccctgaattatagttgcaggctagaaaggttgcagagtgagcggagtagcatactaatttttgcatgtgcacacacagtctcagagctactggaagctcaggaggtcatcctgaccctttgtctgccttaggcaggactacactattaccattccctctccacaaaagagatatacccacccttagtaacccattctaatgtttcatcagtcctgtccttcaagtactcaaaaatatttagatgggaaaccctaagtcatggctttatattgattcctgggccacagtaaccagtactctaagttatttttgttttgttttgttttgttttgtgcttggtgatttttttagtgacccctgatgcagttctcggaaaggagccccccagccagaagccacaataattggcctgatagtgggcagtatctgctaagaggacaggggttaaatgagccagaaagaccttggcatctcttgctaaggtcagaggataaaagcttgcatccacagtgcctaggatatgccttttgtgggtaaacaagagagcattcatcttgttcttccccttccagcagcactgaactccctagaaaagataaaccagtacgatctgtctttgtactataggcatcaccaatttaatacagagaggtaatatttttgtaacatctgacagaatcatgactcttgtgcataatcctaatataaatgataactgttggcaaagtcatgatcctacataccatttaccagtgcttataggcagttttgtatctctctggcccttttttttcctttggtgtgttgggcatatacttttgatcactcatagcttagaagcaatgaccttgcccctagaagacaagggccctgacttagatatgtggtaaggcaagagtggctgacctagactttctgtacccacagggctcattcaagttcctttgtagccttgaagtttgagtcaaaatgctcttacacaaatcaggtctctcagttaggagtgctgatgggagggcctttcctgagacttttaaacagccccaatttttagagatgtagtttatcaggatgtttgtcatgtaaagtgggggagacagctgccagtcaactggggagggtatccagggacagaaatacttaaacattaattgctaagcccagagcatcttttaagctcttaggtttcagctactcccagaacatgcctctcaatagctctaaaagcaagggataagaatagttaacttgaattttgcctccttgctttgccggtctccaccctcataaaatgcagacagaatagagaaggaaaagcagaaatcctaaataaatcagtttgtgggaactgagaatcattaaagtattgtgagaatgctgattgcagagaaaccttagagaacagtatgcaagatatgaaaaaataataaat

SEQ ID NO: 65148 - DNA, 1030 bp, Homo sapiens
actaatctggctgtcaaggggataggtgcccatctcagtttttgaaataagaaataatataaaaacatttcttcaggactctgaagttaccagtaaatgacatttctatgttctcaagtggcttgctgaagaagtttattttcaaataggctgaacctatcacttcaggccaaagtaggataatatcgaggataagatgtcaggacttttaaagatcaaattgtggtataaataactctacaggagtatgtcttttacaattgaagatgttctttattcatcagagaaataaattgataatgtattatttggcatatttagaaactgcatgcagtagtacaacagaaaatgaagacacacttttcagaccacatgcaagcaaagaaaagaatagaaatcaatttgtttccctctctggcttgaagagtcttaacgttccatcttcagggcccagtattttgaccagcttagtttctgatggagccctaagagtggtcttcagagagaaattgctccataatttttaggttcatgtgtgattgaaaaatcatagtattcagcagaaacacctgctgtcattcctgaaaatcatttagctgtgagttagcattgtggcagtataaatgtgagaaactgacctagtcgtgacaagtgaaacactcaggatttggagcttgttaaatgggaggctctttaaaactctctgcatgttttgtgagtatgaaatcctcttctttttaagaggatttttctgtggggcgggtcactcggatcacacaagatactgatttctgtcattgagaaagaagatgtagaccccagtccttctcttttggccctgttagaccagagagcctctagagcaaactttctaacctgtggcccaggatggctttgaatgcggccccacacaaattcgtaaacttccttaaaacatcatgagttttttttgcgattttttttttttgaagctcatcagctatcattagtgttagtgtattttatgtgtggctcgagacaattcttcttc

SEQ ID NO: 65149 - DNA, 1004 bp, Homo sapiens
attgaaacatttcatttatatttcctgaagtcagattttatcttaaaaaacgaggctagagacatacaagtaacctgcaaaaatacttgaaggttctgtagcagaaagacctctgaaaacaagaaggatttataggcagtcaccgtatcctatttgaaaaacgactagtgatgagaaagaagaatttggcaaagaaaagcattctctctcaagaaagttgctttaaaaagtcatcgacctatttctaattgttcagtcttgacttctcatttatctgaaaatagtctgtggtgatcctgaatcttctgcttctggatggaccatgattcagagaggctgttcagatgctgcctgctgccttagtcttcttgagcagaggaacctatgcatagggtactagaccttaaacccaggcagctcacaaatgcggcagaccttgcattcaagaagctagttatcaaaatctgtgcttaggaaacacaagaacacatctcaattcctggggaacctattcaaaccccaggaagtgctttgagaaacattcagaaataaattattattattattattattattattattattattttgagatggagtttcactcttgttgcccaggctggagtgcaatggcacgatctcagctcactgcaacctccgcctcccaggttcaagtgattctccttgcctcagcctcctgagtagctgggattacaggcgtcagccaccatgcctggctaattttgtatttttagtagagacggggtttctccatgttggtcagctgatctcaaactcccaacctcaagtgacctgcctgcctcagcctcccaaagtggtgggattacaggcatgagccaccacgcccagcccagaaataaattatttacacatattttaacacagaaaatttcaaacttattgacagcagaactttggtattaaactactgagagtcagatgctcaagcttaggagtttgggtggggacctgttgttttgcac

SEQ ID NO: 65150 - DNA, 1027 bp, Homo sapiens
atagtatatcccttctaggctcctgctggatttctcagtttccatcattcttctagcataccaaattcccctttggggctgacaagggaatatggcatttctgctatctgctcaaatcactacagaagcgtcctgacaccaaggactaaattcagtgcattatctgaggtcaaagtatgacttgattttagggggaaggtctccttcacagaggcatacacactgtttcatttatgtctccctctcccttcactctctctacagtgttttcctgtgaaacttgagtgcttaaactctcttgtgctgtattactgccttggtgaaaactccctgataattcttttagttttaatatctctttaaattgattgtacccagaaagaactggagttagttgaggcactttaaaaatattcaagaaactcacaaattaaccgtgtcagtgcccaagttttgttcaggaaaaaaaaaaaatccctttaaggaggaagtacttgaacaagaattttcatgagagttctaggatcaagccatttagaaaactgatattctcagaagcttgggagaaatatatctaaattttgatgtaaaattcccttaaaatggcacctaagagctcttggtggcttttgaataataccagtggtgagtgaaactagagagcaataaagtgaaggttcaccgcttatccaggaatccttagagaagcaacgaggtcactcaaccagatactgagagttagaaaattttctataggaataaagccattcactgttagcttatatcaggaaaaagcctatttggctaagcagcaagtttgattttactttggatccagtcttgacttttaaaatatgttaatgcaaaagttcttgagtgtcaaagaaaattgtctaagatttactgagcctgctatgttctccattaggtgtaggaggaaacagaagtgtggttggttcattttatagggtaaagcacacaggtgggagagttaaaaagtttcctaatgcagtgttaattcagatga

SEQ ID NO: 65151 - DNA, 1052 bp, Homo sapiens
tcccctcttctttagaggataattttgtggcacattctgaagactgccctgtctccttcctgcatcctcagcgttgatgaatattggtgtgacttatcaatgcagtggctgagttttagttagacggtagaaagtcttttttttcctctttgagtaagttctgatctcatcaacaaataaacatttctccaggttagtttttccatacgcgtaaaatttagtatccttggtttcattttgagcaattggtgtgtctgaagacccagaaagattttgagtaagatttgatacctttctgcatttgtgaaaagttacaagtctctatcagcctctggtataaagagtgaaggttgtatttttaaattgcatgttgattcatggaaggaataaaaggatgcatctttaaggcaatactgtgtaagaagatgtcttgagtgggtgtggccctctaataattgatacgcaacagatactgccatgtagagcacaaaccagtggagtgactgaatgtgtgaaaaagcagagacttgcagcactgacatccagttgtggagggcagggtcttggagtttcttttgagagaagctttctaaaatttgtgggagcaatttttgataggaataaactggtgggttgattgggtgggggcagtccttccgtctctccgtctcccttctctgttgacaaaagccatggaacgtgacttaaacggtggaaaaacgaacctgattttctgttgtattagacctataaaattccgtatttttcttcaggatctgtcttgctgtcgtgtgaacacgttgatagtatcgctgaatgtcacaatattgatcaccgtgactacctgtcttggaaactgtgacttgaagtgtcagaggctctgtgaactcttctgcctgaacaagccctgatgaaacccagtgatgcgaatgtcaagggaatctaaggctccttgttacatgctgggtttatggagcagttcttgacagatggattgaagtgggcggtactagcagttctggaggcctggcatgttggcttattgtttatag

SEQ ID NO: 65152 - DNA, 2064 bp, Homo sapiens
aagcgtcttattaattttcaaaaccaagattttgtgatagttttatatctctagaaaagtgttttaaatatggcatttggtgaataaattggtgtaccacttgagttcctatactttaattttgtgattatcacattcactgtaccatagactaacatttacaatggatacatttgtgcccaaagaaagtaagttagtagtcagcagtattgttaggataactattgaccttttttaggttactgtggttagggatatactcagaaacacaaactgctatgatggaaactttattctgagttgctgtgaaggctgttatgccattagttaaggcagagttataaatatagctaccttttgtttcccaaataattgggatcctattcaagattaattgtgccaacacctactttcaaaattgcctttcattttatctgctcaagcatgtacacctagcctttgctcagggtagaaaaagcactaatctacctttgtgcatatggagagtagcattcctggcactgcattaaaaactccaggagaatgcattattaatggaatacgtttctctctctctctctgtctctcaaaaagggaaatcatttatgtggccactgtcaaggatgatagggacagacttagtgctagttcttaaccagcatattttttaagtgagttactgagcaatacataaagagaaatgctttagcaagtaaataccacatgtagcttgtagacaccaatgtgatctaattgtaatatagatcactctataatgtgtcaacctgtaagctttactaccttgagtactagatcctatgtttttaataggatgccacattatcaaaggttagaaaaacaataatggctaggcatggtggctcactttgggaggccgagccaggagggtgacttgaagccgggggtttctgaccagcctgggcaattcagtgagacctcatctctacagaaaacttaaaaattggctggatttggtggtgtatgcctgtagctctagctacttgggagactgaggtgggaggatcacttgagccggggagtttgaggttataatgagctatgatcacaccactgcactccagcctgggtgacagtggagaccctgtgtctaaataaataaataaaaattatttttttaaaaaaagccatatactgaaaataataatgaatttggggtttgaatattatgaagattaccagaaggtttttgaatcacttttgatttaaataagctcccatcatttgtttactggtttccagctttatgtttttggtttgtttttgtctacacatgtataattgagctgaatatgtgtgccaataagtaacagagctgcgttcagcttctgcttaagtctgcagtattaaagtcttccttttgttacatgtgctggtcttgcagactctgtagagccttatcaaatgcagccagttggtgctgctggtatgaaagcacaggggagctctcatgtggaaggttaatggagtgtaattataaagaaaaatgaactgctcaaccactctatctcactctacctgcaccaagagtgacaagtgctctgatcttttataaacccgggagtagaggtttaaccatctaaaattatgacagtataactgtcacacaaacatgctgtgaagtataggtatgcacccctgtgtaagaatgattccttcctgttaggggagtctctgttaggacaggagcaccttcagccaccaagagcagctgcttgttaaacattgcacttttgtgtcacttcttttccactgaatttgttccattttcttttcctaaaagtgctttctcccctatgattagtggcaaaagtggatagcctgctgatgagtgggttcgttccactgtatcccatcagacaacaaatatccatgctttctccaagcaagcctatcacacttgccttagcagccaacctgaaatcagctgtattcttataaaggggatggaaataattgtctcttctcattctcaacatctaagcagagtagactctaggacgcttaggtacagtctgacaatta

SEQ ID NO: 65153 - DNA, 1073 bp, Homo sapiens
aacttgttaatatactacatctgttacaatactatatactcagtaggcatattcatttaatattgtcttcaaaccttatactgcctaccactctatccatggccctaacatcctttcacatctaagatgagagagtgattagcacagtgcttgcaaagcagcaggcaaattgatatttgtggatgactcaaaggatgttctgagaaccttttctaaactgctttaaatttgtgtgctaataacacagatggaaacctagctgtgagtaagttaccaatctttaaaacaaagacgactagaatggtttgtatttgtagttcatattcttgtcctctgggattcagtaatctttttagcctctctccacagtggtacatgtatattcctgggtagcaggctgattgctactgatggtactgaaatgttttgataggagcaaaactgtgctgccatcctccttacgagcccagtgttcagaggtgacctgtttgcacatgggcctgtggtgtatcacttttttatacaagagcagtagaataaggtctgactcgagttgattgaagtggtagttttaggttctgataagaggacctattgctggtgagggaggttgaaattgcagaatgagtttgcagcatgaggcaggtctgcccagcagcaggttgatttgcaccgtgagacaagcagcacacataaacagatggcccaacaatgagtcagaacaacagatcctgaacaggtagattggcttttgtctgattcttaacgtggttatagagagtggaattttaatttgtctgccacttttaaggctgcaaaacaagcatttagtgaaagaaattctattcattgggaaatgaaaaatgttattaggcagaggagaaatctgattgtcactggatctagacattgagaaaccagcattttcaggagctgtttcacgtaggcatgggctggcttcatcttttggcatacagttattcaactgtatcattttgctgaatcctctagtatgtaacgtgcagcaagaaaatagtaaaatgatgtcctttatatttggattttaagaagta

SEQ ID NO: 65154 - DNA, 1921 bp, Homo sapiens
tgcctcagcctcccaagtagctgggattacaggcacccaccaccacacctggctaatttttgtatttttagtagagatggggtttcaccctattggccaggctggtctctaactccaaacctcaggtgatctgcctgcctcagcctcccaaagtactgggattacagacgtgagacaccatgcccagccataaatttatatcttaataggaatgtttcagaggggttggattaaaatcattagacaattgaatttgacagatcattggtcaattttaagtgtctttacaacttttcaaaagaaaaacgttatagagtctttaaagctgtttaaaattattcaccatttgactgttacctagtttctggtaattgtgtacttgtctttagtcccatatcgcagctaatggtcattttcagcagtgaattcagaagtgctatgagtactatcatatcttgatgagagagatcctgcaactctcagtagagtatgaagaagtagtgcttagcttctgttacagctagaggtgagagaatatattttctaaataacactgtattccttggcatatagtgtagaagtgaataatttgtttgcatagcatagtgagggaaatagtgtagcagtttcttcgtgctaaatatgttggtttcttctctatagtttgctgccttcactaacaatttgactggtactattgtgttgtcttattttgcttacacctatcaagcagttaaaagggctaatgtactgtcctcagctctctagtcaatcgaaaaattagaatctcccctagatcattatttttacttatcaatgttgtttaaaaagactagagatgttgctggttgtttagtaaatgtcatgttgcagccttgcagaatattgcgactttctcttagcacagaggataagacaagccttcctgttcaccactgctatgcctcatcctcaagagaaaagttacgatgtttctatatactggaggcagtaggtgcttgaacaaaatgaaacatgatgaatttctcacccactgggatacataaattctcatgtaggtatcagtcccttatcatctctgtgctttgtcatcactaaataagtaacataatatttggtcctttcaaatctgtgtttttagatgtatttctgcatgttattgacattgttcttcctcttctaacccactaatccattaaatattcagctcctcctaaattatacattttttgtcctctatagatatatttttaaatttcccttctcaaaataagcttgcattttgaagtacatttgttagaaacaaggtagaataattctactttctagtctcaaggaacagtcttctaaatgtaaagaatagaacctggtggaagtatatactatgtgctatttcactgggtacatattagtttatctgtttagagacctataatcaaccactagcagggaaacttgccttactccatttctgcaaagtaataatttttaattattattgatagaccaagttttatttttaatctcaaaaaagtttccttgagttagcattgcacaaaatatatactctcccaggtttgatcttgacctctgtttgtggtcctgttttctctatttactgctctcttctctgtttacatagtttttaaattttctaataattttctttgttgatactctgtaagaaatggtagggttctggccgggcacagtggctcacgcctgtaatcccagcactttgggaggctgaggcgggcagatcacttgagctcaggagtttgagaccagcctggccaacatggtgaaaccctgtctgtgcaaaaaatataaaaattagccaggcgtggtggcaggtgcctgtaatcccagctattcgggagggaggctgagggaggagaattgcttgaacccaagagtcaga

SEQ ID NO: 65155 - DNA, 1038 bp, Homo sapiens
tttaatattcatgctagcagtttatttttaatgtgaataaaattaacagtaaaactatcataaaagatagatggggccgggcacggtggctcacacctgtaatacccagcactttgggaggccacagcaggcgaatcacctgaggtcaggagttcgagaccagcctgggcaacagggtgaaaccccatctctactaaaaatacaaaaataagctggacatggtcgtgggcacctgtaaacccagctactcaggaggctgagacaggagaatcacttgaacttgggaggtggaggttgcagcgagccaagatcacgccattgcaccccagcctggacaagagtgaaactccatctcgaaaaaaaaaaaaagaagaagaagaaaaaaggtagatggaagtatcttctgtaaagtgccacagattcctggcttcagcgctacctggattccttgaaaagacagggggcccttttctcatctcttagaacctcactatcactttgcatgtttttgaacacatggtaggtatgcagtgagctagtgttgatagatgtctcgtcacgttatggttggttggagggaagaaagatcactttttaagttagtcactctatatttaagtgtttttgtaatgggaaatcacctgtaaaacgagcttgcaggaacgctctaaagattaaaactgtgaagtgtgtggcatatgctaggcacttaataagtaaataatagctcttgttattgttatctttaaattttactgactgttgttctgactttgactttgcattttctgagatctttgaaaatacatattgttagtacctgttgatttgtattttgtgcctttgaaggaaagaatagaaatattattccaagggagggttgttggtcttaaaatatttttgtgccatttttattgtaggcaagtatatcacattctaataggcgtttaagacagttcaatacttaatacaagtgtatctttttaaataagacatttgaccagctgaatagattgtagtaacctgttgtaaactagt

SEQ ID NO: 65156 - DNA, 1602 bp, Homo sapiens
aagttttataaaggaaatggaatgtgtcagaaccctcaaaggtagatggttaaacagaattgggtgaaagaaaaaaggtactccaggaccagggaacatcatgaacagaaggtgagaaatgtgaactaatggccgggcgcagtggctcacccctgtaatcccagcactttgggagaccgaggcgggcagattacctgaggtcgggagttggagatcagcctggctatcatggtgaaaccctgtctctactaaatacagaaaattagctgggcatggtgatgcacgcctgtaatcccagctactcaggaggctgaggcaggagaatcgcttgaacccagggggtggaggttgcagtgagccgggatcacgccactgcactccagcgtgagcgacagtgagactccgtctccaaaaaaaaaaaaaaaaaaaaaagtgaaatgtgaaccaatttgttgagttcactgagcagggaagagtccagtctgattgaaggatctgattaagatggagggtgaacactggtcaaataagtagtggaatgggagtggatagggttgacaagattattttgtagttgcattcacattttacagttgcaaacatagcattttgcagttgaatttacatttatttacttaaatctaacaaaaattatattcagatttatttatatgagatatgtaaaacatatattattattttccttttattttataaatgaatatactggaactcagagagtgtgacttgtccagcagcaccaggttttcatacacaaaaccgagtcacatttccaccatatcttgccatttctcttcctttgctagatatacaggtaaatttgacagccaatcaaagcagactcttttcccgtcttctacctttgacccatggagtagctttcaagacattggcacttctctactgaagcaaatctgggtcaagatgagatgtatgctgcccatttcctgagtccttcaggaaagcaagagaggaattttgattaagtttagctcatcttttcagaacccaggccatatgtggtccatagtgtcccggatatgcttcacagtgtggaactctgctctgtattttctttaataaggacacacacacaggaaaatttcaattgaagacctcacaaatgttttgagattttattgagttatcatctgaacattatggattagtctaggatttcacatgatagagtgtatgggcgtatgtgagtaaacaaatacacattgtaggggaaggtgctgaaatgttaaagttaacattcccaaatagaaaatgggatagtttgcaggttactttctgaacttcacttcgtgttaattttcacctaccagttggtgggtagaacaacattaaacacattttactttagtacccttctgttcttatctggagcatggtaatcccaagtacagacagaaaaagaagaagcagatatgcgattaaaaatgaaaataacataacaacacggattattgtgatagatcctgtacctttttaaagactctgacattccacttaggagtaagatggaaaagtcccttgttctaaaatttgaaaatgataaaaataagtcatattaat

SEQ ID NO: 65157 - DNA, 1072 bp, Homo sapiens
ctttaaaagatacagcagtaatccacaagcctggtaagcacttccatccgctgcgtatgtacacggtgcttccctcctgctgctgcgcaaagacccatcgaacagtgtcagagcaggcgctcctggttcttggtggcagttctgatgaaaaattggtttgctgcaggatactagcagccacttcagggaattctagtgttgtccccaaacatgtcataggatcttactctgcagatgtgtgaatgaaatgccatgtctgagaatgtcaatagggaacaaaagaaggcattaggaaatgacaccactgatgccacaaagtagggatcaaatccaagaaaaagtaatcatattcccagcctgattacttttgagtggtagagttgcccatttactggtggtcattaaccaggataaataaaatggagtggtgagaaacctgccttcacaatagtatctttgttttagtatcatcattcaggtctcttcataatgatggctaaaaaaaaaaagagtcaaaatgtagaaaatagcaaaatgcccttaaaagaacacaatttgaaatgagatgacatgatgattaagattattaggaaccctgaaagttaagcatatgggctttcctgcttcttaatggttgtgtggtccttttctacctaggagatgtaactcacagatgtaatatttcttacttgcttctgtgttgcaatgttgtgttatcatttttagagcagagctactgtttaactgtcaagcagaaatataaaaacaaaggaaccagttaaatctaaccggagactaatacgactaaatttcattgctaagattggaatgccgtctgattgcttaagttaatataaaagtaaagcatttggatcttggaaaaattggtcacaggtgaatagagtgcaatttatagcatcagaaagaacatagtactccataatatctactccagaacttgttcaggggtatggtagagtatgtttaactaaattcctctgatccctgcttttagccagctttgcctggattggccacatcttagggctgtgtggacctggttcattcccac

SEQ ID NO: 65158 - DNA, 1031 bp, Homo sapiens
catataaaatcattaagctgggagatatccccagacaccaccttgccctttccttgctttcataaccaattgcaactaatccagtatttcccaaactgtgttccttagaacatcagtgttcccacatgttacaggttgctacatgctctatgccattcagtgattctttttgtttgtttgttttcgagatggtgtcttgccgtgtcgcccaggatggagtgcaatggcacgatcttggctcactgcaacctccgcctcctgggttcaagcaattttcctgccttagcctcctgagtagctgggattataggcacccgccaccacacctggctaatttttgtatttttagtagaaacagggtttcaccatgttggcgaggctggtctcaaactcctgacctcaggcgatccgcccacctctgtctccaaaagtgttgggattacaggcatgagccactgcgcctggcctccattcagtgattcttaacacacattagcaactgaggataaagaatcctttagtaaaaatctatttaagtgtgtttaacttggtatttggtaaacttactaacctctttttcaggaacacaccttttcatatctgaggggataccagtattccatatgacacagtttaggaatgctgacctaaccctttctagaaagagagcagtcttctttcttaatttccttacctggttttggaaatgggttttggcacttcccaaatggtagtctggttccgaaatgttacctaaatcccttctgctcatgacttcttactctgggcaaaatagctctgtgcaagacagactcacaaaatgttcaaaatagaaggggcctcagtaattagccatcagctgtctctctgccagatcccggcctgccttatggaaggctaagaaaccattgcttacacttaaactgcatcctttcataagtccctggcttctttcacagaccaaataatacaaattcctttaacttttcctctctttttttctaattgtttttgttccttttccagattgt

SEQ ID NO: 65159 - DNA, 1029 bp, Homo sapiens
gtattattatttttatagaaattaatatgagattgtttcaaaagaaccatgactttaaaagttcagggacagtcctgagtacatgtacttgaaaattgaaataattttgcatcctgacaccaaactctttggaatgttgaaatttttgggataggaatacaaatgcagtttttgcacaactttttcaattctttttttgttgtatcccctcaagcccatccttcaaaaaaaaaaaaattgtccccagagatttccaactcaagaatttagagaatcagctactagcctattaaatttcaactgtagcaaatgttaccctgtttgtattattaggctgtagtgaaatgaattccttactgacaaataaaatggtaggtgctggctgcttccctttggcatgagataggctatgtcatggatagggactgacagttctgagatgttcaaataagaattttctatgtacttactacaaataaagtaaaatattggcttaagtatttttccagtgtgaattatatgctgaaaacaggataaaaagaagatataaatcattgtttaacaggtatcccctgaatactgattcctgggacagtagcttttccatatgggaacaataggcgtcttctcatagctctgtgtgttagtcttcatgtgatggaaggtgaataaggagaatgtctttagcacttgggtattttaaagatcttaagcagtgcatttcgttgattggcttgcttcattcttgaaagagttgtgtgcattaaagactgaatcaaattgcattgtattttgtgtgtttcctgtgcaggcatctgcattcaggtgtaggtagtactgttttcccatcccagaaagggcagggtgctcagttgcctttataaaggcaatttcttggttgactgcgattgagtgcagaattataatactgaggacttaatttataacagaaaaatgcaggagtgcaaacctgttaaaccccttatacatgtataaataaggtaaacgatggcagattagcatggaata

SEQ ID NO: 65160 - DNA, 1051 bp, Homo sapiens
cctgatctcaagtgatctgcccgccttggcctccccgtgtattaggattacaggcgtgagccactgcgcccagccagtgaagaattttttaatccttaaactcaaagggaatatagaataaaaacaagtctgttttcagaacagttatttagctgggcctctagaaaaaaataaaatattgttttgggaacctattatgtgaggaaaaattcaacaagtatttgttagactttgtgaaagtcagtatcaagtagaattaatcagtgaaagagcatttccacaacattaaatgcaaaaaaattgaccaaagattatgagacaagaagttatcgttgacttcttgagttaagcccttaatttccacaaggtttagcttatcatgacagataacactcttttgcaagctacattttgttttgaaaaggtaatggtcagattaataaaccatgattgcatcaatattagacttgtggtacaatttgtagatccaatagaaatgaaagaggatctaacagtctgtagtcaacttgtgttcatatagtcctttggggcatagtaatacacattgaagcaaataaaaaattagaaatgccttaaaaggcaagcctttgctgggcgtggtggctcacgcctgtaatcccagcactttgggaggccgaggcgagtggacgatgaggtcaggagttcgaaactagcctgaccaacatggtgaaaccccatctctactaaaaatacagaaattagctgggcgtggtggcgggcgcctgtaatcccagctactcaggaggctgaggcaggagaatcacttcaacttgggaggcggaggttgcagtgagccgagatcatgccactgcactccagcctgggcgacagaacgagactctgtctcaaaaaaaaaaaaaaaaaaaaggcaagcttttaaagtataaagtaatattttagcatgtaaacttaaaagtgagaattacaacagaatcaggaagtcttagagtttcaggagggaaaaactttttttcctcaaaatgcagtagattgtataattattattcta

SEQ ID NO: 65161 - DNA, 1040 bp, Homo sapiens
taagaaaaagaatgaattcgtaccggctgcatgaactactaggttaaatcctgccagaccctcacctcatgggtcctgtgtactatctttgggttcctgttgccaggctccagctcccattaccttcccttcctactctgggcccctccaacagtaatagtctgtgattctttgttgttgtttatccaaggaagtgacataatcaatctgagctacattttcttgctattaatctggcagtgctatatggaaaggaagaaatggggtgtgggagtatagttagaattatattattgtggcttaaggctaaggaaacaatttctgacactggtaagggacaaaaggtatggaaagaggttggaagggacattattgcagaacaatcaacaagattaggcattattgggaactgggccacaaggtagaggaagaaagaatgataagtgactctgaggctttgagcttgggtggctaaaaatgtatagcactggaacacagcttttactacgtgatcgcttgtcgtacatgaatttcctgtaaaagttcactcactggtgtaggctctagctccttatggctctgcattatttgcattttaggacatttatttatttgtgagcaaatattgatagatgctactgttttaaaatcagcaatttctctggtcagtctcctccacttcccccaaaaagtagaaattgctactggaaacacacacacacacacacacacacacacacacacacacacgcacacacacgcacacacacacactatgtggtttagaagaaatgatcgtcaccttcttaaagttacaaattaaaaaaaaactgaagtaaatatagttgaatgggaacataaaatatttgaatgcaaatgtgagatttagtgaaaattggttttattatgtttatgatgcagttgtttaaaagatacaaatatgtgttttaggattaaagaatctttttgaattttgtgttcaaggtgatataaaagttaaattttagtaacattcagagaacagactaatgaaaagtagc

SEQ ID NO: 65162 - DNA, 1057 bp, Homo sapiens
atcagtagagaaagatggatttttttcaggaaatggtataagaacaattggctgtccacttcaggaaaaaatatcaagtgaggctcctagtcaggactgtcttgattgcaaattacacattcagctcaaactagctgaagccaaaaagagagcggacatattgggaggatgttaaggtatcacagaaaggagggaataggtgaacagtattccctcaggaatgcaagaagcagcaaacctcttcagtcctcatagactagttactctttcatttatatcatatgttctccacttcatttttaactacggtaggctaactctgtgtggcagagaatgtagcctttagcagcttccaggttttgtcaccttttgaagaaaagtgttctctggcatgttgaaaatacttgaggaagtactttgatttgtgtggccagggtcacatgcccactatccccttgtagggctcagaccaatcactatatcctgggaaactgggtcatgtaagacttcttacacatatgacatgttggtttctgcaggtgcgtgtgtctcagtgtgtggatttggggaaggatgaacgtgaaaagaaagcctccccaggaaaggaggcgagtagcacagccatagatagccactgggagacctgtcatgagctggatagtcaccgtaatttttgtctgctgttatctctgttttacatcatactaaaaaacaaatttaaagtggattagagatttaatatataacattataaaaatactaaaagaaaacagtttttttgttctttttatcttggagtgtggaagaccttccttagtatgataagaagaccagaaaccatacaggaaaggacctaataacataagaggataaaagaaagaagagaaaccttatttaaggcaaaggcagtaaaagcaaaattgcaaaaacagcaataaaaaattcaagacagatatttttaacacatgtgtgacaaagggttattagtcttacatataaagagttcttatgaatctctaagaaaagtatgagcctcccaagggaaaagtatgcaagg

SEQ ID NO: 65163 - DNA, 1235 bp, Homo sapiens
gacttatcttttccaccctccttactttttatcttttctagcgacatattagtatatattctaaaaagcatttgtgtgtattgagaaaattcagttacaaaaaaaggtgactatttccgcttctgtatttgaaactgtggtggtgggctatggggaaagagagaataagaaggtggatttttatacatgtttaaaaaaagagaaagaagtccatgcatctagtgcttgccttattatattcaccatgaaaagtcagtgagggcgacctatttactgtagaggcatgttcaaatctagtgcattgacaaaggatggggccaacctgggaaattcttactgtggctagatcaagaaccttaattgtgcgtgcgtgtgtgtgtgtgtgtgtgtgtgtgtgtgtgtgtgtgtgtgtgtcttcctgtcagtgtagttctaagggtgaaatagatttatatttaaccaaagaggaaagggggagctattcctgggcttttgctatttaaataatcaattcatgagaaagaatcagtgttataagaaaaaattgcagtggtatttaaattcgaacatatacagaatcctttgctctccaacatagtatgcagtttcatgtaagctgcttcaggatagaattgtgagcaagggtttgttaccagcaggaccttttaatacagtccttcagcacatactgttatttttggtgcactagattgtattagttgctaaaccctaattttctaatgtactgcagtaatgagtaatccagtcttttactctcagagtcattttacattgtacaagggctacagagccccaagccgtcacccctccccactttttaaatatcactattcagacattttctcttctacttataattagattgctaagttattttggaattaaagaatgctaaaaaaaacttttattgtctgtgccaaatagtatttttctttgtttataactaccagtagtgtcatcactgtagtgcaggtatttccttccagcacctccccaccctgcctccatccttcctctcttttccactgaggtgagaccattatgtttaatgaaactctgtttcctatgtgacttgtattatgttctacccactaaagtataatagtagagtgaaaagtcacttgggattactgccagaggttgttcagaagaaaccacatctagtaaccctgttatatctggcacagttcatactcagaagccagcacaaaaag

SEQ ID NO: 65164 - DNA, 3910 bp, Homo sapiens
atttaatattatttttgtcttgtggcataccattaccaacccttttgacagagaagatatatgagggaaatatatgcacaaaatgattagaaaggcctctgtgagattgccttagaatggcttctaataaccattaaaaaagcagagtgaagcctgacccaaacagtggaaaacattaaatcctggcttttctcttgccctgtatgacgagctctggtttcttgttgaggctgtcatggcaaggttttttggtttgggtttggtttgttttagtttttggtttctcttttgccatattgatctctcattttgcttgatggggaaatactttttttgcctccagaagtgggtttcccttgcatattagccttgttggtgtgctgccccataggaggatggccccagtgctattggcactgtcctgtgtacagttaattaaacctcctgctgtggacctggatttctgctgctgctattcactgatgtgtgtgaattgagtgaagcacatgtgcataagctcagggacactcttgaaaacaaaccctgaaaatagcaaaagatggagtcagggcagagccttcagctttcaaataagtttggtaatctggctagctgaatgccagagctcacaaagctgagaattgcatttctgaagataagacagactctttttgtgtttttatcttttcttcccaaaatgtattgagttttaatacggtactttatctctgtaagcaagaaaacagagccagttgtgaactcttgggctattgagtccaacccagtgaggagtttatcctcatttttctggtgaccacatctcaaggtaaaccatgagcagagtcttactaagacacctgcctgctgtggtctcataaaggggtcttggagcagaaaggggttaagaaactcacagaaggcaagagtagggcttccaaaaagtctagtaacctacgtgttttagagaacagatagtgatttcctttgaagttaggccccttctctttttcatttaactaaatattcagagagagaaacttgatttctaaccattctttttttgaatacattgtagtgctttgagtccttgtgattctgtttactaggacataaaatgctaattttagaagctctaaataaattttttccaattcctagcttgcttacttgggtaaaatatagcaagtaattagactggagtaatagtagtgtcctaaaaacatatcagccactggatcagacaacctctctgttctttctctacctttcccaactcccctcagcaagttttgactatgtatttttatatgaaattaatcagccaggaagtatattttcagcctctcctttgtgttagtacctggtataataatgtgtgctaatgcttatgatctttcatagggaaaaagaaataaacacacatggtagaccagggcagtacatagtgaagagttagcatgtggtatagataatgagaagagagaaagcaagaacagcttgggaacccaattgggactttgctccagaaacagaaagaatggaggcattctaagtcaggggaatcacacaagctaaggcagggatataggaatgaacacaaaataaagataagaactttgctgtatgtttaacacttttcataaaaagtgttgggccacaatcaaaaataggattaagtagttatgacaggacctggtactagaaggccttaaatgaccatactatccttgcctagaactagacttgctttgaaagcttcgatcagttcctatcttttgaatggaatactttagcatttgaagggtaaaatgaatttatattggaggaaataaggtttcattggcctgtctgctttttgtatatgtttgttttgctaaggcaatatattcagagaattgaatcagtgctttatcttgtagaaggaagtcaggcatatagttaagaaagcagatttttttttccttaaaaggaattttatttcctaattgtgaaattgtggcctgtttgcttagaaatgagaatgtttatgagtgaaagcacaggtttaatgtttaaaagagtttggataaccgttgcagaagcaaaatggatttctaacattgcttcctaatctgggttgcccgaaagagtaagagaagtcctgcatatccctgtgtgaaggttacacaggttgttacttgaaatgctgcttgtttggaaaataagatatgaaatccaaatgggggtggaaaggggagggggaaaaagtagtaccggggtcactggaagtgtaaagattgggaatttctgttgtaagttttcactatagatttgagtaggtcagctgaccctcaaatttctaattacttcttttaccttgcatgaattttctttttttttcctgctcatttaaggtacatttggtttaataatgtattctcaataaagccaaaaggtacctctagctgtactataggacagcttttgaatagtagtttgatttattttccagtttgttttcctgtgtcttgtgttaatagttgctattatttatctcatttaaacagtagtgcttaggttgaaacttgattctagtcaattttattatgatgagtttaccatcttctcaaatgtagtactcctctaatgcattgttactctatgaaggtaaaaacaaatttacagctgttaaccacaatcttaacctttcctcagtttgtttgatttactacaaattaaattctgtgcttgatataaatcattaagtatataatttaaagcagttgctgcgatccatcttttactgttttctgcactcacatccaaatgtggaacttcaagtctgaaaaacagtgaaatgattagaaaactgcccttctggagtccaaagtgagcattcatttcaatgtgggtatatgacagcggggtcctctcatctctgagtgggagatgcagacattgcattcaggatggaatgtttgcttcttgacttgtctgcctgatttaaatattcatacttcaccagaaggaaaaagctgctgacttctaaaagtgggtcagtttttttttttaatggcccttttggcactttgtaacgtgttaatactgccttagagatggagaacagtttggcagagctcgtctttatcacttcaggggccaaagcttcactaggccagtggaaggagaggcattgcagatattaataactaatagaccgtgatatgggctttacttgccattctgtttgcttttctagatatagaaggtagtatgttaaccagaaaggattaatttgaggaaaaccttgtattgataaaggtgatgatgtgggtaaacagaagtaacctgtgtcttcagatgcatggtgtttctgaacaaattccacaattgcataaatctgttttatttttctatttggacatgataactttcgaaagaagtccttggatagaataggatcattgataggttgtcagtcttattcccacatcatttatttctgcttaattattatttaaagtgtactttacattgattgaatttcttacctctaaaggacccaaatggcatttaaacatgaatgccatctttttatcctcacaaaattaaaatttcaggtatcttttatggaaaggaggggtaggacagtaggatgagaaaggaaggagagttagagtaataataggaattctagatggagagagatctggagatcctgattaccacatgtattagttcattcaggctgctataacaaaatacctcagactggatcatttataaataacagaaattcattgcttacaactctggaggctgggatgtccacgttcaaggcatcagcagattttgtgaggacctactgtctgcttcatagatagcaccttcttgctgtgaggacatagcaagaaggtgctatctatggcag

SEQ ID NO: 65165 - DNA, 1050 bp, Homo sapiens
ctcccagccctcaaacaaaaatttctacatggatgttcatagcattattcatggtacctaaaaagtggaaacaacccataaactgatggatagttaaataaagtgtggtatatccatacagtagaatattatttgacaataaaaaggaatgaagtactacatatagaatgatacatgctacaacatggatgaatcttaaaaacatgctaagtaaaagaagccaatgacaaaaggccttatactgtatgattctgtttataaaaaatgtttagaatatgcacctccctggagacagaaagtcaattaatggttgcccagggctgggggaattgtggatatgtgtgggtagttggggaatggggagtgactactaatgtcacagagttcctttttggggcagtggcaatgttctggaattaattctggagttgtgcaactgtgaatatgttaaaagccattgaattctacacttcagatggatgaattgtgtgatatatgaattgtatctcaataaatctgtttaaaaaagtattacatatttcatttggtctcagggcactgaattgtcttttaattcaaaattgtactggctaggagaacccatattttcaataagaataccagcctaataatggtaataacttatttgcatagtgtgccattgtttacccagagttttcacatgctttatgtaatttgatccccactggacctcaccatgcagatgaaattgacacaaagaaaaagtgacttctcttaagcttacacaaccaagaaatggtagagcaagtatttaatctcaggctttctggttgttagtcactgccttcttgtcagaacaatgtcagaacattgcaaagaaaaaataatatctttcagactcttaattatgctttaaccctttcagttcttgaatgtgactagaaaagtcattcaccttctctgtcttgctttccttacctgaaaaatggagataataatgcttcctaactaaaagtcatttacctttttgtctcggtttctttatccagaagaacaagccaggaatat

SEQ ID NO: 65166 - DNA, 1565 bp, Homo sapiens
tttttttcttctcagagttcagaaaactgataggcagtgaggttgaatggctagtgcagaggtattcagtaggtatatgagtgaagactcttctgctttccagtgatagaaactcaattcaatgttgttgaaggaaaagagatttattggtatatataagtagtaagttcagggatatagctgctttcaggcatggatggatttaggagcttcaggacactttctccctcttttggcttcatttgcttacaggctgtcctgtactggcagaggttgcctctggcagctctaggtttacagcctgccatttaatcaactccattgaagagggaaagttttttttatttgtttgttttttcctggaagtaccagcatagagcatgggcacaagttttaggtccattcttgaatcagtcatccttttgtggccagggaactggagtcccctcattaggcctgggtcatatgctactcctggatcatctcaaccttgactattgactattcctttgactgttttcataggagtaaactttgggaggctaccttatatttggaattctactagtagtttgaaacacatatgggggaaagaaggcttgatagaaaagctatttttggatattttaactgttccaaccattgcaagaggctcctggtttctgtacagaagaatttttgtcccagtttatcttttcttcttctgcatgtttccccacccccatcacctttgtttctgcttcttagcttaagtccattccttcatccaatcctttgtcttcctctaatatcttccttcgtggtagcagagaccagtgtcctcacccccttgagttgaggcatgatgaccattctcttccttcaaggaaagtactacagaatggaattgcacattggcatgcttaaaaacagctggttaatgagaactcagtttttcttgtgtagacaagaagctttgtgtttctgaagaccaaagttagagtactctgtttgaggtttccttaggcaatttcaacccatttatctctcgaggccccagaaggagtctggacactggaaatgaaggcctagtaaactcttttgtgcccaagatggtatgagaatggaggtgggaggtaatggtaaatgctctggttttcattccggctgtcacaagaataaaaatgacctaactgtattttgggcccccaggcagcactgaaatgacatgccacctgctgacctaatccatttcatttctggtactaggatagccaaagcaatttgctcaatttgcaattgactatttactctttaaagcagcaatgattagatctagtataagaaaccacatactttatttatcaagaattaaaacttgaaaggtggaaagttatcctttttggaagaagccatttaaatgtggtgtattttacctcagagagactaactatgcttttagaaagctactttttgctgctgtttcccaggaaggagtacaatctgctgatgaaatttaagataacagaagtgtttctcagcagcagctgaatggcacagagaactcggagactgctatatttatc

SEQ ID NO: 65167 - DNA, 1048 bp, Homo sapiens
ttcagcctgtatgaaacactgattaaggttagaaccccatgctgagccatggggttctttttaccagtcatggtatacatataattatatatataatgaagaaaaactaattgatgtcaaagatgttgataacatcttaaaataaaatatcctcttaagaatgatttcatttatacttaatatttaggcccagcaactttggaggttgaaagtatagcacatttatgatttttcttcctagctcttgcaaaatattagttgtgcatttcttgcttttatttatacacttatatcaaaagaggactagaagttagtaccctttacttttaggtatttgtttcactaataattctttcatattgatattttgtaaatcagttacatatattataaaaagtgttttattctgctatccatgagagatgtgatctagtgttctgtgaaaccaaacatttatcaggacactaaatcaacttctaaaatacacattacatttaattacaaattttgaattgaaaatgtaatcctaatagttcagttctgcccttagaataataatgctttgggagggggcacattactcgaggcccttagattttcaccttgttgtgtagaggtagcttcttttcatccctgatttgccttcatgtgagaattattcttctacttcatcttgtagcacatgtgtatctgcatgggcactcacacacacacatgccccttgaagatggaactgttaattttccctttctgtgatgcctttgcttattcatcatggtaagcctggtaagatggcttggtcagagatgtccaagaaggtggaaaaggcttgttaactggaagtaaaagggaaaatatttaaagacttactaggtgattaactgctttgataaagatttcagaggctccaccagggcacatggtgaaaaactggtagaaatataatgttttcttatcagcactagcagctaggagcaatttagcttcatgaatatctttcttcttctatccctaccttctgttttagttaaaatattgttagctcctg

SEQ ID NO: 65168 - DNA, 2219 bp, Homo sapiens
tcatctaatataggaattggggaaaaaattaacaactcctttcctgtggagtcaagaagcacaaatgaacttaccctgaaaagttctgttacctgaaggaaaataatcaagtgaaattgggggagggtgttaatcgacagaacttgaaatttgtttttctgagtatgtgattttatttattagagattctagaagtttgtcttgaagttgagacaaattcacataagattttgagttaatccaccagtgccttttaattataacatttataaacatctgtcataaaaactgatttctgcttatcctatgatgtgggttcatcagatgaaacagtatttgcaggttatcaaaagtgctgcccctaagcctcatcagttcctgctaatagctgataaaattatatataactctttaaatttctagtattcctttttatagcttcccttcccctagctcttacttgcttaattatatactttatgggtaaagtggttttagccattacttcagggtatccttctgaagagaaattgattagttctccaaaaatggaaagactagtatgattctgtagggcagggattggtaaaactatggcttgaacctgggcaaaatctgtcctgccacctgtttttgtaaaattattagaacacaatcacactctttacatttacatattctctatgactgactgcttttgtgccacaatgacagagttaagtagtcgtgacaaagacagtatggccttacagtagttactatctggttatttttagaaagtttgccaatcttactctagagaaatttaaccagagaggcactcaactcagagatactaggcatcatgtaacagccttgggcaggagtgagtgctacactgtatatagactgtatgtacactgaaaacagggtatatggtgtatacagaatagtaagagctccttctcttataaacatgccagcccccccggcgaattcaattcattttgaacacctcatttttttagccacttttattttttattctcttcgtctctattcctctccccacttctctcttataggtttattgagtcataattaatgtaaaataaatgatacaccttgaaagagtaatttttgatggtgtgaaaccgtcatcacgatcaagatgagcatatgcatcacctctgaagtgttcttggtcgtctcgctcatccttctgtcaatccagtccccaggcaaacactggtctgctttttgtaacccagtttttagctgttacaaataacattaatttgaacattcatgtccaagtctttgtgtggagatctgctttcatttctcttcagtaaatgccttagtatgtctgggttgtatagtaggtgtgtttttaactttttaagaaactgccaaaatgttttccaaagtgattgtactattttacattcctttcagtagtgtatgagagttctagctgctccacattcttagcgcttcaatcttaaatatgaacatagccaagaatcactagatatttaagggaagctgctaatgtgcaagtcagaacaggccaagagaattggaagggaccattcaaaataactataaatttagatccctagatccgtaaaagaagatattgcattagtgaaacaaggagaggatgctagaaataaaggaacaattagaaaacagaaacaattcttgatttaaaaaaaaaggttggaaaacaaaattggagttgtttctcaataaatagatggaagagacaaagggggatagacagtagaatagagaaaaattttaagagggtcacccagaaagtctcatgcctggctaataaaagttctgagacaagggaacagagaaaatggagaagagaaaaccagccaataactaatataaggaaatgtcccacaaccgaagggcatataattccagattaatagaatccactgagtgcctaaaactgtgaattaaaaaaaccccacaccctcataccaaggcacaacgtggtgaaactttagcaaaacaagaataaaagatcctaaaagcttccttagaggaaaaaaaaaaacaaaacaaaaaacagttgcaaacagggattgggaatcagatgtcatcagacttctcagcagcaacaaagaaagctagcagtcattggaatgatgctttacaaattctgaaaagcagtgatttccagtatagaattctatacccaacccatctcttgatca

SEQ ID NO: 65169 - DNA, 1100 bp, Homo sapiens
tctggcttattttgttcaacatgtttatgagactatatccctttcttttgaagtagtaaaaaactttttacttggaaataattacagattcacaggaagctgtcttttgaaattttaaatcactaaagaaaaaaagtttgtcatctcttggatgtgcccgccctaacatctcatggcatagtcaggtggtttctcttctgtgagccagtagctccttgctctgtgacttttgtgtagctcttaccacatatcttttaactatttgtttgtgtgtcatttcttcctctctagattgtgagcctctgtgaactgtgatcccttcacccttatacacccgctttataccctagtgcttcacacacagtggcgcttaaacaacttttgttaaagaaaaggagtaaattctagtcctggctgtgctagtcactgacaggctttgtgtccattgaatttctctgagctggtttcctcaactgtaatatagatgttataattgtatcagtacagatgcttttagctgtagtttagttgtagttagaaagtccaactaaaagtggctaagatagtaagtgaatttattgattcaaataaggagaatttgctagaattgctcagttcagcagctcagcaacactatcaggacccatattcattctggtcatctttcagcactgccatgctcagcatgtcggcaaccactgctgttgtcatgggatggctgctgtggtgccaggctttacatcttcacacatcaacatcctggggcaaaaaaggaccatttcttattaaatatctctttttatgattatggaaaactttaattagaagcctttcaacagactttgcatctcattgaccacagttctgtcatatgccaatgcctagttcctggcaagaaggaggagtccaagactgatttgtgtcctggagctggagattttctccttgagcatttggaagctagatacctaaacaaaactcttttttgttatcagggaagagaaagggtggagaagaatggatattcaagaaagttaacaatgtctgtctctataacactttcctctactaatgtaaattaaggataatgtatatctaaa

SEQ ID NO: 65170 - DNA, 1363 bp, Homo sapiens
ttactatctctttgagaaagagatgcttgattgagtaacttatactttaataacgtgccacattattatagggcattttacctgagtatggcagaggaaatcaagtcagttggttacttgtaccagatgcatcagtttgctgagttaaggcagagcaatcctcttgtaagtttatcctaataacgtatttttggtgctggcaaatggaatgacttttaaaattcaaattgaatttcttagcccttgtcatcaggtgttatatatgttgacactgggctactagaatctactgactggaatctactgtattttttttttccactttgctcatctattgcttagctgagagcagttgcttcaagctatgaatatcaaatcaaaggccaagtttgtggaatgtttttcaagcctgtggtatctgtcttttttcttttgcatagaacatatctgtatttcagaatgtttagggactcttccactctttggagaacgttaatttttgagtgataggcagtgtgaataacgaatgctttttaggagccaatataactgacaccacctctctactatatcatgtgctttcaaataatgtgcatatattatatatatgtatgctttcaaaaaatccattcccatttattcccttttctctaggatctgtgcttttcagacttctttatcattcagagtctgattcatctgttttattccacatatatttattgagagtttactctggtgaaaggcatgatactaggcccatggaggatgcagagaatgaaaatcttggcagtgttacttccatgtgactggttatgacctacaaggcattcaagctcattagcactgatacctttagcaactcattctcatacataccccataaattctctgctgtcacctttactccctgggctctctcaagactgtgccttcttcacacatcctcttctctacacctggaattttcttacctttttacctgattaattcctatgtatcctttgaagactcagcttaagcaaggtcttctataagcttttcttgacttctttctaccttccaagcagagttagacactcctcttctgtgtactcatggtacttggtacttgtgcctactttatttggcgctcattgtggtacttatttgcactcatcaagttgtattgtaattatttgtaagatcctcacaggcaaggactgtgtcttgctcacatttgtacccctcaagtctagaatggtagatgagcagcaagtgtttttgaatgttattaattcattatgccctcagaaagctggtaaggtggccaaggatgtccctaccaagggttcaccatcaaaagaaaattcccatttaaatg

SEQ ID NO: 65171 - DNA, 1026 bp, Homo sapiens
ccagctgctcaggaggctgaggcgggagaattgcttgaaccctggaggcagaggctgcagggagccaagatggtgccactgcactccagcctgggcaacacagtgagactcgtctcaaaaaaaaaaaaattatagtcaccatttcttacagatcttttcaatataatattagatgaaatacttttctgggtttagtaagttcatcttgccgtttatggaatcattctcaattttaaatttgaatatattttaatacaagattctgaagcttttgggaaagaagtttctgtccctcctataactagttatgtttctgatctataggacaacataatttaagctaattaggtaactgaaacaaaggactgggtagggatgggggaaccagaagtttgattctattcctgactctgtaatagacttgttgatagattttaattattgaataacttaatatgtctctttccatattcgtggaatgtttggattatgcattgaggagttaatgcacgtgtatccattgagtgcatggagttcttttgtaggtgagttctgtttaaaaggaaattgttggctgtagtcatggtggttaacttcatctcatatgtaacactttcatcttacgtgtaaagtactacttttctaagaagcttagaacatttaacatttaactcaatcacaagtgcatcattgtgatacataaactgagatgtgggctttatgacttaaccattattgtataatttatcagtatgagattcaatactagaatccagattgctgtactcttcattcagttttatttagtaactgtagacctttatctatcaaatattttttgaaataggacattaggcaaaataattacattgcctttaggcttcattaccttggagtcaaataagtaagttagatcctatagtccttgtgttggttacctgatatatgactatctccagcctctaataccagttactgtaaaatgttaccctccgtggttcacagccaaactagtgtgactggcac

SEQ ID NO: 65172 - DNA, 1069 bp, Homo sapiens
ctcccgccaaaagagccacttatcctctggcagaacctaaccaattttccttccactttaataactaaaatctgaattaccttatccgtatgactgatattttaagttaacattaattttttgttagaaaaatttaaaatacagaaaagtttgaagaataatgtcatatttcacacttaaccctttgtcatatttgcttctattctttttctttgtgcatttttctgtaatcatttttttcaatatttattagaaaactttaattatacaaataatggactcatatattctcttcttttgttttattaaaaaaagttgcatctgacaactttttttttttttgcatctgacaaaaccattgcagatagtcactatttcttgcggtagacactagttcttattcactgttgccacttcaatctttgatacttactcagtttctcccttaaaactatgtaatcgtatgctccatttgggaaaatacagcctttagtgagcatccttcatgactaaaactcagtgaatttcactgaattcttggttggaagggtctagtgcttttaaagtgtaacttgagatttctgaaagaaactctggcagatttcaaagtcagcttcttgacctgcagggcttcaatttgtggctgacagttttaactcagaaaatccctgacttgattggctacataaattatatgttatatagccattaagatcatggttttggaaagtattttaatgatacaggaatgtgctctgaaataataagtgagagtatacacaactttatgtgcattacagtcccatttttatgtttattttgtgtatatatgtatgtgggcgtgtaaacgtatgcaaaaacagtgtcagtataaaatattggaaggtggttaagtttacaggtggtttattttttctgtatactcttatgtatattttctaaatgctccacaataaattacgtttcgcttttaggatcagaaatagacaagaaataagatttaaaaaatttttttaacatcaagctcttgtctgtttcaggcatagttcacatttaaaaatctaatgac

SEQ ID NO: 65173 - DNA, 1536 bp, Homo sapiens
tactttgctaaataagggagagggcaagtggagaaaacctcttatctttgttgataatgctgtaaagcatgtagtgtgtgcatacttataacctccattttcctacttttgtgtgattagtggagctttgggttttctgtcaatggatactttctataaagaataagaatattttagtggacaggtactcttaccgtacaagatgctcaaatataaaacttcatgtaatttaaaacagttgcagaggagctgctcctgttttggtgcaaggagcctgtatttaggatctgtgcattaggtgatggtattatggccacagtgtaatgcatgacagatttgattggctaaatgcttcgggttgcttcatcatttgtaatgcagtatgcatagtcttcctgctactattctgttaacaaatgaaatatctttctcacagatattttttctttccaatcagaatgctgacttaaagaaacagcttcatgaactccaagccaaaatcacagctttgagtgagaaacaggtaggggaaaaggggaggggggcatatttttaacgttgtgttctaaagatatgtctgctcgaggcttctaagagaactgctatttttcctcatgtgtgaaaataagtgtgggcagccagacttggttttaattttgtttgagctctgtttatctatttttatttttggttgaaatcagtctctagagtatcccatggttatatgttactggcaaatacctaaaagcaatgtggcaggctgccgttaactgtgttaattaaactctatagtttacctataggggatggggtaaaggcagttagtgagaataggtgatagagaatcttgtaggtgctgcgtgtaccttgttacctgtcttaaagccttgagctgacattaaacttactgtggagagaatcttcttgtaagtagattgctctaaatgtaggtttcccattctaagtatggtcatgcctttatgttaatctctattagatattgacctactattacgtgaaaaaacttcggtgaaatgttattagacttattctatatagggcaggagaagaacatcttgcttttttccaaggacacctggaaaatattctttggaattttttgtatgatgacctccactttaccaattcaggcagtgcctgccaccaggtggagtgtggcaattgatagagctataagtaaatgtttatggtaatcccacaaagcatttgttttcttgtttcttccccaccactctccctctggttagaaagagtggttttctgtcttggagtaggtgaatatattaatcaaaagaataaggtgatttgcagttgatatttcatgccagtgacattttattgaggatttttgactaaatagttctcaataactgatttttatgttgttacttaatgttatttagtgaaataataacaatgagaataattcatttctggagattttttattgtgtttctattgtgttttcatttaactgaggggagaaataaactttgagaattatgtggaagagat

SEQ ID NO: 65174 - DNA, 1006 bp, Homo sapiens
agcgtaccacacagcaggtctgaaacagcaaatttgagctgggtttcagggttgttagaatagtagcaagagctgcgcatggtggcttacgcctgtaatctcagctactctggaggctgaggtgggaggattgcttgaggtcaggattttgagatcagcctggataacatagtgagacctcatctcttaaaaaaaaaaaaatgctggatatggtggtgtgcacctgtagtcccaactacttaggaggctaaggtgggaagattgctgaagcccaggagttggaggctgcagtgagctatgattgtgccactgcactccagcctgggtgacagaacaagaccccatctttaaaaaacaaaaaacaaaaaaagaatagtagcaaaatgtgctggctgactacttgacgttaaggagtggactggaaaactacaatgtggatttaagaactttaacacatagtagtttgggaccttttttgtaaggaacctattgtttatagtttagtatattaatataatcattcctctaagtatcaataaaagcttgatttttaaattttttttcttctttttaagaagttagggcgggtggctcacaccttaatctcagcactttgggaggctgaggcgggaggattccttgagcctaggagttcaagaccagcctgggcaacataacaagaccctgtctctacaaaaaattaaaaaattaaccaggtgtgctggtgtgcacctggggtcctagccactcgggaggctgaggtggaaggataacttaagcccaggaggttaaggctgcagtgagccatgatcacaccactgtactccagcctaggtgacagagcaagaccctgtctcaaaaaaaaactagtagttagataaatatatagtatattttagaaaggttttattttacaactaaacaatttaaaagtgccttgtcaccaaaagagagtgacaaatttttccattagatgaaaaattgacttgggtaatagcttattccc

SEQ ID NO: 65175 - DNA, 1021 bp, Homo sapiens
taaacactctcttactattcatattaactgtcagctttgagcataaaattaatagcttttatattcatcctttatacaacattttgcttgtgtgattataaacatttatttatatgtcaataatattttaacagagaaagcatatatttcactccagttatatctgtaatactttactatttttgaaaaaataatttatatggtgtcacctacacgattgttgatcatgacaaattgaggcatgccagaaatgacatcaaggtaggggtgttggttactaggctgagaccaaagccagaacatacatttgacgaaatagtgggacaaaagccacgctttgttgcatttccagttagggaatgagattagggctgaaattgagcttactggatagaaaatgtgttctgaaactatctggtattgtggagtgaaaacatatttttgttctttgtgttttctttatgaatggtgagatagttatgaaagtagcaatgtacacatagttgatgttcagtaaatatttaaataataatgtcctgtgatggacatctcatctttttggggaaattgccttttttcctcctcccttttttgatcttatttagatttgatggaagtcacatttaaattttcagggtatttactccatatggaatggagaatagtataaagcagaagttagcaaatttttttgtaaagggacacacagtaaaatatttctggctttgtgggtaatttatggtttctgtcacaactactctgctctgctgttgcacagagaaaacagccacggacaatatataaatgaatgagtatggcttttttccataaaactttatttgcaaaaacaggtggtgggccagatttggcctatgggttgttttgcttacctttggcatgaagtatatcctcaagaaatattgccgcattctggcggaaagtaacctaactttgttaacacaatgtcagcttaaagttactagggatttggatggtccagtaagttggccagctcgtcctg

SEQ ID NO: 65176 - DNA, 1074 bp, Homo sapiens
gcaggaggatcacttgagcccagcaagttgaggctgcagtgagccgtgatcgcaccactgcactttagcctgggtgacacagtaagaccctatctcaggaaaaaaattttttcaaaatattcagcatgtattcgtgaccagcctgggcaacatatgagaccccttctctacaagaaaaaataaaattaaacaaacaagattcaacatgtacctgccttgtttttgtaaactataaatacatgtctgtaatttgtttctttccgcacagaccagtctcttaaaattactatccagaaagagatctttctgaagaaaagaaaaagaatttcaaatgaatcttctaatccttcatatgtttttctacaactagtcctaacttttttaacccttttagttttattttgaaataaaatgagtaattggcatttagagtccttgctgaataaaacttcatgcctttgtgtatctctgagaagcagacaacaatctgatggagaaagtaaaagccatcggctcctcattaacttgagttgcaggcttattattgtgcgaggcactctttgacatttacagtcttcaagttaaaccctggttttaactttttcttttcctgagcattttgtttgatagtataatgttttctgatgctttatctacaaatccttggttaatgtcttcttgtttaaaaagatgtgcatattttttatggaaaattttgaaaatatcaataccccaaaaagaagaaagtaaataactgacagtgctactacctagagataaccatcagcaaattgcgaagtggcacctgacacaaattctagacagctcagagtattattatcttataggtcttcagtttgatagacaaagcatataatcttagttatatttctgtgtcttaaaagatggaagtttttcatgtttgttggtcattcttatttcttctgtaaattgttttttcatagatttttgttatcaatttttgagggccctaaatatataaactgtattagccctttgttatgtataatgttaagttctttgtgttttaacctgccgttcatttccagagtt

SEQ ID NO: 65177 - DNA, 3012 bp, Homo sapiens
caagattaattgaaaaaaatgccttttatgaggaccaaactaagaactagtgatgttaccttaatttgttaatgtaaaacaactgacagtagaggtcacttgttggggatgaaggagtagttgtatgttatttaaatgaggtgcatttcatttctatgtgtctcttaggaaaggaaaattatcaactacttacttttgcttgtcttgaaaaactatggaaaagtagcaatttaactgctcttgagttcttttctttgctgtaaaaattacctattgcttctttttttcttttgggttttaaaactttggaaacttgtgtgtgttttgttttttcttcttaaaatcagtaatctttgagtcttcagcttttaatgacatgtcataaatatgtgtgtgttgtctaattccattttcccgttcttctgttatagggggctagagagctgaaggagagccagtttccccaaaattggtaagtactttgactaggtagacatcgtgtgcctgatcctgatgctagctggatagttattcaaatattgtgatttttttttttttttggcaaataggctctctctcagaaatggggctttgctatttgcactaagtggaaatgaattgtctaatttcacgtagctatacttcaaacgcatttgtgtttctgctaatacagctaggcctgcatgttccaccgttcgataacctgttaaaatgtaaaagtcccgttttccaaaaatgtccttaatgcaatggttctggttgagaattcaaacgtcaagaaattcaaaagttcagattcccagccaggcccagtgggtgtgtgcctatagctccagttacttaggaagctgaggcaggaggatggcttgagccaattcaagtcatccagcttgaagctggcaacaaaacgagaccctcatctcttaaaaaaagattaagattcctatagtgttttgtgttacttaatatgctgttctatttgatggccttagtatatgtgcagagtggcttaggttaatttaactgtggaaacttgactttgaaatttgggactcgtgtttatttacattcttaaaattaatattggattagttagcttcatgtctgatagtacatttttagcatgtgttgttttatataattcttcaaaaggaaaaagagagaaaaagagagagaaatgtaattgtggggcatacaggcaaacattttttcctaatatctactttgagaggtttttttaatggctcttcatcattcttaaacatttctttgaatgcacagggcaatctagtgactagccatcaaacaaatattaactttattaggagagtgtgtattatgaaaaaaattacactcaaataagatagctggaatagggtagtcgcctagtgcaagactactcctttttaaaaaaatttttaaatcctctctcaaatagtaattaacttggtgggtggagtagatatagtagatatttggccaaggtttccttttgatagtttatggtgcttgtggtgtctctcttccttttggggactgggatttgaacatgtttaatggaggcacttgaactagttaatccttgcatttactacctttttattctacttgcctttctctcattaaaccttttaaaataaataatcaagatcctatagctctttactttgacatgggatggaatcttagagaagcgaccttaacccatttataccagaggttgcaaattttttttgtgaaaaatcagactttggcaatgaacttgagcagtaggatataaataactcccacaagcttagtgttccaataatggaacactaggtataaatgggttaagggccttctcctccagtattttaccttgtgtggcagtttcttctagatccctgacaggttgttattcaggtacatattgaataccacatttaaaaaaaatgtagctcattttctataatgtattctgaggaattctacttccacaaaaaataagtattattgaggtggggtgggggtgggaaaaggcttctgtggtcaagtaatttgggaaatgctgcattaaacaaagttaaacaggtttctttactgcaggacttctcagaacctttaatatgctaatgtgcattgtgaatctccaagagggggatatgatatgcagcattcttgaatacttctaatgacagggagcccactacctcataaggtaacccattccttttttgtacgactcttatccttagttcttccttttccttatattgatctgaaatctatctcccataacttccacttctattaagtatttattggttatgctgagactaccacacccacttgcattatcctttgtgtggtatatatttgtaagattctggccaggcttgtctggacagtttttttttaaatagtcattaaatattaataacattctggtaaatgtgacaactagttctaaaaccttggcctcattgtcactatgctctcataccttactccccaacctcctccattttcaatttctgtgtattttaaaatttactcagttttccttttgttggatgtggttgggataatctagtagacgtgcctgatttttgtaaagaaagttaggaaatagaagaatgtgtatattcagacagcctggaccccaggaagcagaggtagaaactgtatattgggctgagcactgatgatggtagggaggggtccaggacactacacagacttgtgaaggagggtgctatggggaaccctggcctggcccaaggcaccataatagcctgcacgttgcagtggaggtatgacctgtgtagagattccttttttaaaaaatgaggacccgccccccaccccctccaaaacaaatagagattagaaagatattttatactcacatacattcagacatttagatatcataaatgtaatgatatgtatgcatatttttttatttcataggaaacaacattattaaatataatttaatagtatagaaacatccaactagctaaggag

SEQ ID NO: 65178 - DNA, 1024 bp, Homo sapiens
acaaacatttattgagcatttactatgtgcctggtactgtttgaggcaaccttttgagtggcacagagtcctgtagatatcagtagtgttaagaatccactttttaataactgcattgttctacagattgttgcatgatttctcttttggttgagagtcatcctaaccttggtgattaaaattgttatttgcatgggcctgagaactttaaaaaggacagctgctaaagaaaaggcagaatagaatagcacattgactttctttggaaatgagtgctaactgcatgaactggggcccttttaaataattttatcgtatgtttggtataactgtacatggttaaacaaagatttacaatctgggagacatgaagctcttttgaaatattccctgaggcaatgagacactattggagtaatatcagtcaacaaacaccatatttaaggcaaaaggaagacatgtagttttagagcatagcatatagtggagtttaaataatttaatactaaaatattaagggaaaagttttaatttttgtttcctaatattggattgggatcccaaaacctaaattttctttctggcttcatcactgattagatatgtggcatagaaacaaatagcttttgtgtatgtggtttacaatctaaagtggtaagatgtggccaggcacagtggctcacacctgtaatcccagcactttgggaggttgaggcagggaggattgcttgagcccaggggtttgataccagcttgggcaacacagtgaggcctgactctacaaaaaaataaagtaatagccaggcatggtggcacacttgaagtcctagctattcaggaggctgaggtgggaggattgcttgagcctgggaggttgaggctgcagtgagctgtgattgtgccactgcacttgagcctggacaacagagtaagacattgtttcaaaaaaaaaaaaaaaaggtgagacacatctaagaatgtgaaaaaaagtttaattaaaattctgactatacattattataaa

SEQ ID NO: 65179 - DNA, 1121 bp, Homo sapiens
ccttaggtttaaaggatttcatgatttgtctttttttgggacggagactcactctgtcgccaggctggagtgtagtggcgcgatctcagttcactgcagtctctgcctcccgggttcaagtgattctcctgtcacagcctcccgagtagctgagattacaggtgcacaccaccatacccagctaattttttttttgtatttttagtagagacttctacgaaataattattattcaccatgttggccaggacggtctcgatctcctgatctcgtgatccacccactttggcctcccagagtgcaggcatgagccactgtgcacggccaggatttcatgttttaagatggcttatgtgatttttctttaaaactttatgtgcagacttttccaaaaatatttcgctagtgtttattgtagtttgttttttagaagagtaactcctgcagcgggttaagagaaagtgaggtctagtggaaaatgaactcagccaaggaatctcgggcccataagctcttctccagcttcactatcagctagctgagtgacctttggggaaatcacttaacttttccgggtttgattttctatgcgatttctgcagtccctacaaatagtcttatgagcagtttcatgacatcatgatttcaggatatcatggcaaaattctttatcagttcaggattggccctgctcctcatttttggagaaaatgccttggagataagatatatgtacattgtgctgccttttgttgaatatgacttttcagcagcatttattaatactttctcaaatgctgtataagttaaaatcccagtcccatcctcatcactttgaatttcaacatattttatatattgtgggtataagcctgtgttgattatacgtaatataattatcacctccgattctgtggtttaccttttcactttcttaatggtgtttttttgatgagcagaagttcttaattttaattttgtccaatttatcagtcttttcctttttactatattttaaaatggtaatattttacttcctaatcaacaacttggatgaaaacagttccagaaagtcattcatttaacaaataatgctgctggaaatcgatgcataagaaatt

SEQ ID NO: 65180 - DNA, 2185 bp, Homo sapiens
ataaggagtgatttactaagtctgatctataattaagaagttttcgttatgatcattagactcagaaaacagcttcgtgagagctatggaagcttgtgaataaggatttttgtactttatagagtgaggaagcaagatttcttctttctatttatttctgctatttcttctcaaccataaaaaatggttctaacagtttttgtttatattgtaagaagacttagaaaaattgttttgttttttattctacttaaaagccttcctgtaattaccctctggcctcaaagtcttttattagctagtgtggctcacatttttcaagcatatagaagttaatatgcactgttttagaacttagacactacaaccactggtcaagtaatagataatcagtgtttactacacccatctgtgaattgtggatttttattacttccatttatttatgtacagtctaaatctttgtagattttagctagtcatctggacttcttggacctctgttcctccatgaaatgaaggtatggatctgccctctgaggtgtccattctagttttaggctgtttgaaggcctactttcctaggtactgaaggaaatagagtactgtaaggcaggcagtggtttctaatcctggctccctattagaatcttttgggggaacttaaatacagatctatgggttctaaataagacataatatattcaatatctttaagggtagggcctgtgaacctgtattttttgaagttttatgtgttatcctgatctaggattgagaactacttgtacaaggtattctattcttttgtgtatgtgtgtgtgtgtgttctagttagggagatgtcatataggtcagattaaaatgtgaggcagtgtgtggttaaacttgaaaatgaatgagaaagaggataaacactttaggagtttaaacaaaggaagaattgggaattaggatggtttgagcagatctctgttaatcagtgagtctttatctggaccctagtgtgtgggtgagatttggatagttagagagagggtaaaaaggtattattcttgttataaggaagagcataagtaaaagttggggagcggaacaattctgattatagttttagtctttattttagtattcttttgctcctgaaactgctgtagatttcctcaataatttgagggagtgagccatgaagatatttggaggaaaagagtgttccagagccccaagaagggaacttgcctggagggtctgaagtacggaaaagaggccagtgttgctggaaaggattgagcgatagggagatgggacggcttcgagtggcagaggcccaaatcactcagtgcctgtgggccattgaaaggaacttcatcttttctcggagtatgatgggaagccactggagggttttgagcagaggagtaacaagatctgtcttggattttgaaaagcttactctggcttgcgagagaatataccttagcggggctagggtagaattggggaggccagttaggaggctgttgcaattatctaggtgaaaggtgaaggtgacttggaccagggaggtggtaggagagttgaggcaagggggtcatggtggatatattttgaaggtagaggcacatggttggctgtcggagtagatgtggagtgtggtaaaagaagagtcttaagatgacttttaggattttttcttctgagggggtggagttaccatttactgagatgggaatgactctgaggaggaagttaggggagaggtagtcaggagtttagttttggatgtgttgagcttgagatacctatttgaccagtgttgagtgggcagttgggtatatgagtttggaattcaggggaaggatatgtgctagagataaacattgggaattgccagtgtgtagatccttctatagccatgagactgtgtgagatcacctaaggggaagagttccaagaactgagtcctgggacagttccacattttaaggtgttggaggcaaggaggaaccagcaaaagaaaccaaagagagtagccagagagttgggaaagaaaatcaagagaggatggtctcctggaagtcaagagaaaaaaaattttgaggaggaagaaatgagcagtgggtcaaaagatactggtcaaggaagtgaagactattttctgttggatttaacaactgttaaatca

SEQ ID NO: 65181 - DNA, 1042 bp, Homo sapiens
cccagctgtaccatttgataaaggtctagtaggtgaataggtgtgtttactataggtgaattggtgtatattttattttgtccctgttcctaaaacattgtatctcatttctgaggagaaattccaacgagttttttaaaaaataaagtggtgtactttggctcgacaaatatttttaaaactaagcaattttataatgggttgtatagttatctttcaattaaataattgtaatcttactttgcaatagagtgaccagtaggtaaagcattatagttttaaaattagcatagcaaatatatagtattaagttttctttactttagctctttgcagaatctgtaaaagttgtttccgttggttgaatggaattgtggaaactttagaagtatatttcattttgataaatatgtgttagaaagagattctacaagcgtttgggggttgagttaaagaattatacaattttgaaaatcagtttgtccctgcttaatttgtaaaaagtggtgctgtatgtgacgggggtgcagtcccatttcagctctgcaggaccctgtccagccggtggtgctcctgtgtagagatgccgccggtgattgcccagactccctgtgttgcctttcctctcctgcttctctgcttaccctcttgatggtctctttccgtcccctgcctgttattcatccttcccttcaagccaccactgttttatttctatttctcttaaaaacaaaacactgttgtaattattagtttttaaacagggagatactgagctattatcaaaaccttaagctttaacagtttgtggggataccccctactttgggccctcagctggaatttggagaatggatagcttaaaatcacttgcacagtaactgaatatttgtaaaatactttatatctggactaagagagagaatagaaaaatacctttttacctcagaaattgctgtattttctggttggggtgagatagaggcaaagttgaggaagaggcaggcatgttacttaactaaaataagcattaatttattag

SEQ ID NO: 65182 - DNA, 2441 bp, Homo sapiens
ctactcccattgagatggcagtgcctttttctgttgttaggcagtttatagaacgcaggatagcttggtaagcgtcttctctgtgcctgatgtgacgtaacattgtggagtatgcagcatgcatgttaagtacaagtggttgtatttggcttgttgctacagcatttttgaagatgtcttaaaaagcaattatcagtggatggagttggatatgtgcaaattattgaaatcatcatatctcgaagaccaaactttgtaacttgaattattctatttagtatttgtttacttcccccaacccccaacacctcagagcagaattctttttctgaaaggaacagatgccgttaacttatcaggacttgatactaaaaagcctacaaaaatctttgtgctgtttattttctttatttaatctatatgcaaaacatattgtaattattgctgttagagagttttaagctgatggttcccccccacccttttgtgctcaggggagatagattaggaatgccaaattgacaacttggtataaagaaataatgaccattgaaataaaacaggagttcaaataaaaagcaaatcagatacaaatgtagaatgaaaatatcttttagtaaaatgttagcatgctgtacttggaacagatgccacattaattcaaaagagagcccagaaaatgtggcaactttacgatgtcaatggagggagctgcaatagttcctgttttcattgtgtcaggttctcagtacctttaggtccagtcctgttccttgtatttattttctgtatattacatgttagtatacaaatattaaatccgtgcctaatacttatatttgtgtaattaaatacattgtcatgctattagatattagtataaaaagcccaataacttatactgcaatagtcatgttttttgttttaaatacacctatcaagatattcagaatctgaagcaaaaattctctgcatccttcaaggcacatttatgataagaaggtagtctaagaattgagtctttcaaagaggcctagtgctttttaaatgtaaaatttggacaagttacaaaattatgagaattttgcttttttctcatttaaatttgtagttatcattggacatttgttatgatttttaagtagcttagactcattcattccttttgtgtttttttttatggtgtttgggaagaagaaggggtgatggaagggtactgtacacactgggatattttcagagtgacattcattttatagaagattgcacagggacgtctctgaattgcccatttcttgcagttcctggttagtgtgggtctgagtgtggagaaaggtgggctgggggctcttaaccagatttacagttgtgctacttcctgagtcgtgcagtgatctaatcatcaggggcatgtcctgtgtgcctgtaaagacgtctggcacacatgcttggaaagcactactagttttctctcagtgaagcttacaatttagtaatttggtaaaaaggttaaaagttttgttttcatgtaattcgagtgaaggggagtttatagcgtgtcagtagaacacagaggttaagaatgttagtgcaggagccactttgcatgggcccagatcctagctttgccacgtattagctctgactgtggccaaatgacttcctgctctgcctctgcctcagtttcttcacctgtaaaatttgaataaaatgaagtggttatgaggaataagtgagttaatgtgtaaactagtagaagtgcctgacacatagtaagtactaaataaatggtactgaagcttagttttctgctcctttcttctcttctcaaggattgagacaagtattagtataagagcctgagctttggcatctgactccagtatttgaatctcagtataaccacttaaagtttaatgtgtgaccttggactaattatttaagctcactccaataaagatgtatcacatacgtgctgcataccactgtgctggtcactgggacttcagtttcttcatctgtgatacagagatggtaataccagcctcctagggttcatgtgacaataaaatgaggaaatcttgagacactcaatcatgatagctgctcttatcattattattgttattattacagtcccactaaaagttcatgggaaaagagtaaatttggaacaatttagctggagaggttttttttctcccttgaaatgcgtggtgagaaagagtatagatgataaaagtgttatctaatgagttcttatttgtgaatacctctgggaaaaatagaaaatacatgggaatatgtcagttttaacagagcctgctaaatattttaggggatttaatgtttattaaaacccatagtgatataagcttttctttttttttctcaacagctggtgagaccagcaccaagatattgatgcagtttatagtagg

SEQ ID NO: 65183 - DNA, 3154 bp, Homo sapiens
ttttttttttttgacacggagtcttgccctgttgcccaggctggagtgcaggggggccatctcagctcactgcaaccactacctcctaggttcaagtgattctccttcctcagccttcccgagtagttgggactacaggcatgtgccaccacacccggctaatttttgtattttcagtagagacggtttcaccatgttgggtagactggtctctaactcctgatctcaagtgatccacctgcctcaccttcccaaagtgctgggattacaggcctaaaccaccacgcctggcccaatagacaaattcttgacatgtgtttacgtgtgtgtttatggtgtagttcttaacagtatacacattggtacatttgtgtgtatattataaatataaatgtactggtgtgttgtcatgggaatgaaaaattttaattatgagcttttgtgttttaaaaattttattttactaactatataaattttatttttatgtgttaatatacaaacttacataaatatatatatttgtgtttggagaagtgacatacacacattttggagaaatgacatagattttaaatgtttgacaagttgtgaacggtttttgtaccttaggtttatctgttgtcatcaataataaagagtgtttattatgtatagtgctaagcctttttacacataggatcttatttagttttaatcctcacagcaatattctgaggatttactattattatcctacctccattttacaaatgaggaagtagaggtttccctcggatcacataggtaacaaatgatacaacctggattcaagcccaggtttgattcctgagcccttgctcttaaatgtccaaaatgctatactaaactatgtaattcccatagatacctagaaatgaattactaaagaagttttcaatttactgaaatggccacagctacagtgtatcattttgaggctgtttcatgttgattttggttgggttaggttgagtagtttgaaaatagtaaacattggaatgggatggaaatgaagacatttgggacagtgcctgctttgtttatccttgtatatccattgccaagcatagtgcgtagcatggggtggggtctaatagctatttcttaaagtttggaagttgggcactttataaagcacagtgtaagttagtttaatactttttttagtaggtgcaaatggtttacattcactatttcagtcagtccttatataacgatcaacgttttagagtgttagataagtgtcctttcaagaaatattacaaaagctgtgcatctaagttagaaagtcattctagcaatatagatacgtataaagtagaaaattagtcattccgttctcatcctacttttaaacttttcctgtgcatttacatatgtattttatatatatatatatatatacacacacacacatttttaaagaagtttaattataccataatactctcaaagtttacttttttccaggtgactatttaaaaaacttgtttatttttgaaaatagggctcatgtgggaagtgggagtaaggttggaggaagagaggtgggtaagatttatacattaagattccaaacctaatgccttagattgattgtacctcatgctttaggaaatggtcattgttattttttaaacttaaaaaaaaatcagtttaaaatgacaacattgttttctgtcctatataagtaatttaggaggcatcatttctgaattaaatgattctagtttattctagtagctacttataaagagagcaattgtgttttcaaataacatttaaaaaaactggtaatctctcttcttggttgttaggacacatttatttcacatttacaaagtaaataggcaagaattggggcaaacctgtaaaaaagaaaaaataaaaagtaggattttaaaaccaagataatacatgtaatattttaattaatagaaactcaaagtagtactgcttaatcagcgtaaagataccctacataggaattagtcctggtcttcacaacttcatgtgagtagtgtgggctgacctcatccccatcacctatccctactcactcaaccactaccaaatgctatgctgataactcagtattttttaacgcagttaaaaaaaaaaagtaagttatttgagtgctgttcattttttctggcattatatttagaaagacatactaaaggccttataatctacattaaatagaactcttgattccagctttgagagttttaacttgttgctgagattattagtgataattcactgttgtaatttttaaattaaaaaattttgttacacaggtaataaaaagttttcgttataaaagtttttaaaaaagcctttctaatcctagaatacactccttgcatctaaggtgctttatgcttctttagatccacgaagtgctaaagccttgccgtaaaattctaagaattggacctggtagaatgtagcagtttatttaaactatagagtagtcaacgttttttaccagccaagtttagtttttctcattggtagcattcataaatatgcttttccttttgagtggctcagaccatgtcctacagagtattttattcttgttcattctagtctaatagtgtacagagggctcaattaatgttatggatggtgaaactgagagacaagaatttgactaagttagtggtagagcctagttttccttttttattctagactcagtcatcttgaccagtactctctacacttttaaaaattatggttaccagttaaatgtatgatagtctaaactagtgttttatgcatgttgtcaaacatataggaaatttgaaatttttaaaaggatgagattttaaaatataagttgtaataatttcttcccagtggctcccttcctcagggtacccacacccacttggagatgagtgctcaagataggccattcttcctgcagaagaggcagccgtggggacagctggaggacagttggtaaaaggtgtgggacttttaagttggagtgatcttttgcagctttttaattttaaagaaacagcctttctttctgtgaaaggctgaaggattcaaagtataggcctggagagaggtgagctttaaaagacagaaatataaaccttacttgttttcc

SEQ ID NO: 65184 - DNA, 1110 bp, Homo sapiens
aaaccaatctgctgtaataatactagcctccccccccacatagttgtgatttaaaatttgttaatatggccaggcgcggtggctcacgcctgtaatcccagctctttggtaggctgaggcgggtggatcacctgaggtcaagagttcgagaccagcctggccaacatggcaaaacctcatctctactgaaaatagaaaattagctgggcgtggtggcaggtgcctgtaatcccagctactcgggaggctgaggcaggagaatcgcttgaacccagaaggcggaggttgcagtgagctgcggttgtgccattgcactccagcctgggagacagagcaagactctgtctcaaaaaaaaaaaaaaattgttaatatgtagattagacattaaatagattccttagatgtgtccaaaatgtatggaatctggtctgatatgcttctactttataagctgttttatttatatgacatcaatttgtcttttcaagacctaatattaaaatgaaataaattcagcagttacaaaggagttaatacaaagggctaaatataaggagaaaaatagtccctggtgttaatggccaatatagaaaatatcaggtttgtaggaattctcattccatatttttatcattatatgtacccatgtgattactgaaatactaaagttggaaatcaggagaggaaataaggagagtaaaactgggcagccatgtagattcagtatagagacctttgacacacctaaattattgaacacagttttcttttttaatgaaatgccccaggccagtataaaggaaacagttgtgatgatgtcagaagacttggtcttaagtgtactcctgtcacgtagctgtacactcttgggaagttcatccttgctgggctttagtttacccagtggtaaaatggggataataataagggcctgcttcactatgatattaaaaggattagataagataatactcatgaatgtactttatattactaaagttgtgtatgtaaattgaatttttaatcagcaataaggggctgggttttaagatatttatctgtatcatgttaataatattaatattatacaattttaaataatgagttag

SEQ ID NO: 65185 - DNA, 1658 bp, Homo sapiens
tttttctaatgtgaaaatgttggtctaaatattgatactttttccggtatgtgctagagaaactgtgtgccacatcagagaacatacaaatttgatttaaatttgattagactctgataataagatatagtcaaattgtgctagatagttcagactttcttgaaacttgctgtgataacgtggtttacttactacaagtcccagtatgcattgcagtttttgcttaacttcagattagagcactgcatgctgggacctgtagttgatttaaacagtacggaaaacccttccttcttgtctgctccattttattatacacagcttcccagccctctaagaactttctgctaagtagtttgattactaatattatgattattatgctgctcaaattctaaagtgagtcttcagaaacaacctagtgttttagtttaccttagattagtttattgtattttttatcagctactataaggtttacacacaaaataatatattgaaaacttgacttagcagatgtaaattatttttatgcatgtggcgatacaggtctctttataattatggcatcattcattgctagtgtgggcatgagaagcctcttattatcaagcctgatatatatgctgttcctttttttttaaaatggggatagttgttccgtaaggttggatggaaggttttctgtgccagtatttaatttcagagttctgtgattcttctgtaataattgtcaacatcttgaatatctgtacgctttaactggaattcctgaaaataaatgtggttttagtgtaaatttaatacttgaaaatgtagtctgaggcagagaaagaggtgaaatgtctttaataatttatttatatttttatttggaaagtttaaatttttttggtgaggattctactttaattttattaactaatatcagagggttgttacagggattaattgttaaaatctatgaccgtacctagcacggtgcttggcacataataagggctcagtaaacgtttagaattagcagcagcagcagtagtagtagttactgttattttaaaaaatagcacgcttcacatttttttcctctctttttacaatataatttgatcagaagctcaggctgttctaagaccttgagatttttggcttatggtaatgatgtgacaaattcctgagaatgtttttgctgtgtgtaaaatgtccttgcacctcagtttctccctaagtgatgtatgcccccaaaaggactatcacaccagtaactgaatattttgactagtattcagctctgcctgtctagtactcattgcatccataccacaagcctttggttgacttcagaaagttcaaaaggtaatgaaaatttattgtttacaatgtttgcactgttagaatatccaaactagttgattaaggaaaataagatgctgcaaaatgccccttttgttacagtgtatgtaaccttggaaaaattctgttgtgtttagaagcatgtaccaatctatcactgtagttcacagtgttacaggattgatgtattggaggccagtaaacagccccagaaagaaagtgtagtttcaaaaaatcttaattctttacattaattttctcttttaggacactgacttcttttaggctcttgaacttgtattttt

SEQ ID NO: 65186 - DNA, 1305 bp, Homo sapiens
tgattttttttctgctgcagatccaagtattgttaaccatgtgcatctccaaagcgacatacttacaaatcaaacagtagttgattatttcactcaattaacagtcagaaccctaaattgtgtgtgttttttttaaattttaaataagtacccaaaactttggggtaatgacagtaatttcctgataaaagtgggtatagtaaccatggcaactgctatctctggccttatggacagtatgttgtattgacgaagcttcaaatcctttatagtagcccgtcacttttatggtgaaatgtagtagcatgtgttgcagatgatttttagctggattgcgttaaatttgtgtgccagcttatctttccttgttaggaatttcttggactatattccaaaacatgtttgtgaaggtgctgttgcctgaaaataacccaccacctgtgttaggcctcctgatgcagattgcacttagttctttcccagcctccttccacagacttgcagaaaataggagggtgtgtagcaactgtatatatgtaaattctagctcaaacttatcagcttgtgtttggacgtgttactgatagcttaaaaaatcttttgtgttttcagaagaggtcagtggatgagagaagtgggcttgtagttggaatactgtttttctaagtgttctttgtagaagcgtgtgtgtgtggggatgtgtgcgtgtgtgtgtgtgtgtgtagggaattagaggtgaggaatggagggcataaatattgagtaaggacttgacaaaagcagaacttcagtgttttttgtttgtttttgtgatggggtgtgtgcgtattactaaaaaaattatttcctggtgggcaatattagaatatggggaatgtttgcttctgagaattttcttcaagaaaaattatttataaaatacatcttgaataattgttaaaaagcaacctgttaaaacaattaaactttttttttttttttttttgagaatgaatctcacactgtcaccaggctggagtgcagtggtgcgatattagctcactgcagcctccacctcccaggttcaagcaattctcctgtctcagcctcctgagtagctgggactacaggcgtgcgccaccacgcccaactaatttttgtatttttagtagagatggtttcaccatgttggccaggatggtctcgatctcttgatctcgtaattcacccgcctcagcctcctaaagtgttgggattacaggcgtgagccaccgcgcccggccaaaacaattaaactttttgtgggggaggattagagaatgttga

SEQ ID NO: 65187 - DNA, 2041 bp, Homo sapiens
tggccggagcagcgttggggaaattccgcttattcttcttcttctgcaacttgttattccggagagtctgcctgcacccctcaccccggggccggccctcccgcattcgcccccgccgccggcggccgcggggcgcccccgggaccccgagcgggccggggcggacaggccgctccgagaggggccgcggccgcccctcccccgcccgcgcccccgccggggggaggggcgcgcggagtgggactctttccgtttggtccagccccgtcgtgcacgcagttcccaacacttctcgtcatcctctctttggtctctttattctgctgagcggtgctgttaggatttcttttttttttttttcccctgaccacgttcgcgatggtgggtagcagcaaggtggccctggtaggggaggggttggtatcgagattgggcaccggaggagaacgccttctttcaactttgtctgtggcttgcacccccggagaaggccacaggccggttgtcgggtgcagatgtgccgagagtgatttctaagtagttgagttgttgtgatgagggtacgactgctaatggtcggcaggttttgttttcattggtgaatctggtgtcatcatattccggtcatatgttgaaatattctttgtttaggtctggaagtagaggatctcactctgcacgtccacattgtgttgtttttaaaatgatgtctctgggagtctggatttctagaatttcaaatctgagtgaaggtccgggcatgtgtgggcctcatcacctggccttgacagtgaactttgtggctgtgtttcagatttcaaagatttgccccatagctggggaaggagttgtgcatttttgctaatagtcggtgtcaggaatgtagatgctcgagctgggaaagttagagagggaagaacatttatatataaataatggatagttgaatattagaatcagattaatttgggctgatgaaagttttttttttttaaagcagttgtgcactctgggaaggaagtcttttcacaggttcacttgatagggattctttaaggcgaggggctggaattatctcctttttgagcgagttctcaccaacatctgtagctttattgagggcctggtaagggtactgaaattgaggctaaaccatgtaagcgtacttttcagtgtttatgatatttgtttacatctggtgttcactctaagcaatagaaataaataggtcagctttgcttttggtctttgaagactggccccctccttccttttttaagtttcacaatttatttggtttacagcattgttggaaactgttactacatttttactggaaatactattattcattttaattttggtaagttccttcttattctcttcttctgtctttacttgtttatggaatcggtgttgtgggcttaaaactagtttattttagggggtcattaaaaatgtctgaaaaatacattttcaaatcccaggacctatcttttcatggcaaagaggaaattttgtgtacagttatgctaatgtttataaaaaaatttctgtacttaaaacgtttgtagatgtacaactatccttaagtgaagagcatagtaatagtgcacaaagttctcaaaacacaaacatctggctaacatgttacgaatattccaggggcttttttttttttttttttaacatcagacttttgcttttggtaacataatagtatttacagtttgactgacattgcttggctgcccataataaagtgttttgcttgggtgctattgaatgctttttaacttagtttttagacaattttgcaggctttatttaagcatgttgtattttggactgaggcaagtctttgtggaactggagtagtaatagatgaaaaagacacctacctgggctaaattgtatttttagaaggtataagtgatggatggggcctatttcttttagctttgaagggtccatcctttttcctattcagtcttctggaaggagctgcctctgaaatactcttcttctgcttacatgaaga

SEQ ID NO: 65188 - DNA, 1098 bp, Homo sapiens
gatcccgttttttagagacagggtcttgctctgttgccctggctggagtgtagtggtgtaatcatagctcactgcagcctcaaactcctgggctcaagtaatcctccttcagcctcctgagtgactgggattacccaccacacctggctaatatttttaaatttttttttttttagagatgggatctcgctatgttgcccaggctggtctcaaactcttggcctcaagcaatcttcccaccttggccttccaaagtgctaggattacaagtgtgagcccccttgagtggcctagaagatctctcttcatgtaaggtggagaatgctctggagagggatcagagtttgagacttggacttacccttcattgtcacaccattggtcagaaagccttttgagagcaggaactggatcttgttcatctctgtatccacaaagctgggcacccagtaggtgctgagtaaataccgaacaaatgcatgaatgatgaataaatgaatgtgactagatgcccttattctccagaggcccctgcgccaaccccggcactcggtttccggtgtcctaagctgccctgcagggatcccctggccgctgcctatagaccagcatctccagcagccagaccgtgggctgctgtgccctcggaggtgccagacacagctaatcccagccctgggcggcggcactcgctgccatcgcttcctcctgcccagacagtgcctggtgcccaccccagggttggaccacagcgcatgggctgcctggtaagaagatgccaggggctggctgggaaaatgaggaagctatggcctgaccaggacaaggttaccagtgtcaggaggggcaatggaagggccagactaacagggctagggggctgcagagaatacacaccctccccaggactctgctctgccttgaagtagcccgcggctggcgccagcctgctgattcctctctccttcctttctccagcacacactggcaaagaaaagctcagtccccatgttggcgctttcttcagtcccagccctcagtgtcccagccccatgcaagcccggggctcccaaatctccctcactggtgttcacatga

SEQ ID NO: 65189 - DNA, 1012 bp, Homo sapiens
aagtgctgggattacaggagtgagccacggcgctcagcctgaacatttacttctcaccagtgttaagtattaacactcacagtgttaagtgtcttatgtacattatactacttaagcctcagaacttctgtattaggtacgtcctgttcctttccccattttgcagatgaagaagctcaggctcagagaggttaagcaactagcctaaggtcacacacacagccaatcaagaggagtgtgaatctggtgcccaagctcattctgtaagctgctgaatgaagaggatgtcctcacctcttctggccccagacaactcctcctcacctcacaaccaccctctttcctgcctgccccctggtctaccctaacagctctcttcagttcagcctagggtagctcccagggggcaggcagggggctgagacctctgccctagagtcccctgagcctttccccttcccctagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggtgagcctgggaactgtttgtagcggctgagggagggaggagggctggtgggtctgtgggaagaggtgcccaaagccctgtgccctggggctctgtgaacaggaagacatgagcctcagggctgagggtgggaagcccccgcccagcccaggcctccgcctacccccctggctgccccctcaccataccgcaacgggcacaagccacagcccccttggagtaactgaggctctcgtctgtgcagaaaaagacagcttgcagggctccaggcaggggtggcatcaggagcccagtccagggtctcagaggtggagacagcccaggccactgacttttctcaaagcttcagtatttttaaaaaa

SEQ ID NO: 65190 - DNA, 1252 bp, Homo sapiens
gaatttcacccagatccactccctttccagatgaggaaactgaggcatagagcattgtgtgccttgcccaggtcatatagatagcacatggcagagcttgaatttgaacccagggctgcctggctcctaactaccacatcatacttcctacagaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaaggtaaagcctgccaccctggggcttcagagggcttccttggtgggtgggctcccctggcataccagctctgaaattggggggcccaggaagtgaatatgtggcagtgctaacccttgttttcgggcctccccctctagatctcagcccaggagagccgtcgtaagaagaaggagtatgtggagtgtctagaaaagaagtaaggggcttgggaggggtgggcaatccactcccttgcctgacctgccctcccctaggccctccctcagggggcagcagaggcagggggcacagggagtgtgatggtggtgggctgggccgaggagctgttgtgagtctgggggctgcccctgagcctgtgcctgcttggcccctacagggtggagacatttacatctgagaacaatgaactgtggaagaaggtggagaccctggagaatgccaacaggtgggtagtgcctcctgcatccaacctggccccctgcccctctgcaacccgtgcctggctctgcatagctctgggagacaggggagaggagagagaactaagtttaggatgacagggaccccagaaacacaccctgcagccttgggccacttacatcctgcccctctctgtgttcccatttttcctcacctacacctggcagggctggggagttgcttaagtgagcagatgttttcaaagtgtggtcctcagaccagcaacaatccctgggaattattagaaatgcttattctcgggccccatgccaggtctactgaatcagaagctccaggggtagggcccagcgccctgtgttttaataagccctccacgtaattaggttgcaccctcaagtttgagaaccactggtgtaaatccttgttactcaaagccagctgacccagacaggcaacatcagcatcacctaggagcttgttagaaatgcaggctgggcacggtggctca

SEQ ID NO: 65191 - DNA, 3259 bp, Homo sapiens
cagaacccaagaggggaggatgaaagcgaaggtgacacaggatgtggcttggcagagaggcgtgcacacagaagtagtgggcagctggtgtgggcagcagggtggtagggtttggggaggtggaagaccatgcttcccagctcctggcctcccttcgtcagccctgcgggggccatcagaaacagccccggtgtgtgtgatggctgtgcccctacaggtgactgcttgggttccaattgctctcatttctggagggggacggcctcggctgcattgtggggtgtctttgtgtgtgcatgtgaggtatatttctggatgggagtgtgtgcatatgcacacacatacatatgtgtgagggatgtggcaaccggtaaccattgtcctgggagtatttgtatgtaggagaaaggtgtgtgttctgtgtgggcatgtgtgcttgtgaatgggagtgtggtacctgttgtccttctgtgtatttgtgagtgtgtaagggctgtgcaggtgattcccgtagcatatgagatctataggttctgttgaatactatgtcaggaaaatgcgatgtgttgggcctgggtgagaaggttggaaaccattgtgaatagctgtggaaggatgactttgtaggagaaacttgtgagttctttgttggtgtgtgtgcgagtcattaagtgactttggtcactgagtgcgagaggctggggtgggaagtgttcgtttaagtaatgagtgggcataattgtgtaagggatgtgtttgttctgcgtgcatggggagcactgtgtgacttttgttcccctgggtgcgatttgggggagccaaggaggtatgggtggagattgtgagtggctatgagtagggtgtgcgagagcggaggggaggtggtgacagcagccctcgcgagtgtacacttgtgagcgtgcagttgtttggtagcggagggatcgggggaggaaagatgcgcgtctggatgcgcgcagtgcgagtgtgccaggccgggagattcagtcccatccaggcgggccgggccgggctgggggcagggctttctgctgccccgcccattcgtcgccccgcccctcggaccgccccagcgggctgcagcgcagcgggcgtccggcagagggcgctgcgggcccggtgccaccgtgcggccgagggggcgtgctcggcggcgggcaggcagcggcccggccagctatgcggggtcctgcggccgcggctggcggcacttcctggagcggcggcggcagcggcttcccgggcacctgggcgtggggagcgggggcgcgcggcgcggggcgggcggagcgagcgcgcgccatggaggtggcgggcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggtgagcggggcggcggcggggcaggcaccgaggcaccggcaggttaccgctccctcaccgggggacattcctcggccactgggggtccgggccacttcggtactgacactgagtcggggagaggctggcaccggcggcacgagccgtcttggcgtgggcacccactgggagtcatcccccagggccgggacacgggcgggatcggtcggcttggcactgtcaccgggtgggggtcattccctggcaccggcagtctagtgcgcctcatgtgtagtaccgtgggaggatcggctcccaaccctccagcaggaagatggaatcaccccagcccccggcacaagcaggttgggcccccaggactggtcacccacgccttcttggcactgatagaacagggcctctctgagcctcctggcaccactgaggtggggatcacaccgccctttggactttcgtgggaccaggttgcctaccatcactgcgtggcatctgcagaacgtagccccgttgataccgtcaccacacatggcttgtccccaagctctggtcactggtttaattgtttaacatgttaagcttctccttggggttgggggtgcctgatcatctgccctaccttgctcttaattagcagagagaccccagcccatccctctgctaggcaggcagcatgtctccctctaccctcttccagcccatgctgggaaagggatggggtgggctggagtctggaatctgctggctgttcaagcttcatcttgccccctcccccagcactccaaatgtcaccatcttgtgcctgtgacagagctttgaccaggactctagcggggaaccggggggagagtgtggaaagactgagtgcaggcagttcatggcaagtgtgctgctcttggtcgtgagccgctgcctgccctggtagccgtggtgtaaggtaagggacgtgaggccccaggagtacctgacctggctccctgcgcttcttcctgaccgagccttgcccttccctggtggccaaggagcttgtagccaatcagccaaggaccccagagccacctcagactgaactctgaccacttggagtctgcccaaggcctccctctcacttttctgcagctgcctagacttggtggcattcacccccaccccgccccttagctttgctctgccccttccctgggtagactttacccaccaataacatgggcggttttctcctgtcgtgtgggctagcatacccgtgatgctgacttgtgccctctacccgtctcacccgggctagggcccactctttgcacctgcactctgtctctgagcacatgcacagatctgaattcttacactggcagatggagctccgtgggctcctgtgttaccacgcaggcttcaatgtcatataaaacagagcagggagtgaaacttccagtagctctgttttgtcacccacagccctgcaagatggagcagtttacacccagctctgcaggatgtagcctccagtattcacaggctccgcagggggagggaggggcgccaccagaggcttcctgttgctgcccacagggtatcaagtgttgggttcttctgacctgtggctgtgccccttctgaagggcacaggtttgtgggtatagggatgagcacattcgggaggaagaacaagaaaccagagaac

SEQ ID NO: 65192 - DNA, 1056 bp, Homo sapiens
ggcttctggattagctggttttacaccccaggggcatcagaaattacctggcacctcacacatgtagacataaggagccttggcctcagagcccctaggagcctgagcgtctgtgccgccatcccctgcccttcacggtgctcaaagtcacaagctcccagagggcaggaggcacacctgcagaaccagtgtgagacaatgggtcccatttagaggcactgccacacggccccagcgagcatggccctgaagtcagggctgcagagggtgcccagcgggtgcctgagcagaagcagcccctgtttgagttggttctgcaatgaatagggagggacgtgttgagggacgcctcttttgcagaggtgagaaccctgtctatggtgccagggtgtctgggagcgaaaggaaacctctttgagtggtttgtctcacctgggctaatgctgggagcagcccaggttgctgtgagaggcagggacaacctagaatccttgggttccagcaagtttgggaaagaaaaatgggcctcagtggccgagctgcgttcatctcactgtgtttgctccccacacaaggtcaggtgccagagtatacagctggcccctgctgggaacccagtgtagaattctcacagtctccctctgtgccaaacgctgtcaggggagggaatgacaattcttgtcattttgtctccatgccatactccaaaaaggtcagatcctgggatgtggagctgcccaggattctcggttggcacaggagcttgagagttggtgtcccctcaggcaaggacagaggaaggactaagtgacccctggtgagagaaagctgaggctccaggcagctgggctgggggagagtgagagaaacgggcctgccctcctcggctccctggaggcctctccagaattcgccagtggcccccccggggcagaggtgaaagtggagtcataggttagccctgagtcttaggccgcgcgggcccctcggagaagcagggatccggagcccttccacccactttaaggcaggagagaattgggaggtgtggaagca

SEQ ID NO: 65193 - DNA, 1102 bp, Homo sapiens
cagctgcgggggcagtgtgtgcaggaagcgggatctgccacacctgcggccaggttcttccgctccccgagttcctgggccacccctgagcggtgccaggcactcattccttgctcttcttggctctcctctgttccgtgtcggggtcagccccacatccagcctgcagtgtgggtttcagcacaggacttggctggcacttgggtcacaggtgtggagggtaggccaaaactaaccaaatgccctggaagagctatcattctgccatctttcctcttcaccccctgcctcgctgaaacaccagagacgtggttaggtcgggaaagcaggttcgagtgagaccaagggctctgtggccgcggaggggagggagaggctgaagagacaggagtggcgttccagctcctctgtctttggtgattaacagctgccagaagcttgtaaattcatcagtttcatgtgatcttcataacatctttgtagttggtttgattcccattttgcagataagaaaaccaaggctcagaaaggtcaggggcctggccaggatcccccagctcacactggagcccagcccaatgatcttctcatgacattgggccactctacttaggagtactcttttcttctattatttgccatccctaaactgggaagacctaagaagaggtttgagtgctccatggggtttagtgaaaggtctttgcctccggtgccaacggtgtgagacccatgagataatctgacctggacccccaagggagaatggccaccaagatccctcaagtcaggggagcaggctggactgggagagacccttggtaaagagactggggctgtgagcccgtcatcatgtggcgtccgggctgggtctggcgtggaggacaagtctgatctttttccttgctttaagggcgcagggagtctaaagcccaatggacatgctcagaggagcccccataccacccaggggtcggtggctggtctggggcagggaagatcgcttcactcgtacccagtgcctcatggtgagaggtctgagaggagagggagggccccagcatcctcctcatctacactgagacctcctccccttgctcct

SEQ ID NO: 65194 - DNA, 2262 bp, Homo sapiens
tgggctcagccctcaccgctgcccacgggtgcagcggcacctccccccactgactgtggccttttgttttctgggtgacagtagcatcaggcggtgtgtccgggtgactaatctcctccaggctgggcagctgtcacagggcggcctgaccaggcaggcaggaaagctgacaccctggggagggctggcaggccggtgccctgacggcagggggcagttgggccttcaggctcctcttcccctgacacaaagcaggccccaggtcgggaagacccgggttcaggtcccgaatgccgctgactggccgtgggactgtggcatgttactggccctcttgaagcctcagtttccccatctctagaatggagctgcaggtcctgcttacctcacagggctgtggtgaggattacacgagatgataaagtacttagcccagggcctgtcacgtagcaggtgttcgttattattccctatctggttccctttcctaccccatcccagcctcatgttccaggaggaaggaccctgcaacccaccccatttctgggacgcaggctttgccgttaggtagacttggactccagcactgactccacactgacttgccgtggactctaggcggtcacctctgcgtcaacttcctcatcaggaatgcagtgtgatgcagtacctattccttggggttgcagtttatgaaatgatctaagtgtttgtcaggggcttagcacagtgcctgacacataggggctcagtaaatgtcagccgtgacactggtgattttgggggagacccagcgctctccacccatgcctgctgtcctgcccctgcagctccctccggcccaggtggtctgctttgagtggggcactatttggggtcataagagcactgccctgacctccctgtcatctgaggcagctggaaactccaataggcagagaccaagagctgagctgtgcagaactctgcttccctaggcacctccaccctgtccatctctcccccaacacccctgtacctggcctgaagctgctcaagacctgcagggcagtagcaaatcagtgcagtgtatggaaggagaaggtgctagacgtgcggcctgggcctgactcctccagcccttcatctttgccttcatccttcctcctgcccaacatgcgtccagggcatcacccaccatgcctaattaatgccagccttcaggggaccacagggcttcttctgtcagccccaggcagcactgtcccagggctgtgaccttgacctctgtggctgccagcggttaggatgcatcccccaccagtctctccccaggaccagggcccaggagatcacctgctgtggggcacaggtggcctcaggtacctggaggcatcgccagcctgatccatgccaggcaggctgcccttcccccactgttaggagaggtagggcacaggagctcgatgctggctgtgaagaagggtaggcagggctgaggtgagctggcagagggagcaaagcatgagttcaggatgggtccatggaggccaggtccaggtgggagctaggatgatgcccacagctcctgcctgcctgcaggagggagctctgggctgtgcagcgtttggaattgtgagtatgggggcttccagcatcagggccgcagaagaatgtgcagtcacaggctccatcaggagcagagtcagaagggtttcccggcatcacccagcttcaccctggggtatccgtactttgtcccttcagaaaggtgagacagagcagtcgagcaccagaaagttcttaccatcagcacttcagacatacaggcacgcacacacccagaatccagaaggctttgcttttggcccaagcctattgtcacggccccctgggtgtgaagggagactgagcagcctctctcccaggagagccagacagtgactctccagttccctgagacctggtctcccctgagctacacattagaccctctctatttccaggagtcaccttcagcctgaccccaaggctatgggctgagagactctgggggtcctgtcaggattaagttcctttgcagagagcctcattttgttatagcttggtttgctccatgtcccatgaggggacacctaacctgcccccaccatgttggtggcaaaacaaaggcccagcaagtgggaagccctgccctgggccccaccgtccatccaggcagaccgactccccattttctttttgttttcttttccatcagcttccggcagggcaggtggaggc

SEQ ID NO: 65195 - DNA, 1065 bp, Homo sapiens
cctcaacaccctccccgcccgcctccagtgtgatggaatggacttgactcccaagatccaggacctgaaaccccagtgtgttgttttcctgaacatccccaggtgaggagggggctaccggagctggggggagccctgctgtccttgtcctgcagagactgtgttttgaggcccatgtcatcgcccgcctttgcaggtactgtgcgggcaccatgccctggggccaccctggggagcaccacgactttgagccccagcggcatgacgacggctacctcgaggtcattggcttcaccatgacgtcgttggtgagtgggccctgggcccatggtgcctgggagcacagcccaaaggtggaaggggtcacccatactcacctccatgggccacggcggcctagttcaccctcacctcccttctttgtctcattcctctggcttgagagcggcacctaccccctctcctcactatgcctcgggataccttcactccccactctgactggagcgtcaccctcattgcctctgtcccttccctttcctacctggggtctcagcctcccctctgccctctggccaggggtcactctcacctttgttctctggctagagtttctgcttcggaaggagcagagtctgggacccccctgcccccagccctggtgccatctgacccaagcttcctgtgcccacaggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgagtacgtcccaccctgccacgtgccctgggtgccaaggccagaccctgccctctctgggccttgatttccccatctgtaaaaggggctgactgtccctctgccccaggggtgttgggagtggagcgggaccttctctcggcaagtggtttggtgccaggccgagggtggcac

SEQ ID NO: 65196 - DNA, 1011 bp, Homo sapiens
gtgctcatggcagaggcttctccaggtctaccagccttgctgcccctcggcccccaccgtcaggtgccctgacctcccgccctgacctccccccacaggagcacctcaactatgtgactgagatcgcacaggatgagatttatatcctggaccctgagctgctgggggcatcggcccggcctgacctcccaacccccacttcccctctccccacctcaccctgctcacccacgccccggtgagtcctggtgtcccgtccctccagcccctggctttcagccccacctgtaagccgatgacttctgaatccctgcttctagcccctccaccagttaactaaatggtgtcaacctgaacctggccaaagcccacctgacggccttcagccctgtggttctgtggggaagcggcctcacgtccaccctggttccctccctgacttctccctcctctggacctcatccttcagccagtcctggcagcccccggacccaccacctgagcactcctccccacccctactgccaccagcccttcccggctgccacgccctggcccccagctcttatatccctgtggccattcgtgccctcgaacccccatctccataccacggtcaactaaaaatgcagagcataccaggccactccccaacctagaagcttctttctcagcagccctttggacgtggattctccccaggccccccgtcattgcactgggctcccagccccctccctgagttcacctccatggtcctgccccactctcttctcttggttctttgaggcatcaggtgtttgccaccactggacttctgtcatcgctgcctccaactcttcccccatctttccggagctcccccacccccatccccttcgaatctcagcttggctgtttcctccttggagagatcactcccaggaccccctctgcaggggtgccacatcacctgttctgaattcttaagagcacccctgctctcagaactccttatttatttgacttgtt

SEQ ID NO: 65197 - DNA, 2460 bp, Homo sapiens
ggggtctgagctgcgtcctgggctcgaggcgtcccccggggagtcgcctcttagcggtgcgtccgggctagcggcgaggggccgccccaagtcttcccaccgccgccaccttagcagcccgacttggggcctggaaagtggagcacgcggaggtgggagggccctgcacgcggcccccggtggggaaggggacgggccagggattcagactcgggctctcccctcaggatgcagcaccgaggcttcctcctcctcaccctcctcgccctgctggcgctcacctccgcggtcgccaaaaagaaaggtgatgggggatgatcgaaggagggctggggacgggcaggcgaggcccctccacttctgggctgggccgcctgggttcctagcctggaaccccaggaaggcggctcccgagggagtctccccgtgccccagtcctgaactctgttcctcgcgcgttgtagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggaggtgaggcggggcgcagtcagagggcaggagacggggggcacagcctcgccgaagcctgggcggacccttggcggagggcggggccgcgggccgcgcagcgctgacctgggccgctctctcgccagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccccgcctgtgaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcaggtgaggaggctgaggatgcccagggctgctgtgaccaggactaggactggaaacttgaaggttttctgatcccaagtggaaataggaagctggggatgtcccatgtccacatcacaatggctgccccatcccctgcttccgagtcagctgattggaaaccactagggggcagaatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatatataaaagccccttcccaaggagtttgctgtggaaatgtgtttgggagtgggaaggtggggagaaagaccaggctgtagggactggtgggtttcagggggcttggtggtgggtgctctccagagctcatggaaaaagcagaacaattacaaacatttcttccagggcccctgaaagggtgctccccatcaagtcacctaagcctttcggtcctcatctccctcagggaccagggctggggaagggaacctggctgactcactggaaccaccacacccatctcagcctcacccagtcaaaggtcttttgatacaacccacagccaatcaggaaggttctacccatgggggagagcagatgcgagggctgcgtgcctacctcactgcccacctccccccttcccactgtcatggaaacccgagtgagccaccaggttgacccctttcctcttgcctgtgtgacccagg

SEQ ID NO: 65198 - DNA, 1071 bp, Homo sapiens
gggaaggcaagttactgggactgggctgggagtgaggccttcagcctgaaggtgacatgctggggctctgggagcaggagctgccaccttcagaagtatgtctgctggtgtttcacctcccagagaattctctgctgttttcttggttagcatgcagcccatttctggcttctagtcaattataagttcctttcattcttttggggggatggggacagagggtggggcagagggaaggagctcttttccctggttttaggaggcaagacctggttcctcgccccactatcccctcctcctgtaaagtagagtaggcggtagaggatggccccagctaagctgaggctctggtcagcgggagcagcaggcagagtgagaccgggcagctggctgcttctgcctgcctgcatccctgcatgctctgcgtataccctgtacccacagctgttccacacaccatacccctttcagaaaccagtcagggcaggggaggtgtgggtcagagggtatgggcacttgatggatgggtgtcattctccagccttgtccctcctagggcaaggagccttgctctgaggcactcacaccactattgtgctgtcagactcttcaggggagcccagggatcagggctctctttgagcccagatttccccatgcagaggcagctggcaggttttgtattgacaaaaccagagctgcaagagcatggatagtgaaaccctctggtcagggagttcagctcttctgggctgggctagaagggagatcccacctgtactcacacctgctacaggcaccaagatttatttattttgtttttattttttgagacaagatctcgctcttccatccaggctggagtacagtgacacgaacacggctcactgcagcctcgacctcctgggctcaagggatcctcccacctcagcctcctggcacacgccaccacgcctggctaattttgtttattttgtttgttgtagagacagggtttcaccatgttgcccaggctggtctcgaactcctgggctccagtgatcctcccaccttggcctcccaaagtactgg

SEQ ID NO: 65199 - DNA, 1085 bp, Homo sapiens
gagaagctaaacccaccattccaggcatttaggctattagagatttgtctgaattgatccagcactgagcatcctgatgaggcagcagctctggtcttggtttcagctcagccccaggagagagaaaggatgggcagccacagtccacaaagccaggagtttcaggagctcttatccttccctctctaatgcctttcaccttcttctttacccttcccaactgatttttagggccttaaactctggtgttgagtactactgggaccagctgaacgagacggtcttcactgtccattccaacagcaggagcagcgagcggcctgggtatgtttgggaagtaggcagggagcagctggctggaggcccatcccttcctcctgcttttgatgggctcttaagcagcgccctctagggctctgggtccctcctcaaccagagcagcacctccttgatcttttgtgtacagtttcatttgagaaaagtgttgtgtggctaagaaagagaacaaaagctctgctctcagagtcttgctgtagaaccaccccctggccctctcccatcctggccatggtgcctgggcacacttggggtgaggagagaagatagggcctggagaaggatgccgccccatgaagtctgctccatggcccaggctcttccagatgaccaggacctcagggaccaagctgcccagggctgtagcccagggacaaatcctcttgaggcacccattagtagaaatctggtactgatcctttcatcacttaattcactaatgaagactggaacaaagcgctgggttgttgataaacccaaagcaattgctacttcccctaggaattgctgagcatagctggaggaatagtcccagaagcagctagaaatgtgagtgtctggtgatagtctcaaaaggcctgggctgcctctgctgccagctccagctattccaaggcagtgcctgggagatgcccaaggaagggggatgctagcattggccagaaccttccttgtaggacagcctgtgctccctacctgcaagggtctgttttcagaaggccctggaaagaggatcccagaacagcctc

SEQ ID NO: 65200 - DNA, 1062 bp, Homo sapiens
ggggaggcatagtggagcaacacatctgagacaggaagtacggcccctgttctgttggcagtggacctcttcagtcagtagccaaggtcacagccctgagccgatgatgctccatgctgctgcctggatggaaagcattcgaggggaccttttggccaccagcattatgctgacagtcccagctcagacagaaggccttcttgtggcctcttttctgaggtaggaaggaaggttccgggtcaggaagtacatggtttgttgtaggtctgatgtgaacagtttgttgtcactaaccagccctggctagcaagaattccagaagagggatttggcagggacccatgtggtattgcaacctgtcaatacatcttgacaagtttgtaaatcagtcttcctggcagccagcttcacatagtatctaacacagacaggatttgctcaccaaaaacagagatgagtttgtttttggaggcctctgctgttacttctggccatttacctcttgcataatgtaaggtagccttttctcatctttgccctccaatgcccatctggttctcagacaatccccaaaccccacaaaaatggctgtttagaagaggaaggataaacagttggcccttggtatctgcaggttccacattcatggagtcaacaaaccataaatcaaaaacattttggggaaaaaaaaacagtgaaaattaacaatacaattagtctgggaacggtggttcacacctataatcccagtactttgggaggctgaggtaggcagattttttagcccagaaatttgagaccagcttaggcaacatggtgaaaccctgtctctacaaaacaaaaaacaaaaaaaattagccaggcgtggtgaggcacgcctgtagtaccagctactcgggaggctgaggtaggagaatcacctgagcccagggaagtcagggctgtagtgagccgtgatcacaccactgcacttcagactgggcaacagagtgagatgcaatacagtataataactatttgcataatttacattgtattagtgcaagtaatctagagatgatt

SEQ ID NO: 65201 - DNA, 1047 bp, Homo sapiens
ttctgttttctcttttctccccatatgttgctccagcatcccagagtctcagctggcctaagccatcttgggctgcctggggaactctcttacccaccaggaactcaagcctcttccctgagtaagatggcattagcactggacacattgaacagtgtcctgtcacagaccaagttgtgttggactaagaaaactagtttagcccatcttttttggttgctgtttctcctgacttcttgggtcaggttggcaaatgcctcaagccttagggcccaaaatgtaagggtaccatataaattggacatggacatgacttaagttcttcaaagcttaggcaaggaagactgtgtgtgagcaatatacacctaaggaagttaagactcctctgaggcctcctaacagatgacagaactagaattcctcactttactatccagagcgcttttcactcaaaaacccctttaaaattctgacgaaagcaatgtacagtcttccacagaaaaatatgccacaataacacacacatacttttgtaactctttaagacctcaggtaaagaatgcagctttagattgtgttgagacatttcagcaggtcaggcatggatgcaggtggaaatgagagaggatcagtgagcgcattcatgtcttttgagcggtctacagatgagtggtctccagtctcaaatgaggagaacaaatagggaagtaggagctcagggttcttgtgtgtctcataggcagctgcctatccctgggtgatacagctccctggcacacccattcccaagggcacaggatccagccagccagctgggccaagattgcagccctccctccgaaacaggtggctgtctgcctttgtcccaggcacaggcagctgcaccccattttgtgctctcaatactgctcttgatttctcctccattgtctttgcctcagcagtctctccaagcacaaagacagaggaacaagctccttgggcatctcttggtggtactaaaacccacttggcagtagactaaggccttcaaaaatcctccatctc

SEQ ID NO: 65202 - DNA, 1056 bp, Homo sapiens
tgctacccagaattccccttctgtctggtgttacctcttggaattcactgtggtaatgttcagagaggcaaatgtgttgggccaacagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaaccaggcacagtattgtaac

SEQ ID NO: 65203 - DNA, 1049 bp, Homo sapiens
tgtattcttaatcatcccattcatttcaccagtggagaaaaggtcctgtctaggaccctgtcttgtctaaggcacgtctctcttatattgccataaaagccttctgggcatcctgtggttcgtggccttttggcctcagccagactaacgtgcctgagtgaacgtcccacatcccataggtgctcatttagccagggttttgtcaaggggattcaagcatttgaacagttctctaattagatagtattcaagctttgtcagaatccaagaacctgtgaatttccttagtactttgtgcaatctgtaccatttatagttggatgtacttgttggtccattttttgtcttctttagctgtgtagcgtatgtgtttaatccacccaattcggttcagtgtaagctccttagagggatatccctcaggtccctcatttagtgctgtgcatgtagatggctgttgaatatctggaatgggaagcatttgttttaaataaaaaaactagagatagcacccattatatacaaagtgatagaaagtgggtggcctggtgtggtcctttcctctccagcctcttctccctcctgtctcctacagatatcctctgtccaactacactgagccacttttcaagcttcttgaatttgtcaaagtgccttcttgccagggtacctttacttggaatgccctcctgtcccctatctccagctacctgcaagctttttactttctgtggcatccatcttaatagaattgatcactcgttccttgtgctatcattgtacctcttacacattctcatgtcagtacttgtcacaccaaactgcagttatttgtttccatgtcactctcttctcctgggctgtgagctccttgagaatagagactgtgtctgttttatctttatgaagtccaagaacttcatgcggaacctgacacttagtagaaagtgaatgaatgaatgaaagagaatctcaaaaaaaaataaataaataaaaataaagcatcctctttatcatttctaggtggtaactagcagaaccaatgatgg

SEQ ID NO: 65204 - DNA, 1012 bp, Homo sapiens
aattacaggatgttaacaattttttaaaatgttgataacaacggttagcatttattaagtactttctttcttttttttttttttttttttttgagacggagtttcactcttgttggccaggctggaatgtaatggcgtgatctcagcttaccgcaacctctacctcccgggttcaagcgattctcctgcctcagcctcccgagtagctagtattacaggcatgcgcaaccacgcctgactaactttgtatttttagtagagatggggtttctccatgttggtcaggctggtctcaaactccctacctcaggtgatcccccgacctcggcctcccaaagtgctgggattacaggcatgagccaccgcgttcagccttattatgtgctttctatatgtcaaacactacactcagtatgtatatgccttctcatcatactcctcactacagtcctatgagataacaccaggatgagcaagtgaatatgaagattagagaaaaagacaagagtaagagtgaaagttgtttccttggaatggccagaagcctaggaaatatttctctgttttgttggccctcaggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgagggtgagtgccattgcttgtgccttcactgtatggcagctcccctaggcttggaagggtaatgaggggacagtggtgtgacctcccagccaggaccagagctatcacacagtcataaggagtaaggaagggctgtagtcaagcccatccatgaccagcaggcttcatttgtggaagctctggactatcaaaggcctttcctcacaccctagaatatgtgctgcattccccagaggcctgcaagtatcttcagataaactgaatacttccttacttctacg

SEQ ID NO: 65205 - DNA, 1120 bp, Homo sapiens
atacatgtggaattaaggtccagtctaccccctcaaagaaatgtatgcttgtctgttccttttccaacctggaacctggacattaaactgttgaatattttgtctatcttcccttttggctttgatgttcttaaacgttgaacgttagcaaatgtcatggagacacacccataactactttcttgtaaggaaaccaaggacttgaattcttctcttattcataattaatactttgcattccaagttataggtagcactgggcgctggaggctgcctgccagataggctgactagggtttgaagttagttgggttgctattctactttgcagaagaacctaaaatactttaattttttttctattgataagactgtttttcagtttaagatatattcaattcacctcactcattttctcctctcatctcctctccaagtactcaggttgatcctatgggaacataatgtcatcctcctcatgttatacatatatgcggactttgtcaggctgagccttaaaatgtccatttctcaagcgcacactgtgttctttctctttcgactatcttgctttttgttttttttcactgttctggctctgatatgggttagctgccctcagtgaaccagtactgtatttctttccttgaacttaactttacctgctagccatagggaaaatccagaatgagtactaatcctttctggatttccccctctgtccaacagacagtatagtatagatgcttaagaacaagggtagaggccaggtgccgtggcttacgcttgtaatcccagcactttgggaggccgaggtgggtggatcacctgaggtctggagttcaagaccagcctggccaacattgtgaaaccccgactctactaaaaatacgaagtcagccaggcgtggtgtcacgtgcctgtagtcccagctactcgggaggctgaggcaggagaatcgcttgaacctgggaggtggaggttgcagtgagccgagattgtaccactgcactccagcctgggcgacagagcaagactctgtctcaaaaaatagaacaaggttagaaattgggcctctgtttatgttgagaagtatatgaatagacctgttcgtattgat

SEQ ID NO: 65206 - DNA, 1057 bp, Homo sapiens
tgctgaacaaaccacccccaaatttagtggcataagacatttcttgtttctcacaattctgcgagtccaattgcagtttgcctggtctgcatcattggctcttctctgtggtcaattaatagcttggctggatgtggatgatcttagatggtttagtaggtaaaataatgatctgcctaagaggtccttccacatcttaatccccagaacctgtgaatatgttactttacatggcagaaaggactttgcagttatgattaagattatagatcttgaggtgggaagattatcctgatttatctgggtgggcctcatctgattacatgagctattaaaagtggaagaggaaggcagaagggtcagtcaaggtgctgcaatgatcaaagatgggaatggcctctgctaacagctagcagcgagtgggaacctcagttctgcatctgcaaggaactgaattctgccagcaaccgaaatggacaaggagacagacccgaacacaggccagccaacacctttcttctagcccaatgagtcctttgtttgacttcaggcctatagaactgagagataataaatttgtcttgtttaagccactaagtttctgcttgttgttatggcagttatagaaaactgataacagatagtttcacacatgtatctggcatttggcaggctatttggcttcagctgggatgacttgtctcctttctattcaccagtaaactaacctgtgcttcttcacatagtgtctcagggttgtgtgtgtgacggaatctcgctctgtcgcccaggctggagtgccgtggtgtagtctcagctcactgcaacctccgcctcctgggttcaagtgattctcctgcctcagcctccctagtagctgggattacaggcgcctgccactacacctggctaatttttgtatttttagtagagacagggtttcaccatgttggccaggctggtctcaaactcctgacctcagagttctgaaaagaagcaggagaggtcaagtcctactgcataagcactttttgaatctctccttatgtcatgtttg

SEQ ID NO: 65207 - DNA, 2048 bp, Homo sapiens
ggacacaggaaggggaacatcacacaccggggcctgttgtggggtggggagagcgggggagggatagcattaggaggtatacctaatgttaaatgatgagttaatgggtgcagcacaccagcatggcacatgtatacatatgtaacaaacctgcacgttgtgcacatgtaccctaaaacttaaagtgtaataaaaaaaaaaattaaccgggcggttgcgggcgcctgtagtcccagctactctggaggctgaggcaggagaatggcgttaacctgggaggcggagcttgcagtgagccaagatctcgcccccgcacttgggcgacagagcaagactccgtctcaaaaaacacaaaaaaacaaaaaaacctttttactgaacggtgtcacttctcagtacgacttctttgacctattacttttttgggagtgtgttgttgaattttcccatattttgaatttcccaaatttccttctgttgttctcttatttaatttgatcatggtctgagaacatactttgtgtgattttattcattttaattttattggaacttgttttatggcttagtatataggctcttctagagagtgttacccatgtgcttgaggagaatgtgtattctgcagttatttagtggagtgtcctgtagatgtcggttaaatctacttggtcaatattattgttccagctttgtatatccttgctgattttctatctagtttgtcagttattgagagtgggtattgaaatctctattattattgaattgtgtatttttcccttcaattttgtcagtttttttttttgttttgttttgtttttttgagacagagcctcgctctgttgcccagtgatgcaatctcagctcactgcaacttccgcctcttgggttcaagcgattctcctgcctcagcctcctgagtagctgagattacaggcgtgtgcccccaggcctggctaatttttgtatttttagtagagatggggtttcaccatattggccaggctggtcttaagctcctgatgtcaagggatctacctgccccagcttcccaaagtgctggagttacaggcgtgagccactgcatctggcccaattttgtcaatttttgattaatgtattttgtgactttgtcattaggtgcacatatgtctacgactgatatgtgttcctgatgaattaactattttaccattgtccctctctgtctagtaatattttttgtcttaaagtcaattttttcttatattaatatagctactgcagttcttttatggttgttgattacatgagatatcattttccatccttttactttcagcctgtttagctctttgaatctgaaatgtgtatctggtagaaagcatatgattggagcttgttttttatctagtctgacaatctctgctttttgattgtttagtccattcacatttaatattatcattgatatagttgggtttttgtctgccattttactgtttgttttttgtatttctgatgtttttattcctctgttccttctttactgacttcatttgtattaaatgggtatcatctaatgtgtcttttaaattccttttttgatttttgaatgtattttatcaggatcagtttccaatttattcagacttaattctggtaagatatagaaacatttttcactatctgttgttcccctgtggctccattcccttctacctcttttgtgctgttatatatatattaatattacatctatatgtattacaaacccaacaatgtggtgttaacttattgattaatacaatcttttctcaggcatccttctgtttgttgcctggtgtgggaaagacagagctatacttttcataaaatttacttttattttcatctaactttattaacttgttaataaaattgttattaactttatttttggttaacaacaatttacttgttattattgttaactttatttttggttgtcctctgcccctctcatctcttttatttttattttatttttagagatggggtctcgctctgttgcccaggctggagtg

SEQ ID NO: 65208 - DNA, 3073 bp, Homo sapiens
caggtaaggaaatgtttctttggcttttgaaaatgtgaagggccaaggagccagataaagcttctccctcctttacctatgttgatgtgatggtgtcttggcatctgtctgaaaattctattttggggtcctggtttgatattcagttccttacttgaaggcaggaaatggcagggttgaagaaaaatgtttctcttaccctattcccactttccctagacctttttttttcttttaaattatttgtttaaaccatttgtttcttaatccagcaattaaattctagctatgcttttaattgaatgataaaggtgccgtgtttatgttttggttggtgagatactcatgagccagatcctgtgatttaattaggagcttagtgcacacctctccactcctttggtactgccagcatgtggaatttccaggcagtgtggaatcttctgaggaaggaaaagagggagacgcccttggagctggctcagaaatctccacagaacagaaaatgggctaggcaagccccactgaagcagttttattgtttatttacttatttatttttgagacagagtctcgccctgtcacccaggctggagtgcagtggcacgatcttggctcactgcaatctccacctcccgggttcaagcaattctcctgcctcagcctcccgagtagctaggactacaggtgcccgccaccacgcccagctaattttttgtatttttagtagagagggggtttcaacgtgttagccaggatgatctcaatctcctcacttcgtgatctgcctgcctcagcctcccgaagtgccgggattacaggcgtgagccactgtgcctggccagcagttttatgatggttgaatagcttagtgacagatgtttttcggctgtgaggcatgacgtgactgtgttctgagacgttgtgtgtgctattgcttctggtcagtctctagagaaggaagtaaagcagaattccatttttatatgtggcaaaggttgtttccctgtcacagtctttccctacctccctcccacctccactgccgacttataaatttatgaatgcaaatgcataaaaggtataaaaatcaagccacatttagaggtatctttaataagcatctttattaaaagttttaaaatgacattctgttttggagaatctgggccatgtgatggttaaaggtggggagggatctactgaggcagtggcactgtctgactgtgagaatgttacaagctttatcttatgatttctaaccaagctgctgtgacagcatcaaggccatgggatctggcctttcctaaatagtatgtttgatccaacatcaatgcttagaaattccagaaacctcagtggtttctctgtcagacaccaggacttcataggctctggcctggcaggagagcagactataccacaatctcctgacagcctcatctgaggaggctctggccctagttgtaaaacagatgctgtggtccgtgcctctccttgcctggcacttctgtgtggcttaaccgaaggcacgttaaagcttttttcactggcagataataacttgctgccagacaatactctagagctcttctccacccttctttgttccagacatctgcctccaccaccccatacagcacctcctgcttctctactgccggcagatctctgtttccttggcatttagctttgggggaacagctgtatgttgtttttttctgccttgcctccaagacctccttacttcaatttcctgtttcctactttatgccttgtggtctgaccccaaatggcctaattacacttatggatgcctttgaatataggggctgtgttgcagtgggcagctgtttacagatgtgaaatctgagaaaatctatcaaaggatgcagaatgccattaggagaaggaactctagactccctagaacctcactcttgagttagattagcagatggttttcattcaccattaaactagtttctaccaatttttcaaaatacatattacagagtatttatttatcattcgttgatattttgatgtccctccagattctattggcagttgtatcatttgttttcttctcttgagaaaattccaataataataatatagcaacaaaagcctaacatttattgagcacttgctatatactagggagtgttttacgtgctttacacatatttcgtttctgtcttgcagtaatcatatgagataggtgcgattacctaattaacagtggaggaaactgaatcccagagggctaacttgcccagagtaatgcagctaagaagtagaagaatggagccagtagtctctaaaccaccttcccgatccgcctcctcgtagttgttttaaaggacaaaacattaaaatgtcattctttttcttaggactttataagagggagagagctcccagggaacttcagtgtttttcttgtttgttttaattattctatttaaatggttcctagacataggtttttatgatccagtggtgcttgctgaggaaaatcttattatgtaaccgcccttttcctgagccttcttgccctcctggatacagatgttttgctttttattaaacttacttgtgatcatgtaattgagctgctataataatagctttcagagtgaaagagcaattgaccttttagcagtaagcactcccaattttcctggaaaggcactttgtcatgtatgattggaatgagattgtaatggtcccagaacaattacatttagcagacatttgttctacagctgtcatatgccaggcagtgttctaggttaccagagtgaataagacagactatgatccctgccttcctgtagctccaagtctaggtggttagccatgactcagtcttactccagacataagtggaacttttgcatggtgaatggctttttgcagggatgaagcttggaaatttggcagacctggagggacaaagcagacacacacctgcagttttagggggtgtgaccagtactgtagtgccaaatgagtcttcagtggaccctaagcaaagccattcagaatcatcaacaaaaatgggttt

SEQ ID NO: 65209 - DNA, 1010 bp, Homo sapiens
gagcccggtatttagcacccttcactgttcctaaactgtctgggtctgcctttctctcacttttcatctggcaaatatcttccaattcactcatattcagcctctgcctgcctgaccaaatttgtctccttctatctcatagagccttggcttgatgtcgaccttgtatcagcacggaagtgagtggcagatttctgtgtagttttctaagtatatcattattttaagtacttttaattcctgtgctcttctattggaacttatccctctcccttcagttcttccactaaatatcccatgcattgaaatttcttttcccaccccaacccattatctctgaatcttcccctctttctaaactatagaatctagagagtcatcagttactgtttctgcctttagttatttggaactgtgcctttggtccaggatttctgtgtaccagtactaaaactgatggccttttcccctcttcctgtcgaactcgtccttttgtagtatattttgacctttgccaccttacccattccggtattcaaggttttacctgctcagtaaatgtttgagctggtttggttataggctattttatcctagaggtctgtgggttcttttctcccataggcagcatctcatattgtgtttattatgtttcacattttcctggtcgtgctgggtcctctcctgtcatttctccttcagagttctcaacacttggaatttgaaatctgctctgccttgtattgagatgacatttagctcctatttctccattcttagccaagatgttaaataaactgaggaccagcatgagcacctccccttacttaacatgttgcctcttttatagtgcctcgtgtaaccttcagtctgagactgcgtgtatttgagccagctgatctcattcttgttttcctttatatatcccccactaatctctaaacactataaagccattatctctgaccatattttgcaccctctcttttccatcagtttttaaaaatgtt

SEQ ID NO: 65210 - DNA, 1057 bp, Homo sapiens
aaaatgttctgttcttgtcttaccttccctttctcctgctaccacctcctctctctctccccttccttccccctcgattttcctgtgtcagactgcctcctccttatgctccccccagcccacctgtgcgctctcccccaccccctcccctggctttagcatgacctgaatttacatttccttcttcacctttcatgcactgacttactgttttttctcagggggtcttatattgctccctggttagtaacaatggactgatttctctcatactccttggaaagtcccttctggggtgtttgcctttctttttgggctgatgtagactagaatcttgtttttaatagcagctgtggattagtcacctcaacattagtagtccaggtcttctagtaaaggatgttactggctggttgaaactgactgtttattctttctctgtctccttccctgcccacctccctctacagtaaactgaatgctgcttgtggttgctcctgtcctctgagtgtccacgtgctctgtgaggagggagaataacaaagaaggaatgtaccagcacattttaatttttctgccccaatcttttgccttagctttggtaactagaaggaaagtcagaggcatgtgcagtcacgatttatatttttttcaggtacagagagacatgtaaggtagatatggcgagtaatcctcctaacaattaggttaccattaagacagttgttcctttgtttggtatcctcaccttctcagcacttcatgctcttgcctttgctacctcactttgatgacctctccctctgtttgctaagtcatagatcattttgccatttttgggcttgtcacatccagttgtatagtgttctcagaaaaccaagggagccattactcagagcccatcttttgtggttctcttccatttgaccaaatcagatatgtctaaggttagaggacaggagcaagcatatttagtgtctgagttttattgtcctgctgatttaaaaacctttgaaaatgatgtaccaccatttttgagcctttccaagagcttgct

SEQ ID NO: 65211 - DNA, 1260 bp, Homo sapiens
agtcctgttactatctcttaatagttatgtgccacagagtgatacactttaacttctgggcccagtgttctcatgtatgtagtcatacctacctttctaggttgtggtgaggtttaaacaaatacatatgaagtgctcagtattacctattacctggcatcaaaaaaagtgttcaataaaatgtacgtatcacatatgatcagttgagtttgttattgggctagattatataagtaaacgttgtcagttgaaagcctatggagtactcttatatatatttatatttttaatagatatattatagttatatatctgaggagtactcaattctcacaaaaaaaaaaaaaagaaaaaagagcgtaggcagagcagaatggatagacaggaagtagatgtggatgatgatggcatggaggaaccaaacaacaagataaatgttagcactatgtgataatctctgtgtgtgcctaatttttcactcctgtgttgatccgaaccttctatttgtctactggaggtactgcaaatagaaagaagatcatgtctctgaagcacttgttcatttctcattgaagagcagtattcagcagaatgcagtggtcatgtccagtgtgggagttttgcagctcttcatttatttgtgtctctacctacttagcttgtagaagggtgtgatcccagataacaggcgttagctggctgcaaaaggggaaagttatatatctctccctcatttttccttatgaatgacctctgagttggtaattgacagggattattgccatttttttaatctctgctaggaggctgctggaatcttccctcatttcattatcccgttatgatggagcaggatccagagagcacccaatttacccagacccagcgaggtaaggccaaagtgagaaatggcactaggtggggggaggggcggcccttggggttgccacactgttggaagctccgttctgtgcctctctggtcctggtgctcttttattcttcagttacagttttgagacaggtggttcaggtgatggggaagtattgcaggtaagtgaacagtacctctggtgacagagggttatgaccaagctcttgtcctttgggactcatttccgcaagtgtggtgctagaggaggaacctggagaggccacaggtagtcataggatactctttttctgttggccagagaggctgttgtcattcagatggacagccaacaggggaacaaaatgtttttaatttatagggaaatta

SEQ ID NO: 65212 - DNA, 1043 bp, Homo sapiens
atctacactgtaggcactgtggtgtctttttgtagtatgtctatttttttcctgaggttactagcattttagcagtggtaccttgccttggcccacctcacatcaggggcaggaattgcctgccagtctctgctggcaactgcatcacatgctttaagtgcacccctcaaactagggggccctgcagcgatcagatgaatgcctatcgttggataacttaaacgataattgctagtgtgtgaaatggggaggcttggatgcctctgcattagagcagagatgtcaatttggaaatcataatagaggtgtcgtttcagaacacacaattattttttacaaagaataagggcttgtcatctcccagcccaggcatgcgccaaggcagagatcggggagttgcagagtaagattcagaaatgaagaaagccacagtgcgttcaagtttatttggcctcctgccccttcatcccctggcaaacattgccctctttcccctgtgggggtctcttttggcaatttacagtccaggagcatcagtggtagtttcccaggcaagtagccagcctctggctttttgatttaatgagcctcccagggaccagactgcactgcatttatcaggacaactatgtcagcactttaacctgagcagcataagtgaccagaggggatgaaggtgatgtaagcagtttctgaaaaccttgttccttcaggagttttagtgtgaggttttgggcatctagcaaccttgtctgagagtcttgtcgccagtgaggggcaaccagataggtcttcttgcttattcttccaagtctggttaggctgctgattcatcacttaaatatttgttggtttcctattacatgttaattaggatgtgagttttgatggggataaaaagatgacttggatccagtacctgttttcatgtagcaaagacaagacataagttactgggtgacttgagaaggcctcttaagagaggtacaaaatgctataggggccgggcgcggtggctcacgcctgtaatcccaacactttgg

SEQ ID NO: 65213 - DNA, 1366 bp, Homo sapiens
agtaatggctgtttattagactgtactggctactgtgcttgacacaggttcttaatcataataaccatgtgaaataagagatttcccctcaaatgtggaagcagaggataatgaacttgcccaaggtctcacagccagtgggtgacacaagatggaatttaaactgcagtctgtctgattctaaggctcaaacactaaattgcctcatattttagttactcagagttttcttggttagtctcagaccattaagatatatcaaaaggttttataacagcagcactattgacatttggggctggataattcctcaccatgggaggctgtcctgtgcattgtaggatgtttggcaccattcctggccttcacctgtcacatactggtggtgctctggcacccagaagcaaaaaccaaaaatgtcagcagacattgccacatttctggggggcattccactccccttgaaaagcactggtaaattatttcatgatttgttgtcctttgatcttgctggtttttaaaaatatgacattaggccgggtgcggtggctcacacctgtaatcccagcactttgggaggccgaggtgggcggatcacccgaggtcaggagttcgagaccagcctggccagcatagtgaaaccctgtctctactaaaaatacaaaattagctgggcatggtggtgcatccctgtaatcccagctacgtgggacgctgaggcaggagaattgcttgaacccaggaggtgaaggttgcggtgagcctagatcatgccattgcactccagcctgggcaacaagagcgaaactctatctcaaaataaataaataaatgaataaaactatgacatctcacaaggaactgtcagtgggttcaaaccatcttcttatgatagttaatagtactgcctggttctggtggtcttgtgtcacgcctttctctcattgcttctctcctcttctgtcttatcttttgtcttttgtctctgatttttctaaataaagcgcatctgggtaaagcggtgtttgtgggactttttacacaggtatcgatttagcaggcattcagaactctgagattatagccattagtgctaataaaaagaaggcaatttacatcttctgattatagtacagggggaaaatgcataatttttagcaagcagggaattgaatggcttccagactctacagagttaatcctcctcagggtagtattgattgacatgctggaggacgttaatgtgcgaatctttttgggaacgggggaggagagtggaaattgcagtttctctactaattgtactttaggtgtcgtttatgacaatttcatgttgtctagacagagggaaatggtggagaaatta

SEQ ID NO: 65214 - DNA, 1930 bp, Homo sapiens
cttcctggatgagtttggttcttcctaataacgctgagagttgggcttgtaaactgtgattgatccatgcatccatccattcactcattccattaacagatatttaccaagcacctgctggatttcaggtgctatttattttactttattttgagatggagtttcgctcttcttgcccaggctggagtgcaatggtgcgatctgggctcactgtaacctccgcctcccgggttcaagtgattcttttgcctcagcctctcaactagctgggattacaggcgcctgccaccacgcctggctaacttttctgtatttttagtaaagacggggtttcaccatgttggccggactggtcttgaactcctgacctctggtgctccgcccgcctcggcctcccaaagttctgggattataggcctgagccaccgcacctggctggcaccaggtgctatttaaatgccagcaataattctctcattctaatgggagaaagacaataaaaaaataagatatctagtatgccagacagtgataagttctatggcaaaaaagagaaatgtataaaaaatgtaggggatgctgcaatttgaaataggatcatcaaaaaaggtttgataaggttacactggagcagaggagaccttaaagaagtgcgaaaacaaaccccgtcgacactaggggaaggacattttagacagaggaaagggcgaatgcaaaatctctgagatgcttggcaccgtcagccagtgcagctggagcacagcaagggatggagtgatagaagatgaagttggagaggtgacaaggatgagattatgcagggtcttctaagccatttaaaagatttttgccttttcctttgagtgacttgggaaaccatcagaagtggagtagcatgatcttatattttaaaaagataactgtggctgctggttgagaatagacctaggagctaagtagcgtaaattaaagctaggccaactctgcacacttttagattgatttgtgtcttgagactgtgttgagaaccaaaaaggaggagtgacttgttctgtcaagataagagaggccttaaatgtttgggtgaagagctgatgaacggttgaacaaatgaatgaatcaatcatctcagcaggcatattacctgcaacaaagcccctccactcttccccaacctccaaacaagaaggcgtgttatcgaactgtgaggaagggagagcttgaaaaattaatagtaaacaagagatcataaatggaaatgaaattcctgttttttgctaattacaaaactattgtcaattcatttgtaaaaaatcaaacattacagaaatgtacaattgtagaaagtggatatcctcttaaagccactgctcagagatctgctattaacaatttgtgtgtgtgttaactccagaattttttctatgctaatcaaaacacatttttccatttattttaattcttttccttttttttttttcttttgagacagagtctcgctttgtagcccaggctggagtgcagtggtgcaatcttggctcactgcatcctccacctctggggctcaagcgattctcgtgcctcagcctcccgagtagctgggattacaagtgtgtgccaccaggcctggctaatttttgtatttttagtagagacagggtttcaccatgttggccatgttttgttttctttttcacagtgttgcaggatctttgtgtacttaagtgtttttagaagatgaagttctagaagtggaattgctagtgcccaagagtatgagcgttgttagtggtaaatgaaaattaattgtatgctactcattattactaatgtaagatatataaagtatttcttatttcctgttttatttaactgaacattatttcatagatttcatagattagaactcttaaggccgggcactgtggct

SEQ ID NO: 65215 - DNA, 1510 bp, Homo sapiens
cagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggtaagcagtcgctttcctatcttctgcatcccttgcttttctccttgtatcatttccttgagtcctatagatgttgtggctgtatctggagtgtctgggacccacgcatctgcttctgatctcgccattgcattttcttggaaaatcttgctctggtggcagagataggatagggcctagcagtatgagtcagttggctgcgctagctctatttcggctaagctcaaggttctggctttagccttgaaaggagagtgtagattaggttagagaggcatgaggagatggaaccattgactttctctgcctgctttttgaccttgtcgagacattgtatgtgcaggactacttattgtagtagtcccagagtgcctaggaataagtaaaagagaaccctgcatggtagagattagtatattggctcttcgctgattgtattgctttggacaactgagttcacttcctaatccttatcttttggaacactgcagtttgacaaagggaaaagaaaaaaaaatacatatatgtatatatatgtatgtcaagaaaaattccaattttttcagagatacttgtttttgggcagcctattgctcagttgagattctctgaatggaccttccaggtggactttcaccttggggtggagaagaagaataattcatggaaggaaagactctccatactcagattggcatcctagccaactctttcatgggagaaacagagtaggtgtagttgatcgcccaccatatgttccatgtatggctatgtgcgcatctatcttgatttattagggacttctttctgtaattttgtaaaggtcaaagctagcataatcaccaactccaagaatatgcctgttggatccaaacagcatattgcgctgcattacatcctctgtcgaagcaactgaaatttctctgacataagcttctaacaagggtgggaatatgaattatgcacataatgtacttgttattttgggaggatgctttagacagtcactcagtcaataagtattagttgaatggttacaaattttctaacactgtgctaggcactgtgggaaatacaaaagaagtataatacatggtctttacccacctgagtctacagtgttattgtggaggcaagacaacgaaatttttcaaaagtatagatgagcaaatgcttcattgtatggtaccgagattggatgtagtctcagagagagggaagtatcatccaagaaggctttgcaaaatcaagtcttgaaagatggataggatttggagagagcaagacctttttattttagggaaacagcacatgttaa

SEQ ID NO: 65216 - DNA, 1097 bp, Homo sapiens
ctcctgacctcaagcaatccaatctccttggcttcccaaagttcggggattacaggcgtgagccactgtgcttggcctgatcctttctttagctacaaggttgagctatggagaatatgagagtatgaaatatttttggaagaaaaattctgggaggaagggtcttttctgagaaagtgtcattaaataggaaaagtataatttcccttttgagctagaattgtatttgcaattagaagcttctcgttgcagaagtcgttctttgacattattctttgttccttaagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaaggtaaggaaaatggctatatttcacataggatttgtgctggtgatggtagaatgagaccttagaatgggttaacagcagagagttgggatatatttatcttgtgtgggagagttgacatatctgacttagggagttgtttgtaaatttgaaagaactaatgtgctagaaatatctttttcctttagagctagacagttttcctgaaggtaatttaggtttatctctctcaatttgtagcttgatcattgtctccagtttttaagcctacactgtgaatgctaatctagaatggttaatgtgcttttgagatacggtgaaccatggtctacaaatcatgtattttaactttttttttttttttgtctcccagagagtagaactgccggatagtccacgctctaccttcttattggccttcagcccagacaggtactcagtatttatctataacttaagatttgtgataacagtgctttctgtatatttggcctggcttgatcttccaagtcagtccctaaagtctctctgaagtactgtatgaacagcactttggcc

SEQ ID NO: 65217 - DNA, 1012 bp, Homo sapiens
gagaaggagctttgtgctgacttgagctggcaaacttctgtcatacttactgagtgatttgtatagaagaacactggggaccttttgcccaggcataagaattggtatttgtcatttatagaatatcagcggaattgaagccagaaccattgtaaggaggcaaatgtgagagattatctgttgcttttgggaagatagctggagttttcaaaccatgccactttgtacttccttgagggtaacacttgccacatttcagtacagtggttatggttacagtatattgcagttgtagtctccccacaagctctcagaggttagaggccttttttgttcatttattttttttccagttctctatccctttcttggagtagggcttgctgcatcgtgtagtcttccaaaagtatgctaaatggacaaaaatagttgaaccaagatcagcagatgtatttagaaaatgacttgtgcctacatgcttgttaactgtcttgaattttttctgttgtcatgtgttaatatagaaaaacctgataaagggaaaaaacccagtgttgtatcattaacctacagtttatctcttactggcttaaaaaaaaatattaacagcaatcaaattactgttcaatgggggggcaagtaacatcacgttgagctagggttttgtctgtaaaatgggagtggagtgggaggagactttagagatggggtatataaggcattggcacttaatagtggtcatacctcgtattacaaatgaatgtttttaaaatgatcagcaatatacttcacatttctacctgaagaaggaatgtaattttggagaagcttatacatgggagaattatctccacttgtcattttctgctgaaaagatataatttcgtacttctccctctgggcccacaggatagttccatggaggagacttagagtggggatgggctcctagagtagctgcagaagaccttgctttttttttttttttttttttttttttgagacatggtct

SEQ ID NO: 65218 - DNA, 1079 bp, Homo sapiens
accatgttggccaggcagatctcgaactcctgactttaggtgatctgcccaccttggcctcccaacatgttgggattataggcgggagccactgtgcctgacctgaagttgtgtttctttaaaatgagctgaagcaaattttatatttcatgatttcatcacttatttctactctctagaatagatcacaggtatatatacctatagtataatgaagcatctgaaattttgctgagttggagaggattaataagcacatttgatttgcagagaaaattggagtattttattctaggcgaccactgaaaacaggacagaaaaatatctctccccagacttttgaatagcagcatagtggcactgagtcctggagccaagcagcctggttcaaattccagcacccctgcttactagctatacaacttgggcaagttacttagtctctctgtgcctctcctcatctgtaaaataccatacagttgttgtaagaactaaattagttaatatgtataaagcatttagaacagcactaggtgctgtatatgccagttgttagtaacaatgttattataacaaaataaagttttccaaaagaacacatgataatgattcttagattgaagtttagatgctttgggaaaactttaatagggaataggaagttaaaacagcatatttgtccctctttccccacagtacccttcaaaataaagtaaaaggatataggttcaaatcctagctaggaaaaaaaaagtaaaaagatggatctttatttttaattaaaaaattatttttttattattttttggagacagtcttgctctggtgcggtggcacaatcttggctcattgcagcctctgcctcctgggttcaagcgattcttgtgcctcagcctcccgagtagctgggattacaggtgtgtgccaccacacctggctaatttttgtatttcttttagtagagtcagagttttgccatgttggccaggcttgtgttgaactctggcttcaagtgatctgcccacctcgatctccctaagtgctggaattacaggtgtgagccagtgcgtccagtttta

SEQ ID NO: 65219 - DNA, 1375 bp, Homo sapiens
gctggactcaaaactcctgggctcaagtagccctccccaatagctggaactacaggtgcatgcacctggcttacatttttttaaattaattttttttttgagatggagtcttgctctgtcaccaggctgcaggcagtggcgcaatcttggctcactgcagcctctgcctcctgggttcaagtggactacaggtgcgcaccaccgcacccagctaattttttgtattttagtagaaatggggtttcaccgtgttggccaggatggtctctatctcctgaccttgtgatctgcccacctcggcctcccaaagtgctgggattacaggcatgagccacctcgctcggccatacatttttatactgtataattttcacaatattttcaatatgtgttaggaaacttataaaacttttgttttgatcatgtagctttatggtgcttattaatatcaaatccaaacattttggtcctcaagcatattggtgaatgttgtctgtttaagttgacaatttttagaccgggcgcggtggctcacacctgtaatcccagcactttgggaggcgaaggtgggtggatcatgaggtcaggagattgagaccatcctggctaacacggtgaaaccccttctctactaaaaaatacaaaaaaaattagcggggaatggtggtgggcgcctgtagtcccagttacttgggagactgaggcaggagaatggcgtgaacccggtaggcggagcttgcagttagccgagttagcaccactgcactccagcctgggcgacagagggagactctgtctcaaaaaaaaaaagttggcaatttctctcacacttccaatttatctcactcttaaaggaataagagaaaatgttttgttgttagcacagagaggtgtctttttctaagatatgcctcagccttggtagagttattttggagtggaatccgcatttttttgcccagtggtttggtttaccccaaaaaaacttaggttcctttaatcacagtcattcttgtttcattctccaattgttcctcataaactcagagagagctttcagtgtcttaatttctgtttgtatagaaatgctgtggtacagcctgtcctgtggtttggggtcatttatattttatcttttcaggctcccccaagttaatgtgatcaatttttttttgcacagctaaaattagttactgatggataaaaattttatgattagttattgtcagcatgtatttatgtgtccagtagtatgtggcagcctgccaatgtaatgtaaggagaaaatagattaagtaatcaggagatctgggtttaagccctaggtttactacctgagaagtcttgtacaaattatttaaggaggctgtaggga

SEQ ID NO: 65220 - DNA, 1062 bp, Homo sapiens
atcctccttctccccagcctctttggaaatcttataactatggtgtttgtggttagaggttagagtctagtagaggatggtcaagactttgaaggcaaacgcttgtcctgtgagggtctgctttctggggagtatccaatggaaacccaaggagtctgtctctcttttttcttttttttttttaagacaggctagctctgtcgcccaaactggagtgcagtggcgcgatcttggctcactgcaacctctgcctcccgggttcaagcgattcccctgcctcagactcccgagtagctggaagtaccggcgcgcgccaccacactcggctaatttttgtatttgtagtaaagacggggtttcatcatgttggccaggctggtcttgaactcctggcctcaagtgattcgtccacgtcggcctctcaaagtgctggaattacaggcatccaccgcgcccgcccagttttgttgtatttgattagtagtttggtcactgcacatacaaaagctaaaaaaggctgtgtgtagaaatcattcaaatattgagatatttaaatgaaaggttaacgctttgggaactcctttgtggttcccttttccttcccagcttggaaagtctggggactaagtctgttattttcatcggattcagtaccatgatcctaatttgtgtcacttcattcttggaaaaaaaaaaattcagcctgtcgggcgcagtggctcactcctgtaatcccagcactttgggaggccaaggcaggtggatcacctgaggtcggaaattcgagaccagcctgactaacgtggagaaacctaaaaattcaaaattagccgggcgtggtggcgcatgcctgtaatcccagctacttgggaggctgaggcaggagaatcacttgaactcgggaggcggaggttgcggtgagccgagatcacgccgttgcactccagcctaggcaacaagagcgaaactccgtctcaaaaaaaaaaaaaaaaaaaaatcagtcttgaggtcattctgggttggataagtttccaaagtatgtagaatcagtaagagagcgtt

SEQ ID NO: 65221 - DNA, 1070 bp, Homo sapiens
ttcctcctttgatgtctggggcgttcttgtattcggtgatcttttgcgccgtcttcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcaggtaggcccaggaggagcctgggaggcccagcccggcatccttccgccgcggggttgagaagaccttggcgccggcgggtgggcaggctggccggccgccgtgacactgccagaggaggggctaccggactgcgttgaggggcgcggccggaggggcagcccggaaccgagggagaagccgaaaggagggagagttgctggggcttcccggtgtggttctttagggaggagatgttgggtctagggcacccccagtgtgtggcgaaaatggctttccaggaaccgatagagctttgcgcactttgaccctccttcctttctccttttccccccaccccgaagtctccgggtgtcatgcctcaattgcactggggacccctactgagtccagcctttgaagggacctttgagtaggtggaggcttatggaacaaggccctctggctcttctgagcgaagtgttatgttctcgcctttttctgggtgggtaaactgaggctgatgtctgggacgtgacttccccacatatccccaacagatcattaaattcactgtaagtcactttttgtcgtttaccaattcccttccccccacttaccagtcaagttatgaaaacagtgagttattgtttgatcgtctgtgatcccaattttcctaggaatatagactgttaggaatatagatcctgtcacaagaggcttcagaagtaaaggaaccatgtggtttcttggctgttttgcttttcaaagtctgtatcattttaactagtgtagcaatgacagtttctttttgtttcttgataaccttgttgtctactttgtttc

SEQ ID NO: 65222 - DNA, 1034 bp, Homo sapiens
tttctttttaccatagcattttccgcttggtttttctagtgtgctttggcgccagaggctgttgtattttcttgtccattgtcagtatatgttttctgaatttcacttcctgtttctattccacttatagtcatttatgatttatttgggccttccccacaggtgacagttccttctttcttcgaacctggctcatgaccccacttcacattcctgaaactccagcagaatatcgctataacatggcccattctgcaactcacagtgtgattgagaagactttccgaaccctctgctcccgattccgctgcctggatggatccaagggggcactgcagtactcaccagagaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagacagcggctccctactatccagtgaactctaggttgagtaccactaatttgaaagctcagtggttgcaaacatttatgactgtgcctacaaagtcatagtaaaggtcaggagttcaagacaagaccagcctggccaacatggtgaaaccccgtctctactaaaaatacaaaaattagcggccgggtgcggtggctcacgcctgtaatcccagcactttgggaggccgaggcgggcggatcacctgagttcaggagttaagaccagcctgggcaacatggcaagac

SEQ ID NO: 65223 - DNA, 1692 bp, Homo sapiens
cttttcttgttagactggtttgaacaccccagcatctgtcctgtatttgtcaggtgaaaccagaagtctttggataatgaaacccgtgaccaattcttacccaaggtggttatgacatatgtcagctgcttcttggcctatatagttagaagccgacctcttttaccttgtgaataattatgtcatcacctccattattcttttggtgttctcaattgaaatgccaagcattaaatgagccacaaagattgaattcccattatccttgaatcagagcaagcctgtcgtgcagccatgagttagtggagaaaaatccggagttgtaagtacagtacgttttgcctcaacaaaatggaaatttgtagaaaaggagctgctccagcctttgagtcactttaaagtctttggtaggttcctaatgttttttcttttaacatttacagagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcagcattgggtttttatacctcaggttccttccagactcggatgggagatgccattggaatcagtcaggcgtctatgagtcgttgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccaaatgctgaagacctctcctatgtgaaccgaaaaggcctgcattctttaaactgcctgatggtgtgtgacattagagggacactaatgaccgtggagacaaactggcccggcagcctacaggactgtgctgtgctgcagcagtcttccctcagtagtcagtttgaagcgggtatgcacaaagatagctggcttctgggtaagtttgcaagtgtgaattttcattttgtttggaggcatagaaaagttatgtaggctgggggcggtggctcacacaaccccagcactttgggaggctgaggcggtagatcacctgaggtcaagagctggagaccagcctggccaacatggtgaaatcttgtctctactaaaaatacaaaaattgggcatggtggcaggcgcctgtagttccagctactcgggaggctgaggcaggacaatcgcttgaacccagaaggcagaggttgcagtgagccgagatggcgccattgcacccccacctgggcaacagagcaaaaactccatctcaaaaaaaaaaaaagaaagaaagaaaagggaccgcacgtgtagctcatgcctgttatcctagcactttgggaggccgaggcaggcagatcacctgaggttgggagtt

SEQ ID NO: 65224 - DNA, 1434 bp, Homo sapiens
gggccaggaagtacggaagaccagacacattggaagtcgggagcgaaaaagaggctggccgaaccaggtttgggaagcgactctgccacttttaaagggcaccctaaaaacggatgtcaaagtctgattgcgccggccactcagttagcccaggcccgtcacccacctctccgcggctgccaggttaccagccacacttcccacccacccagccgggttgggccctcctccggaaccggcgactgcacagaggccgccacggcgcgcaacagcggcaccgccccttccgcgtcagcgcccgccccgcgccgcgccctcactgccgctgccgcggctacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagaataaatagggcgtccgtactgtagcgaaagtgcgactaaggttaggcatctggatttcccccgtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtactaacttttgcgggggataccccaagatctctcagcgcccccgggtgggaggctgtggatctgcggccccttggctgctgcttcgtggaagtagaagggattagccacggttcaatcccctgggcccctgagttttctgtgggaagttgagttggtctaggccccgttggcccctgcttgtttggcagagaatcccctccaccccagagctttcctctccactttttcagctccttgggttaggtcgtcaggcgttttggaggtaatttggggggccataactccggggttgggtgccaatatgagtgaggtaggttttcattcaatcaagatttgctgagtgccaaatatgtactccgcgtgtaggtgagggtgactgttgactagtgaaaaaagggacccatggttcacgactgtcttcttactggcagtggaacgacctgtggaaacctgtgatccattctcattaaataaatctctgggtaagtggctaagcac

SEQ ID NO: 65225 - DNA, 1037 bp, Homo sapiens
tttctctctgtctcctagtctggagtgcaagggtgctgtctgaactcatggcagcctctgcctcccaagttcaagcgattctcgtgcctcagcctcccaagtggctgggattacaggctgcggcaccactcctggctaatttttgtatttttagtagagacgggttttgctatgttggccaggctggtctcgaactcctgacctcatgtgatcccctgccctcagcttcccaaagtgctgggattacaggcgtgagccaccgagcttggccttttaaaagttttattttaattaagacataataattgttgtacatatttataggatacagtgatgttttgataaatatatacattgtgtaatgatcaaatcagggtaattaggattgcctgagtccaggagttcaataccaacctggccaacatagagagacccccatctcttttttaaaaaattgcatagcaagagttgcaggatttagtaactggatagttaatagcaaagggcagaaaaaaggaagttgttcaattgcaggtttctttaatgtttgtatcaaatttacctttgtattcataggagcactcaaagaaagaattttgcaaagagcaaagcgtaaagtaaaccttacatacatttatcttgtagaggatgaattgactgcttggttaactggacctaagggaacacataggcctgggagataactttttccctagtggagactgcaccctttttggctcaataactgtagttacataatcctttcaatgctaccagttgtacaaaaagtcattggagccattgtgccgttataatgattgcattggtagataatctgatggtgataatccaattcttacctttagtgtaagataagggcagtataatcctgcagcgcatttctttctttctttgtttttcttcttcgtgagacagggccttgctctgtcacccaagctggagtacaatggcacagttgttagtgttctttttaaccaaaattaggaatgtctgaagtgggtatatgtttcaaatgc

SEQ ID NO: 65226 - DNA, 1433 bp, Homo sapiens
tcatgaaatccatgaatccccatgaaattatatgcaaacattcctatatgtatgtttttttctggagaaagggcttttgtcaatagattctcaaaagcccataactccccaaagttaaattgatttagtggcctttgaaggaatataaattaactaatgtgtgttcagcaaagtttatgtctcattaaaatttagtcctgaatctgctggatgatgaaataattttgaatggataattaaagctcaaagtttcagaatcaggtaaaatgttctcattcattttttaggttcctagatgtagctcagtgtggaatctgttttcctcaagagatagtatctcagtatttttcactttggtatctttagttaaaggaaatttttttcctcccactcccacatgattattcctaggctagtagacaataccatctctgtatgctttgatgtatcaatgcctttttaaagatattagtcatatttttttcactttttttttttagattcctataggcaatggaaactgatctcaattcccaggacagaaaggacctggacaagtttattaaattttttgccctcaaggtaatgtgtccattctcttgagcctagaactgttagaaataacttccgtgcttctcccttttgcgaacaactctctttggaaagtagcataacagcttgcagcttgcccattttaagggatacttctgtctgttgtcaaccaaactgtgaggtatgggggcggtattgggggtgtagctaaaatgtagcttccaattttccacagctacttgttcaaaaaaaaaattttttttttttttgcaagtctgtttgcagaaatgtcaaactgttatgccaggttattggcacagtatgttccctttgggtgggaacaaagaccatcagctggaatgggcagcattttggacatctttccttaagtttcaagtaatcctgaaatgttcaacttttatatattcttcccttcctggtaaatgaggaattaaaattgaattttgaatgccatattttcctaaatctaaaaatcatttctacctatgtcactcctctcaaccattgccatgctagaacaatccatgtagttgattttagttgtaaaattatgtggaagacttttgccatatgggccaaatgatatgaataattgtggaatttttgttttaaatctaccatggtgttataagtttgtggcagggaatatttaaaaccacagttggacacgtttctttatgaacatcatagccaccatgctcagctttccttctgccatatgagaatattacagtttccaagcctcaacctgtaattcctttcattggttgacactgtaccctcaggaatgtttataaagttattttttgtatgtggtgttttttctgttctcaaaaattaaaattatactgtttcccaaa

SEQ ID NO: 65227 - DNA, 1032 bp, Homo sapiens
taaatagcaacattcccatacccaggggtgatggagggtgtgattagagaagaggactttctatgtcaaaggggcctcaggacaaaggagagaatagaatgactttggagaacctggtgacttcggctaccagttctgcgcaggcttgtgctccacacatctgctgggcttagcactgaaacagttagctcagcccctgggaaaacggggagcaaggaacttatttgaggcctttgggaagctccacagcttggaatcccaatcccagtacaaacaagtctgtgttttcttctctaataacggcctcatctgtccctaacccctatcacgtcaggccccctgcactgtgggcatgtgggcgggagccattccttatctctctactgagccatcttgtttgtcacgctctgggattgcctattttttccttgcctttccttttctcctctttgtttttctcttgcttagctctcaagctctcgcctttcctatcagcctgctgccctgggcgttggatcagctgacctggcttatccagtagtgtttgctgctggcttaaatgctacacaccctcaccaggtatctttaaagatggggaggactatgggtttccagtgctgcctcccctgcccggaggcaattgaggggtctctcaaggcagagggatatgttctaagtgctatattctgaagcaaaactctttcgtgacttcagagaccaaaagtgactcgagaggaaggagcctcttagacttcagaaaggaaagaagacttttccaggatttttctccatttcctttttcctctgtagtcattagtcattaccgtgcatttcttccattaactgagtttcagagaggataaagatccagggattgctgcctacttggtggcagcgttggtgatggaaaagtcaaaagcagataccatcatgctagaatgtgaagttcccctcctgcctggcatgccatgattcactgtctctttccatttttccccaaagctgatggttcctgggaaggaaggtggggta

SEQ ID NO: 65228 - DNA, 1005 bp, Homo sapiens
ctagacctagaagcatctactgcacttgatccagatttccttcatagggatcagatgtgctggtgtagacagaagggatggacaggtggagtctggtctggggagacattttggaggccgataaacaacaaggcattttttgtcatgcctttggttaaaattcataatgaaattcaactctaaatggagattttccactgatacccacttaggtcctattcgtggctaggcaaggagtttgaaggagtgggacataaacttaactagtggagaggaatattatcaccagcattagaagtgaacagtctgggagagaaaagtgtaaagatttctctccctaagataagcctgaaagaaccttttgataattgctagaaggaaagacttgttcatagcttatctcctctgtggttcaaggcaagctaaactgactctgtcttgtttttgaagaaaccagctttttctaaagatgacattcttccgatggacctggggaccttctatcgggagtttcagaacccacctcagctgagcagcctctccatagatattggagcacagtccatggctgaagacttggtatggaaacgtcttcctctaccacagtgcatccttatttgatggtcattcctttgccaaaggcctaggaggcctaccaccttctatcttccctgtaataggaaagagacataattagaaaattatcttttgatcactcttgagattggcattgtgcccagcagtcattatctggaatttgcttgagcttggttccttctttctctgcacattctcagcattacttacatgctcctgttgttctgtgcctgacgtcttctccttgcagatgccactaggccaagttgctctaacagccattgcattagctatttagctttccaggcagatgccagtggtactgggcagaggagattgtgaggtcctgagtatctgtgttcttgctctttcctcagagagctcactccgtcatctagcagttctcac

SEQ ID NO: 65229 - DNA, 1043 bp, Homo sapiens
tagagacggggtttcaccatgttggccaggatggtctcgatctcctgacctcatgatccacccacctcggcctcccaaagtgctgggattccaggcgtgagccactgcacccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaactgctcatctggatgttggggaaatgagttgggtgtggaagttggaaactggatgggaagtgtggtgcggtggaggaagaggaacagatggggcctcaggaagtcccctccccagtccgtctgccgcttcctcatcttgtgcactcgagtggtgatgagggcagcttcctgaccagcttctaggcatggaggtgtccacggccaccttcccgttgtttgtacccccagcattccagcaggccaccatgtgctgcatcctatgaccagggcctctcctgtttcccaactggaaggtaccggaagtttgaagggatcttagatttatctaaggcaagca

SEQ ID NO: 65230 - DNA, 1092 bp, Homo sapiens
tcttccctgggaggcgcctaggcccgaaagcctgcagcgcacctgccccaagtccagccccaggcccaacagaagagatggggactcactgaggaagcccaccacatgggggtagaggtcaaaggtgagcaggggctcaggaagctcccggaggaaggtcttgaggatgactgctggcaggtgcagctcattgtactggtcgaaatccacaggcagccctggggtgggggcagcgtgagagaagctcggcacagcctgaagggcagcacccatctgcagacaacgcgggccgcactgcctgactgcccctggacactgcataagcccctcctcccaggggcgccctctgacacctgcctccctcttcctctgtgatcagagaatgcaggttccggccatctggggaagtggggcccggcacaccccaccgttattccttgcctctgaatgtgcctatacccaggacccgggagcccgaccgatgaggcagcaggcctggcagaagtaggacttatgtgacacccagagccacggaaacctccagcaggaagagactctgagactctcatttacagggcagcagagggcagagaagccccctaccagtaacacacatatggccctgcaacagcccagggctgctcacccatgttgtacttctgctgcacttcccggaccacttgggtgttggccgacctccggaagatgccctcggtggtgagagctgggaaacagtagggcctggtgagcctccgagcgctgggcaccggctggattccctgccccttctctgtcttggggttctaggcagggctgggtggggacgttgaggcttgcaggacctccctctgccctgcccagcagcttccccagcttcctgaagggagccgggagacctggctggtgaggaggcaggcccggcactcaccgtgggcctgtaagtaggcaacagtctccctgagtacaatgggaatgggctcctgctctggattcttctcctggaggctgcgggaaaaaggctggtgagccgggcctgcagcccttcccgccccgccgtggcccagccacctttcatacttactgctgcagcga

SEQ ID NO: 65231 - DNA, 1003 bp, Homo sapiens
agtgggcggggctcctggaaaggccatgtttggggccggaagtgggttggaggtgtggcggaaatggttggggatagaagagagcgggagggggcggttcccgttccaccgcggagccggatgtttgccgagccttgacaggcgtggcagagggagcagtgcccgagcgcggtgagctgctgggcgcggggtctccccgggtggggatggggaaaggaaaggagctggccaggtcgtccgaagggatggggtccggatggggaggaccggagcagatccgaggaggggaacgggggtggaactgggctcagaggcctggccttcctgcagggtttctgccccattttggcgcctgcaataagaggacttaatcattttcactaccttcttcctgccttccccagggcagagtccaggccggatcgctgtcatccagcaagccggcgggagggggaaatctcccagatctgatctggcaaagcactaagaagaagaaatttgggggaagtgttcctccttgccacttattaggccacgctttcagttcaacttatttatttttttaagacggagtttcactcttattgcccaggctggagtctcggttcactgcaacctccgcctcccggattcaagcgattctcctgcctcagcctcctgagtagctgggattacaggcgtccgccaccacgcccggctaatttttgtatttttagtagagacagggtttcaccatgttggccaggctggtctcgaactcctgacctcgtgatcctcccgcccccgcctcccaaagtgctgggattatagacgtgagccactgcgcccggcctcagttcaacttcttaatctgtgaaacaggataattgcaaaacgtaacctgggctttgtaaaccgtgaagctctatgcaaacataattgtagttgagagttgtaattgctgttgtattgtggtgggatttgcaactgggaggccgattccaacgttgagaatatgatttct

SEQ ID NO: 65232 - DNA, 2122 bp, Homo sapiens
atggctggaacaattagttccgctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcggtgagtgacctgcgatgtccgcgaccctcaaccttggcccaggtggatctgacgctctgtggtcagctttctcctcagtcttctctcctccggatcccaggatcctccagtgccctcagagtcgctgggggcttctgaagagcccttgagcctcctcaaaactttcagggccctccttagagccctcacctgtccctcgggctccgcaggcccacctggacctgcggtttcctcccacacttttccccacctcccaccttcttgggtggctccctcactgtcttcccttctctctgcagcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggaggtattgaaggatagagcgacttccctccgcccttgaaaatgtaggggaggtttggacattgctagacagcttttcaatttgaagaaagagagtatttcaagagataggagatagtcttgtcccttctcttcaggactgtctcctctcagcagcagtagttaaagaatcgaggtttgaaaagttgttgaaagctggaatcatacagtgtcagcagtgagtgaggaaggtcaagagctaaggtttttggaattaagaaagcatgggatcaaattccagctttgtcacctagctggttaaattacgtgccgcatttaattcatctgtgaaacaaagcagtggctctcttgggattatatggaggagctgatgaaatagtgaagataaaaggtttcactgcacaataagtaccattttattttatttatttttcttttttcttagacagtcttgctttgtcgcccaggctggagtgcagtggcacgatctcgccttattgcaacctccacttcccaggttcaagtgattctcatgcctcagcctcccgagtagctgggattacagatgtgcaccaccacacccagctaatttttgtatttttagtagagacagggtttcaccatgttggtgaggctggtctcaaactcctggcctcaagtaatccgcctgcctgggcctcccaaagtgctgagattacaggtgtgagcccccgcgcctggcccaataaataccattttaaaaagctggtgttccttattactttttctgtttagtactcactggaagacagtaatgtgttcaatttagtaattctccatacccttgggagggaggtgaggagacagactttttggtccttactgaatgaagaatcagacagcactgtcctgttagaggagaaccagaggcttctaaccttccaggagtttcatcttaaatttgtcccaggaaagtttcatctagtttctttttttattcctacccgacccctcgaacacatttgagaaggacttttgttggtttatttcagaacctgtcattaggcccatggggagacgtgtgtgcctgtgagcagagttctggctggactaggtaagtcagaggagagtgtgtcgttcctttgaggttttctgttgtggtttgggatggaacccggtgctgactgtcatttcctattcagtgctcttttgcagtgaatgttccaaaggcacggcgtcctttaggacccagactgcttggggactg

SEQ ID NO: 65233 - DNA, 1232 bp, Homo sapiens
ccattcgatttgcttccaaattgaagcgcctgtccctcaaggagctccatgggtgtgaccatcctggtgctaagcaaccagtcagcagtagcgctgccaacgaccactgcctcactgggtcccttcagcagcgcttaaacaataagcaccctgtggcgttcctagggaaggaggcagaacaacaagctctaccggatgtcaattcaaacatctctacttcagaagaggtttgacctagtatgcttggaacacgatttggtggttcttaagcaggaagggaagtccttgatctgtctgtcatagtagactctaatccctactaggcaaccccaagaaagaagatgcagacacgcagcagtgagaaagcacgagtctttatggagctgtgtcagcaaaaggcaaagctgtcaggtgcccatctccacctccaccacctctgcccaggcgccgaggcccatgtccttatggattagcaccaggctgggggcggcatctggctcctctggcaccacaaagcacttctcctggctttctgaaatggtgacctcaacaacatccctggcgggggagacttcctcctctctgtgtgtgtccagcagttgtggctcagcctgcaggagcaccacagtgggctcagaagcagcagaaggcacagagggtgggctgcagggtgcctcaggccggtgactgagctgatgccgcctgaggctctgcgggagggtgtagcccatgccacaggtggggcagcggtagggcttgtcctccaagtgagatttgaggtggcgccgcagcttggtggccagcgtgtaagcacggccacactggggacagggaaagggcctctctccggagtgcaggcgctcgtgagctcggagcgtgtgtgggtctcggagggccttgccacacaccgggcacaagtgggcctccccggtgtgtgagatgagatggcgccgcagttcaggcagctgggggaaggcatcggcacagtgtgggcagcggtaaggacgctccccggtgtggagccgcaaatgcccacgcaggttgccccgctgacgaaacgcccggccacagtgcgggcacaggaaaggcttttctcctgtatggagcctcatatggttccgcagggagccctggttggccaggggccgcccacacacagggcatgggcaaggggcaggggcagctggcacctggtgggtcttgcgatgcagccgcagggagggccggcgggc

SEQ ID NO: 65234 - DNA, 1528 bp, Homo sapiens
ctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaaggatgagaaagtgagctgagtattcacctctggaataaattccacaggacctccctccacagtcagaaaaactcttcaggatgaaaaggttctggattcaggaggagattttgggcagttataaagttcaaaggaactttcctattgtagcccaccttcaattcaattgatgtccaagaaatgaaagattgatggaagattaatcctgtaaaggttccagtcatcgttttcaggtggccccggagcctcctgaaattaaacttgtctctcctttatagtgggaacatgggagtgggtatttgttcactgaagggatgatggaggcgtttgctgctatagtggaaagacatatttagaaagaatggctacaaaggctgggcctggtggctcactcatacaaccgtagcattttgggaggctaaggtgggtgaatcacttgagcccaggagttcaagaccaacatgggcaacatggctctaccaaaaaaatacaaaaattagctgggtatagtggctcaagcctgtagtcccagctacttgggaggctgaggtgggaggatcacctgagcccaggaggtcaaggctgcagtgagccgtgatcactccactacactccagcctgggcaacagagcaagaccttgtctcaaaaaagaggagggaaacaaaagaagaggaaaaaaaagagtggctgtactcctgtctggaattagcacagctgactggaaaaacccaagtccctagagcttacaacactgaccgctatgtcggaagaaaacagacttatgagaatgtgtgttcttgtttaaaaagcaggtcctgcatgtcacaagtaattctgaatcccttcccccttgatcgagttgatgccctgggctgccaaatcctgcaagctcactgcctttcagtcaaccagaaccaaagaatgaggccaaggaactctgtcctgtttgttttctgatgtgttgaaaaatgagaaaaaaaaaaaaaaacgttatgaggagggtgctaaagatccctatctcaggtcccttcccgtggaaaaccacgttagaagatcctaggccaggtactgtagccacagggtttccctgctccactccactatcctgtgcctgaggcagacgttgatcttcattctttccctgagctcatggatgagacttctcaagacggagccatgctccatcccacacctgtgacctctgccaacagtaaccgtgaagaatgtgctctgaaa

SEQ ID NO: 65235 - DNA, 1066 bp, Homo sapiens
tgttttgttttgttttgagacagtctcgctctgttgctcgggctggagtgcagtggtgcgatcttggctcactgcaacctccacctcccgggtttaagcaattctcctgcctcagcctcccgagtagctgggattacagatgcctgctaccatggctaatttttgtatttttagtagagacggggtttcaccatgttggccaggctggtcttgatctcctgacctcgtgatccgcccacttcggcctcccaaagttccgggattacaggcgtgagccaccatgcccagccgatccatttacattcttctccatcttggttgatggcaactttatccttcgagtttgttcagatccaaagcttttgagtcttctcttcctttccgtcaggaaattattttggctctacctgcaaaccatatgcagaattcatccacacttctcttcactgctaccaccttggtgtgtgtgttctctctcatctgtattactgtactatcttcctgcttgatctccctgcttccaccctgccttcctctgttcttttctacacatagcatcagaatgactctaatgaaacattttccagaggctctccctttcactcagcaaaagcaaaaggccctttaaaggtctctgaggtcctgtgtttataggacccgccagtgcccctagtacctcatcacctagtcctcttcctgttgtttcactccagccccaccagcccccttgtttcttttagagtcagggtctcgctctctcactcaggctggagtgcagtggcgcaatcatggctcactgggttcaagcagtcctcctgcctcagcctcccgagtagctgggactacaggtgcatgccaccatgcctggctaatttttgtattttttgtagagacagggtttctccttgttgcccaggctggtctctaactcctgggctcaagtgatccacccacatcggcctcccaaagttctgggatttcaggtgtgagccaccacgcctggcctccccctggttgtttctggaacacaccaggcatatgtcttcttagggcctttgcactggct

SEQ ID NO: 65236 - DNA, 1006 bp, Homo sapiens
gccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaaggtgagtaagaatcgcaactggtctctgagggagcttgagagaaaatcatggaaatggcagtgctatcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgagggacatgaggctacaccggaagtgatcttatctaaggtgtaggtcaccaggatatgctttccgaaggtccaaggtgaaggctcatggactggttgaatcagtctcctgctgtggtgcagtaaccatttccaccttgaaattttaaaatctaaactaagtataaccatgtgttttttggtccccaagaaagatgcctaaggcattggtcaccagataaatagctagttctgcttaacatggaaagaatatgtcagttccttctccatcaagttgaggtggaaatctgagactggaggcattcagtaacacagaatgttagtgcttctgctgcaagacctgcatcatcggtgcatctgttatctgtaggaacataccaataaggcccagattttgagatattttctgttcatatccaaccatcagttcctaattaataactcaag

SEQ ID NO: 65237 - DNA, 2406 bp, Homo sapiens
tacagctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaagtatgtagatagagatacttgtctgagagcatctccatggcctttgccttgtgtgctcacagcctgtcctgtaacataatcttgagttcttgtagccattatcatgcatgacagagtgtctgggtaaatgtattgtaaccaaatgtttgattcttcagtcttcattgtctttgtctttgtctcaaaaccacttctaaatggtcttgtgccttctttcactgcttttccgtggacagaattatgtatcgcacttataggatgtaagtactgcctgctaatttctcattagcagggctcttatatctttctaacttctgacttggattcatcccctctggagggtgactagcttagagtttataatcagggtagagggtgtccataagtaccccatgaatcaagtcttccacaaaagttcaatgtcatgtggctaaaatactgattcactttcttctttgtgttatacttggttgtgcttagtttcctattcttgagataaggctaattaaaatacatgcaacccaaaattggcttagggactcaaaatactgcctcctaagcaagacagctctattttgggttgtgtcatgagtataattttaacgaacttgaatttggaaactttgaatccctatttcttggatgtaaagctggccctgacctgtcaagagtgaatattctaaaaaggggtgactggtggtctcacaaaatataaaatgtgctgaacacggcatggaatggtacttatgattagcaaaattaaagcactggttaatttggtggaaaagaaccagccagtctaaatttttcttatatatttgctcataagtagtgaactttgagtcaatacaaatatattttattgttttctgccccttcaggaatagaaatacaaggtttgttggctttagtgaactagaacaaatacttataacttggcaggtaatgtaagtacaaattaaagttatctgccctcttaggatattcatgaaccaatgttgttacctattaaaggcacttgcttagactcagggacttaaatcattcaggggggctgaaaccagaagttgaacatctgtcctgaagctttggggcaactgacagtgctactcttgccctttggttaagaagtctcttttagttcaggagcctccttttgcttcccttagccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagtgagttaaactctttcatttaaatatgagcagttcatgatgatcagacggcctacgtgaaatgtgccctttgtaatgtgcagttaaaactttttagaactgattattttttgaatgatagcagttgttaactaagacctggacctagtggagaattgtataactccaactgactgggatgtcttgtaatagaggttgaagttttctctttgttctgctatctaggatccgggctgtttctccacacttcgatgacatgcacagtaatacagcatccacaatcaatttcattatctcccaagtagccagtggtgacatcaacacaagtatccaagctctgacacaggtaatgggtgtgctcccgtgacagggattccattggtggacatagaggctataaatgtgatgaattgcacactcgcagagtcatagcattaggggatgcaggcagtgtttcatactttcccgaggaaagaaatgcacaggtgccactcagtcatcacttgcctcagaggatgtgactctaatagagccttatttttttttttttttttcctcttttgagaccaggtctcactatgttgtccaggctggagtacagtggctattcacaggcactatcatagcacattgcagccccaaactcctggactcaagtaatcctcctctctcagcttcctgagtagctgggacaacaggcttgcatcactgcacctagctaagccttgcattttttataattgcattgattcaccagaggctagagataaaacagcagctaacaagtaaggaccaactctcatggaacttatttagattttagtggacagagacaagtaaacaagaaaatatcacacagttgtaacaactgtgtaaatataactt

SEQ ID NO: 65238 - DNA, 1104 bp, Homo sapiens
atcccctatcttgtcgtcaaggtaatgtggtgttctctctctgggagactgcttaagttcccagctgacctcagtttctgtacttttatttcctctcccttttttactgattatatcacggtaccttccctacttatccctatttccctattctttcaaaacatagtaatgcatgggagaatcattgctacttaggaaatgcctcacttaatcattattttccttatcgactaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcaggtgaagcaaacagtttaaactgagatgtgaatctctgcagcagtagcctatagaagaaatagtttatagatgaacaaataaatttctccagtgcctatgtagttgattccaacctcctgatttagactgtgagagtgatgagttgcacactggtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccagagtaaggttttagtccttcatatatgccaagggaaatttctctagtaaggataagtctctgtcccaaatatgtgttgtctcattaatctagcctttctcccccatcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatgtgagtgacttctctgaacactgtcagcatgtcgtgaaaagaattgcaagatctcctaggtgttaggtttcctgtcctctcaactgtagctaagtttttactacttt

SEQ ID NO: 65239 - DNA, 1012 bp, Homo sapiens
aggctaaggcaggcaaattgcctgagcccaggaattcaaaaccagcctggacaacatattgagacttcatctctacgaaaaaaattttttaattagctgggcatagtggtgcatgtctgtagtcccagctacttggggggctaaggcagaagaatcacttgagcctgggaggttaatgctacagtgatctatgatcatgccactgcactctgccatgcccaggcaacaggtgagactctgtctcaaaaacaaacaattccaaaaatttttattcctagaagattttcagagttgttaagcttcaagaagtatgacaccttgaaatttgcattcatatttaattacaaatgaatattgttgaatttttaaatattttattgttcctgcagctgcattatataaggctctctacctcatttcagttgaacaccctgtagccccttttcaccgtttgttttttccaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaagcacttggagagtgaaaaagaaggagttattggttgcctggatcttatcttaaagtggcttaccctgaggttttttgacaccaatacaagcgtcctga

SEQ ID NO: 65240 - DNA, 1027 bp, Homo sapiens
cttttaatattaatgtaaattaatataaaaatataactaattttcagtcaatttattagcagtttcagtcttaaccattatgatgtctttaacatttagaatttcattctttagcagacagacatggacgtaaatgcccccaactactcaggaaacaaaatataagagttattcttcttacatgatattttatgcccagatcactcactgttttgcctgattaactgagtacacaagttttacaatttggagttttatatttctactttactttggagttttagtacaatcatagaactagtttctgtttcagagaagatggtttcatgtatgttcatgtgggccttagataaccctccattgttcatgttcataaagcaacagtgatcaccccctacctccaaactgtagtagatattatttttgctgattatcttctccatttagaacaatgttcgagctgctgccctagcgactgtgaatgcttgggcagaacagactggcatgaaggaatggctggaaggagaagatctttctgaagagctcaaaaaggaaaatcctttcttgaggcaagaggttagtatcataaattaatcatgtgcattactcatgtcatttacttccataggggcttgggcctgtctgataaatacgcatttatggttagaatgagtttcattataaaacagttaataaaatgaaatcacattcctggggcctttgtattcatgtgcttccattttttcctttcacatgcttctttatcaataacgctttttagaggactaggctttttgtggaatttttcccttttcttaaacatttaaatggtaaaatcagaggttttgtgttttttttattattatttaagctctgggatacatgtgcagaacatgcaggttcgttacatgggtatacatgtgccatggtggtttgctgcatccatcaacccgtcatcttcattaggtatttctcctaatgctatccctccccttgccccgctaacccccgacaggccccactgtgt

SEQ ID NO: 65241 - DNA, 1038 bp, Homo sapiens
tattacaaaggaatgagagtttgacacaggcaccctctctaatttgtttgttcccatatcctatataaatttcattagccttactcattcatttgtgtatagatgcagggacaaagtccacctgctccaaccagaggaatttccaagcatagcacaagtggtacagatgaaggagaagatggagatgaaccagatgacgggagcaatgatgtcgttgatcttttgccgaggacggagatcaggtaggttccagtctgtgaaatggtttatttcattcattgtattgaattcagaatgttgtcttctttttgaattcagtgaggggaacttaacgtgatatcatcatttttttggagtctggaattaaaggttattttctgtttttcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtatgtagagcatacggctgttctttttatctcccctccccactgctgcaggagttaccttttcagtgtagccttcacttgcaaaaaataagtggttactttatttgctttgaactagaaatagctgcctttaatttattaagtgtatctcaagatatgatggtagttggcagatttattcatcaaatttttatgagtctcagaatttgctttttgcaggaatccaatattgaatatatttgtataaaactgcttgtaatacatgtaaacataatgatttctgatttttaaatgtggatttttatgtcaggatttccttaaactaggttttaccttaaagttgtaaagtactatgatctctggtctaaaattctgataatctagttttacgaactgatgataaaaaggccactgcctaaaaattaattagaataatctaagtcgaatagcatgacaagccagtgtctctgtctct

SEQ ID NO: 65242 - DNA, 1024 bp, Homo sapiens
agcccacgagcttgaggctgcaatgattgatgattgtgccactgtactcctgggtgacagagcaagaccctgtctctaaaaaaaaaaaaaaaacattataatgcagagtaattgctgcaaagctataaatagtccagaatgcctttagtcctactatcatttcacctcattttcttgtgtaggttcactcttgttcctaaggcattcttgcagttgttttagcgtcagaaaactagtttaatgcacatctgccttaatgtcatgctgtatttctataagaaatacgagataaaacacagatctgctgtttttcccttttcaggttgtgtcaatggctttctcacaaaagaatcccaaaaatcagtcagaaactctgaattggctatcaaatgccataaaagaatttggtttttctgggtaagtcagaacgaaatcaagtggaaaatagttaaatgttctgtcagtctctaagtcgtgctgtttataataatagctattgctgtttatttctgaagagtgagagctggattgtctcatttatataaaagaaaattacctttgttctcaaaggtctatattggcttgtgttcctgctttttgatgttcactgaaagagttctctacgttatttttccttaagcattaatagctgtcccacagaaaatccagttccaagaatttctagtcaaatacattaggaaatttctgtatataattacatttgtttaaagacctatagtatgccttggcgaattaactgctgtcagaaatcctgcaatagaagagcttgtttaactttgtttaacccactgttcccaaacttatttgcttatagagcacggttgtttatttaaaacaaaactttatacagtttactttatcccaggtacttttaaaaagcactttctaaatcataattcatttgatttaatcatcataacaactaagcgaggtattatattatccctatcttatagatgaggactaaggcacagaaagtttaagtaatttgggcccatcatag

SEQ ID NO: 65243 - DNA, 1116 bp, Homo sapiens
taatgaggaacggtaaggagaaacactgcaagagcactgtcacttatggcagaagccgtctagtcctgcgtctgctgcccattgggtttagatctgagtttgtgcatctttgatattcggtactttagaacttcaaatctattctgctttgctgtttttaggaaaatcaaggaagagaaaatacatataagcagtttctgccacacactaggcaaatgaaaactattattttgcatggagcaaactatttgtgaattcctgaaatgtgagataaacgttcagtgatactaatttaacagccatataccaagcatctagcttaagaaataaagcattatagacataaaaacacaaagaaataaagcataacagcggaagctatataagctccctcaataaccctcctcagttctattccactcctttcttcagaggtaaccacttacttgactttggtatttactcttcctttggaagtaacctttaacccttaaactcttattctcttattttacttcaaggctgttgagctaatggaccgaactgaaatgccatgccaggcattagtgaggatgctagccaagaaacctggatggaaagaaactaattttcaggtattttaaaatgtgagatttgatgtcttttattgaagtaatttacattacatcatcctatggagtaatacagcagaatagttttcgtaatgatttttttttttttgagacggagtttcgctcttgttgcccaggctggagtgcaatggcacgaccttggctcaccacaacctccacctcctgggttcaagcaattctcctgcctcagcctcccgagtagctgggattacaggcacccgctaccatgcccggctaattttgtatttttagtagagacgcggtttctctatgttggtcaggctggtctcgaactcctgacctcaggtgatccgcctgccttggcctcccaaaatgctgggattacgggcgtgagccaccgcgcccagcttggtaatgatttttaatgaacaatggggtgtgtgcattttgattgaacacataactacagttgactcttgaacaatgtggtgattaggggtactaccccttgtgcagttgaaac

SEQ ID NO: 65244 - DNA, 1438 bp, Homo sapiens
tcattttaatcaaatttttaagggagtgtgtgactcaataaaagtttaaaaaccactgttttaggccgggttcagtgatacatgcttgtaatcccagcactttgggaggccaagacaggaggatctcttgcagccaggaattcgagaccagcctgggcaacatggcaaaatcctgtctctacaaaaaaaattttttttaattagccaggcatggtagcacacgcctgtggtcccagctacacagtaggctgaggtgggaaggaagatcccttgagcccaggaggttgaacctgtagcaagctgagcttgtgcagctgcattccaggctcgacaacaatatgagacactgtctcaaaaaaaataaaaataaaaaactccactattttaaatccttaggtggtttaatttttattttttaaattgtttttaggctggtgggccaccaaaaaaggggaaaccagctgcaccaggaggcgcagggaatactggaaccaagaacaagaaaggactggagactaaagaaatagtggagcctgagctctcggtcagtattaacacactgagcctgaaaatcatgaaccctgcaaagtgagaccaatgagaagactggagttctttgctgggttctacaacgtacagttaattgatattttttagcttattgaaactgccttggacaatctcctttatcaaagtataatagaagcctcagaaactatagcatacctatgggagtattcttttagttttggctggagtatgtttacgttcttgtcatctgttcccttaagcaattcctaattctaatatgtttttgtatcttacagatagaagtatgtgaagaaaaagcttcagctgttcttccccctacctgtatacagcttcttgacagcagtaactggaaagaaaggctggcttgtatggaagagttccagaaggtagtgcatagggaagaattgagtgtgaaagaaaattagattatatggaagcagcgaaattgatgaatgaaggatttgtcctaattgctgtgttttataaccggtgaacacgttttatggcattaaagatgaggtgggactttttatttcttgtagctgtgtagtgtttgctatctttaaacatcagtattctatggcctttataagctcatgacttaatacttaagaaaattagattcttattctgaattataaggcttagattatttttttattttttgagacggaatcttgctctgttgcccaggctggagtacagtggggcgatcttggctcactgcaagctccacctgctgggttcacgccattctcctgcctcagcctcctaagtagctgggactacaggcgcccaccaccacacccggctaattttttggatttttagtagagatggggtttcaccatgttagccaggatggtcttgatctcctgacctcgtg

SEQ ID NO: 65245 - DNA, 1578 bp, Homo sapiens
aatggattggactgaaattggacaacattcctgtctctttgcatcatggctttgtctcttgacagttatagagtactggtagttttgatgaggagttcttgattttttttaaattgccatttatagtaggaaagaaatgcataattgaaacaagttttggaggatgctctctggtactttttgtcttcaattttgtctgttgttttattaagaaaaaaatgctgatatcacctcaggaaatttatttcatcctccactgatagttcagaccgagtttgaaaacttagcttttgagaatttaagtttcattccaggctatgatggtgataattgtagaaatagctttcaaattataaccgaaaaaaagctgagtgaccaatctgtagagaaggtgaaaacagttctgtgagataaatttatttctaaggtccagaaaattaccttcttatatgtgaatgtcttccataaacaatgtggtcattttaagtttattacaattctaatttgtaaagaaataaaatgtaagattaatatcttacgtatgtctatctactgccaaaaaagtgtagataatttatcttttttgttgaaagggaaattttttctctgaaaattttttttttttttttttttttttggcaatgaatctcactctgtcacccaggctggagtgcagtggcacaatctcagcttactgcaacctctgccttctgagttcaaatgattttcgtgcctcagcctcccaagtagctgggattacaggcgcctgccaccacgcccggctaaacttttttatttttagtagagatggggtttcaccatgttggccaggctggtctcaaacctctgacctcaagtgatccacccatctcggccttccaaagtgctaggattataggtgtgagccaccttgcctggccatttctctgaattcttatgtgtagttgtggtttagaaatgtaataacgtagtggttgtgtttcaaagttgggcttaatgatgttcatctcactttcattctccagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggttaatagattatttaaaaatagaagttagtaaggaagggtctgagtctcaggttcgtggttgttcctctaaaattattttgtttgagaaatgaattcattggccacattaaaaatacagcagaaaatctgttaatgaagataggatattccagcaataaattcagctgtttggagctttaatagagataaaaatggtgatgaaggcacagaagtgtgttttgtcaatttaacataaaatttactatcttaactttttttttttttgagatggagtctcgctctgttgcccaggctggagtgcagtgatgcaatcttggctcactgcaacctccgcctcccaggttcaagtgatcctcctgccttagccc

SEQ ID NO: 65246 - DNA, 2936 bp, Homo sapiens
gtagggactagataaaattcaaagtagactggaggcattactcttactgggaaaagagtgaaaaaagaagagttgggggcatttaaaaataaagcagccgtgtgtgtgtgtgcatttataaataaagcagccgtgtgtgtgtgtgtgtgtgtgtgtgtgtgtctgtctgtctgtctgtctgtctgtcttgctctggtacccaggctggagtgcagtggtgcgatctgcactcactgcaacctctgcctcccagattcaagtgatccttttgcctcagcctcccaagtagctgggactacaggcacacgtcacactgcctgtattattatataataaagcagctttttaacaccaactgattgggcagtgtaccacagtaaaatcttaccaggaaggaacccagtcgtagtcagtatcttgttaaattgacacagatgcagctactacccgtgagtttagataagtgctgggctttgtgggttgtggcataggagggcagtaatataagcagtgctagaggagaatcgactgagactctgaattgaagcttaaccattattagatgactgaagtggcagcctcaaggccagaagctccctcagaagaatggttctcagaagaatgcagtagcattcacaatttagagtccccatggacttcctgaaggtacctgcagccgtttgtactggtgcttcttggttatgaatattagagctgttgccctgtgatgtctttcagagatacattgccttttcattttccttgtcccaaagcaaagtcagcagacctctcgtctctctgccattatcagggtcatttcctgcacagttgaacagtgctgacagcccagactgccactactggatagtgagcaatttgatgttgtggttttatctatgttttattagtagaactttaagatagaagactaaacataatgaagggaagctcccaaattcgatacaatgaaagaagaatttctcctctgttgtagtaaataaaattggtcatatattagcataagagctttcagagttcttttttttttttgagatggagtcttgctgcgttgcccaggctggagtgcaatggtgcaatctcggctcactgcagcctccgcctcccaggttcaagtgattctcctgcctcagccttccaaatagctgggattacaggtgcctgccaccatgcctgcttaatttttgtatttttagtagagacagggtctcaccatgttggtcaggctgatctcaaactcctgacctcaggtggtccacccaccttggcctcccaaagtgctgggattacaggtgtgagccgctgcacccggcctcagagttcttttgagaataaaatttcaatacccttctacatggctgtgactattttgttttcctttttacccccctttgtaggttgttggaaaggacaccaatgtcatgttggtggctttggcagcaaaatgtcttactggcctggctgttgggctaaggaagaaatttggacaatatgcaggacatgtaagtaacactcctttttagatacagatcaacaaaatttatcaaaaatggtaggcctagtttgctgtttgctttaaaacaactccttggcatagatgtgtatatactgtacaaagtaaatttctctctgttttgttaatattcagcatagatatatcttagaaatttcagtagatgtcagttgtaacaaaatttataggccttatgtagaaagtcaggcactaggcctaaagtacttagttgagtttatttatttgcttattacttatttacttactagtatcttgctttgttcttacaacattatacacatcataacaagatgaaacaaaacttgtaacgaccaggaccagaatgaaaatgagagtcggaaaggcaatgtaaaactataaatgtaaaactgtgaggttaatatataaaatgtgttttacattgttttcctattttaatatataatttacttacatatttgagacattttatataggttacaatgttatatattttatataggttatctccgttttacttattcaaagaaaatctgactggagacatttgttgacttactatttgtataagtttgtttccaatcaaatttggtaataattttaattaagatgttttctttaactgtggcatctgtcctttggcctctaaatccggtctgcattactaagaatggctcagcatcctaaaaattgaccttattgatctttagagtttagcttgctagccccttcatcatttgattccctagactgacttaggagtttcctaatagtccctagtcatgtgtccattttatattgtgaagctaatacctagcctcacatgagctatggtatttggagcttgcttactcatagcattaaaaataatctcagagaacttaactgaagaaaaagaagacactaccaaataaaaataaatcatgactggcttattactagggaaataaaaataagggtctgtaaaacccttagacatatacatcataaattgaaataaaattaaaatctatttttatagcaatcaatattatataatatcgatgtgtatatgccattttgatcaattttatattacttaggatattttacacttttatattgggaataatttttcaagataaaaaacaattttttcctacaccacttaaatatcagttcagagaataattttagttttttttttttgagacagggtctcactttgtcacccaggctggagtgcagtggcaccatctcagttcactgcagccttaacctcctaggcgcaggtgatcctcccacctcagtctcctgagtagctgggacttcaggcacaccccacaccatgcttgagtactttttgtatttttggtagagatggggttttgccaccttgcccaggctggtctcgaaatcctgagct

SEQ ID NO: 65247 - DNA, 1108 bp, Homo sapiens
gaaaatactttttatatatgaacaaaaatttatatatatgaacaaaatgttctgattgcctccacagttttattttttattattattactatttttttgagacggagtctcgctctgtcgcccaggctagagtgcagtggcgcgatcttggctcactgcaagctccgcctcccgggttcatgccattctcctgcctcagcctcccgagtagctgggactgcaggtgcctgccaccacgcccggctaattttttgtatttttagtagagacagggtttcaccttgttagtcaggatggtctcgatctcctgacctcatgatctgccctcctcggcctcccaaagtgctgggattacaggcgtgagccactgcgcccggccagttttataattttttaaaaaaattatgtatctttgaattagcagagtgcaataaatagacttttattccgctctcttatttcctgttacaaatgactcatattgtatcttgcaggaggcaaaaaaatggcaagagagaaaagaggccctggagtctgtagaagtactaataaaaaaccccaaactggaagctggcgattatgcagatttagtaaaagcattaaagaaggtaaatatgaggacttgcagtactggtattgtaacagccatcaggcctttgaatttctcatcagtcatctttttaattacacatacattgccacttaaggaacattactgatggtatttgaattacagacatacatttttaaagggttgttttaaattcctgttgtgggttagtttcattttcaatctttgttttttgtcactttgactttaggtatgctatttgatagcttctgtaactctctaggaaaagagagttgctgatctagaactacattttccagttttataattctataggatgagctatttaagttagctgtatttaattggacaaatattaaacatgaagatagcaaatgataacacactactttgtatcagtatgtaaagagtatacgaatatgaggtcagttctgaaacagacaagtactaagtaagagataaacatttttaggaaataatcttttggtattgcaagttgaatgctgctggtggaca

SEQ ID NO: 65248 - DNA, 1444 bp, Homo sapiens
gtaaccctacttttgtaaagtatatttgtatgtccatatacacacacacttagagaaaggtctggaaggagggatatcaaaaagttgaaagtagttttctctgggtggtgggatttcaagggatctttaattttttgtttgaattttctacatttataaactgttactatgcctgctatgacatgtcttaaaattttatgtttaacgttaagtttttaaaatattcttgaacataaatttaaaaattaaagactcatttactgtatttctagcatttgtaaaagtactagtacaccccctttccgtgacctttttccaattcttactacttaagtgggatttttgttctttataatatgttacagaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaaggtaagactttgttttagctttgttaactagagcagcagtccccaacctttttggcaccagggaccagtttcatggaagacaatttttccatggaagaattgtgtgttggggggaatgggggggtcgttttgagatgaaacagttccacctcataaggagcatgcactctagatccctcacatgtgcagttcacagtagggtttgcactcgtatgagaaccttaatgccctgctgatctggcaggaggcagagctcagggggtaattctcgcttggtagctgttcacctcctgttgtgtgcctggttcctaacaggccactgtactggccacagcccaggggttagggatccctgaactagagtatctcaattgagtttggattccgggtttaaacagaaatggaaactgcagaatttgacttggcatgccaaaacaagcaagaaagtgacctgaataaggaaagtcattccccaagtgtggcacttcatgttgactaattttagccttcaagtgtgttgtgtagttattttatctgaatccctttctaatgaagatgaatagagatttctgacctgttatcagattaagaattaggcttttcagttgggggcagtggctcatgcctgtaatcccagcactttggaaggctgagttaggaggatcacttggggccaggagtttaagaccagcctgggcaagatggcaagacccctgccactataaagaagctgaggtggggaggatctcttgagtctagaagttctaggctgcactgagctgtgattgtgccactgcaattcagcctgggtgagagagcaagaccctgtctctttaaaaaataaataaatatggccaggctcagtggctcact

SEQ ID NO: 65249 - DNA, 1601 bp, Homo sapiens
atttattaaacacctgttgaataaattaatgaaaaaagaatacctcagtaaaaatgtccggaatctactagctgaaattaatatacagtgtaatataaagctacctaatgattatacaaaaatagaaccaaaaaacagcatatactttggagacggggcagtttcatcagggtgatttctcatgtttgagttatcacatctttaatacaatattataaagaagtaataattcttagatacaatgtgagattcatttataatggcctattatgaatggcagagtatcataaacactaaacacttgtaagaagtttattagctaatcttttttgaaaactgccaatttcttaaactcttttttcatttctagtcatggggtcctttgtttacattacctgacataggatattcatttctattctcacaccctccccccccagattaatagtagatgataatatcattaaattatgttttgtttcaaaatactacttttcttttagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaagtaagtactttctttccaactttactgataaaaacccctgtttggtgttacataatgtatgtttgtagatcactgtccttagttattagcagttttagaatagatgaattttcttactttcgtagtttcttgatacttgtttttcattcagtctttattctcagaaatctaaatggcacatgagatctgtagaggagtaaattagaaataatattttgagggtttaccttaaggtttgatgaccaagtggttttccttttaagctttttgtatgggaattattctaaactaaaaggaagagtctttagtaacttcaaaaagaaactgagagattgtcagtaaaggaattatcagaatttcactgaagacatttgggcattatagaaaactaaattttttacaagggttgttagataggtgatgttagaatcatgtctttctccctttgttcattaggcatttttatttcttgggggaggtaatgcttactaaacaacctcagtgactcctggccagtttaacttgatctgtgaatgacagatttctagtcatcctactatcccatacctcatagacctgattttcctaactctagtctctgtgtcattgaaaggaaccctccatacaaaaaaaaaagttgaaacacttgacttaattgcacaagaaatatatacttgacttacttcaaagattataccaataaagatcatcattaatttgacaatttggttaactggcatcactgggtttcctttaccgttagtaaaactatcactttttaatttctcttctgatactagaagcggttttttgataaatgctgcatgtaatctcaacccactcagttcttctgattcccggtagtgtaggtttcatttcatttagaggagattcaaagcagtaa

SEQ ID NO: 65250 - DNA, 1057 bp, Homo sapiens
aattctattggccgggcgcggtggctcacgcctgtaatcccagcactttgggaggccgaggcgggtggatcacgaggtcaggatcgagactgtcctggctaacatggtgaagccctgtctctactaaaaatacaaaaaaattagccgggcgtggtggcgggtgcctgtagtcccggctactcgggaggctgaggcaggagaatggcgtcagcccaggaggtgtagcttgcagtaagcggagatcgggccactgcactccagcctgggtgacagagcgagactccgtctcaaaaaaaaaaaaaaaaaaaaagtcctgttaattgaattaagtggggatctgacgaaagaacgggatttttactcttgttgttgcatgaatgataaaataataatctcagaaaagttatttttgtcttaagagactgcctggttgctaagcaggtttctacctttatctgaccaggaaatactcttaattctaaggaaaacctggaagcacaatgggagatgacagtgagtggttgaaactgccagttgatcagaaatgtgaacacaaggtaagattcttctggaattcgattttcagtgtcgttggcttgttttgtgagcagttatactatcatcttacttagaagtgtgtgaaaacattggcagtttcaaaaatactgatgccttgttagatatgttattttttctcattgaaaataggtttctgtagctcaactaaaaatttttttgtctctggaaagaattcaaagaaaagatattagtgaagtgaaaagtaagtggtatctatgaaaagtaactggctagttttttcatctccttgtatatacagtacaatatacttctggtacctaagtacttactaatattttattatatagagactcttcttttgagatgtgttctgaatttggccttagaaatccagcattttttaggttctctgatttatatgatcggcattccaatatttaccctcagaatctaccaatctttattttctagtttatgctagtaagatacaatttattacatcatgtcattatttggt

SEQ ID NO: 65251 - DNA, 1101 bp, Homo sapiens
gccgcctggtaatgcagaatactccggcaagaggataacacttgtccttgttaatgggaaatacctggagacagtgagttttttttttaatttgagggaaagtgttgtcatttttgccacctgctactcagagatgggattttgtcagattttggttaaataataaaaatcttaagttttctatgacagttacatagttgttgtgtttctttaatccagttgtccttcctagacatggtttgagtagatttctgggcatgtgtatgcattgcttttttaaaaaaataatttctttttttttttttatgagcctatcatcacactcagtggtcattcaaatgggttgctttttgatggagcagaagtttttctcaaacttctgttaaaatcattctgtgcttctgcaatagcatctccttagccagaggtgagagtccaggaatggtaatcaaattcagatctcttgtattgtgatagtgaagagcttttgtaggtcaagagcttgggaatttgccataaaaaagtcatactgccagtggtttttctctaagtagaagagaaaataatctgtacagtagctctgtaattactcttatagactatcaaaatacaggaatttaaactaaaaagacaccacacttgggcccatgggttgtagggaagagagacagactgagaagtaggagacataggttctaggcccagctctagtattactcatgacttaatctctctgtcccttttaaatggttggttaatgagaaaatgcacagattttggggtctcttttatgatgggatatagtgcatatttaataggaaatttgttatttatttgaacactaaactgaaaaatcagacaatttggaatttattctaagttctgccttcatgtataaccttgaaaacatttcttaacctctagtctaaaaataaacaattatgcctaaaccttttcagcaatagcatggactatatggtatttgagctcttaggaagacatttttagatcagtggtatatgattataatatatctgtaaaacatacttactttagctgacctacttgtctttgcctcagttttagactgggataaaatct

SEQ ID NO: 65252 - DNA, 1040 bp, Homo sapiens
atagataaaggtgaaatcaatttattttgcaaccataagttaaatctagttggtaaactcatgtaaaaaaatttttaaataagattttaggctgggcgcggtggctgacgcctgtaatcccaacactttgggaggccgaggcgggcggatcacgaggtcaggagtttgagaccagtcgggccaacatggtgaaaccccgtctctctctctctctctctactaaaaatacaaaaaatggctgggcgtgatggcgggcgcctgtaatcctagctactcgggaggccgaggcaagagaatcatttgaacccgggagacagaggttgcagtgagccaagatcccgccattgcactctagcctgggtgacagagcgaccctctgtctcaaaaaaaagaaaaaaaattttttaaaaggctgttcactgaggcaatggcaagcaaaggtattccgtaacaattaacatgccttttactttattctccattactttaaagtcttgatcagttttgaattatgtttgaattatgaacagtgggtgtggtaattccatcgcagtcttctactactgacagttcagttttagcagcacctgtttttttggtgttttttgtttgtttgtttgtttgttttttaccttcacggtttattgtaaaggatgctacaaagcatacagatgaagagaggcgtagggcttgtaggtatgggagaagggtgtggagctcttatgctctcatatgaagtgtgtttgaatataccaactctcctgtaaacttttatcttaattccatcaacactcactttcttttcctttttttttttttttaagacagagtcttgctctttcgcccaggctagagtgcagtggtgcgatctcagctgactgcaacctctgcctcctgggttcaagcgattctgccacctcagcctcccaagtagctgggacttcttgtgtgcaccacaatgcccagctaattttttgtatttttagtagagacagggtttcactatgttggccaggctggtctcgaactcctgacctcaa

SEQ ID NO: 65253 - DNA, 1370 bp, Homo sapiens
cattgctgagcattggtactgcgacggtgacaccgactgcaaagatggctccgatgaggagaactgtcgtgagtggccccagacctcaggctgttgggttggatgagggcagacagttctgcccattggctaagggcgaggctgaggagtgcatgtaccaagggcaaggagcatgggtgcctcagcagcagctcctcctaggctgagctagggagggagcaagttccccaggtgggaagggaaggcttcctttggtccacctgaatatgggcgtctataagggctgtcccagatgaaacctggttacatctcacttgaagaagctctcctgcctgagcatcctgcctgcttgaggaatcagggcccctctccttcatccaggcctgagtgtgtgcccctccccacccctgccttccctccagcctcagcagtgccagcgcccccctgcaacctggaggagttccagtgtgcctatggacgctgcatcctcgacatctaccactgcgatggcgacgatgactgtggagactggtcagacgagtctgactgctgtgagtactctggccagctgggaggtggggaggccaggctgggaagaactgcttgggtggcaaggcacagtcgccagctggggcaggagttcagagaggagtttctggattttctggtccctcttgggaagagatggaggaactgggattctggggctgtggccttctagtctgccatgggacactgcacagactggctagagacagaagtcttgtgtttccctagcctcccaccagccctgccgctctggggagttcatgtgtgacagtggcctgtgcatcaatgcaggctggcgctgcgatggtgacgcggactgtgatgaccagtctgatgagcgcaactgcagtgagtggggaaatggaattaggttgggcttgaactaaggagaaggcttgtggagccaaagaggccactaccggctgggcgcggtggctcatgcttataatgccagcactttgggagaccaaggtgggtggattgcttgaggtcaggagttcaagaccagcctgggtaacatggttaaaccccatctctactaaaaatacaaaacttagctgggtgtggtggcgcatgcctgtaatcccagctactcgggaggctgaggcaggagaatcgcttgaacctaggaggcagaggttgcagtgacccgagacggcgtccctgtagcagagtgagatgacatctcaaaaaacaagacaatccgggaggtgaggggcgcctctgcctggccgcccctactgggaagtgaggagcccctctgcccggccagccgccccatccaggagggaggtgggggggtcagccccccgcccggtcag

SEQ ID NO: 65254 - DNA, 1003 bp, Homo sapiens
gctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccaccta

SEQ ID NO: 65255 - DNA, 1359 bp, Homo sapiens
tgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtag

SEQ ID NO: 65256 - DNA, 1018 bp, Homo sapiens
aaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaag

SEQ ID NO: 65257 - DNA, 1043 bp, Homo sapiens
ttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgc

SEQ ID NO: 65258 - DNA, 1025 bp, Homo sapiens
cctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgg

SEQ ID NO: 65259 - DNA, 1045 bp, Homo sapiens
tcaccggggtggggagtgggggtgggaaatggctacgggaaaccaaacctgttgctcagtccctaagggtacttgtgccacacaggacagcttacccctctctttgtgtagaaaagttttatacaaggagtactctttccttctctctaaaatgttaaggccagtctgtcacccagtaaattggtcaactacagtggtcttgcctgagtgaaagcagtccttttgaagtgagctaattgagagcctttcagtcaacaactggtttgggggcaaatggcactgttacattatgaccagcaagggccctagaatgcctgggccgcgcagaacatcctgcggagctctgttccgcagccagcagtccgaccccctggggctggggggctgggggctgcatgcccgttcctcacctgtacttgtgccgatcacacaggttttccagacactggtagaacagcgacgcctccacgccctccagcgtgccggccccgcccaaggcaggtcgttggcggtgctgcccactggacgacgtcggcacaatcactgtgttggggttcttgcctgacagcaggtcctcatagatggcagccacactgtccaggaattctggaaccgtgggggtgggggtgtgggtgtggacggctcaggcagggaggacatgttttgtctgttcactatgtcttcccttctctgtcagcccagttccacaccagcctcagtgctcagggcatggtgtcctgagagcagaagttctcaaccttgtttgacaacacattgatgagagatgacactaatctgtgtttttgctcaaatgtcccatccttggctcagttgttcctggaccaggtgagacctgccattgcacactttcatagcaccataggcttttttttttctggcacttagccagtgaggagctttctgtgtcattaattgtctaatctgtctccttgctggaatgcacaaaggcggggtcatgccttgttggcctctcctgcctagcactgtgcttggcacatattaaggccataaatattttttggag

SEQ ID NO: 65260 - DNA, 1953 bp, Homo sapiens
aaaattagcggggtgggggcggtgtggtgcatgcctgtaatcctagctactcaggaggctgaagcagaagtcacttgaacccgggaggcagaggttgcagtgagactagatcgcgccactgcaccccagcttgggtgataaagtgagaccctgtctcaaaaaagaaaaaattacatatatatacatacacacacatactcttagacgttaatgggaccctttaaatttagggaagaaaaggtgtgtgtttgtgtgtaaatccttagcttggccacccctttctcttgggggcttctgaaacatctctgtgccaccttaggagtcctcacggtagttacagaccactggtctgggaagtggatgattagaaaggatgggcagagggagccagggggctgtaagccagggatttgcagagtgtaggtttgggactcattcagctttgggatcatctggaatttctggactccatcccaagttgatagagttagactctctggagcttggtaatttgcatcgtcagtaggctttcctgtgattctgaggacaccaggatttgagaaccatgtctcttatgggctgtgcatcattgtgggcctacagagctcatcacgcagcctgagcttttttttttttttttttttaagatggtctcattctgtcagtcactcagacgggagtgcagtggcacgatcatggctcactgcagcctcaacctcctgggttcaagtgatctacctcgggtctcccaagtagctgggactacaggtgcaagctaccatgcctggctaaggttattttgtagagatagggtcctactatgtttcccagggtggtcctgaactcctgggctcaagcagttggcccaccttggcctcccaaagtgctgggattacaggcaatgagccactgcatcctggagcagcttcggggctggaatgcctagtcttggcctcagctctgcaggggtttgggaggcagttcctgtaatgatccgttctgggtagggatgagcccaaggaaatgtgtatgcctagtagtggtgacatccaccttcagaggaggcagtcctgttctgcttgggcttctgggtgggttttgctttctgggggaccccgccccttcagccctcaatccaaagaagttgaagacactcgtccttacctgcctccagtcttggctgggatgtgtctgccccaggctgtgtctgtctgtctttcacagctgcatcccactgttctaaccccaagcaggtgcttggcaaatgttgactgaaaccctggctggaaggctgtgcagtattaaccctttatggccacggtctttaaagttatgggaacctggccttgaaccctctgaacctgtttcctgaaggccgttccagctgtgagcacttttcctctggaaggttgctcttgtgcgaagctaggcccctctgctcgttgtctgaggcaggtccccaggtctgagtgggccactggcctacctcctagtcctaccagaaaagcaccgaaaacccaaactccccctctcccttctcccctcagcctaggagctttagactcaccagttaccagacatgagggactttttattcgtttcacatgtttgtttagctattagacacaaaggggtcaagacttgaagcagtttttgcaagtgaaatcatcttctggcccacccttcatattaccaaggctactggctgttctccaacaggccacagcggttatgtcctcctggtacttgcgtcgcaggtgtcacccttgatggtgcaaggccctgcgtggctattcgggttctcccccttaatggagttgctgtgaggagatgaaccttattgggggacccgcagaggctggctcagaagagactgctcttaagaggttaggaggactaacaggctacggcgtgacaaggtggcctcagcacagtctgtcagcttggggccta

SEQ ID NO: 65261 - DNA, 1038 bp, Homo sapiens
gcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaagcagtgtcctctggatcctgcctccctgcccagtgccggcccctggcctcactctctgggctcccaccggtaatggtagggcgtcggtaccgaagctgaggacactctctccagggcctcctgcttctctcttctctgaaagccaaaggcccctggctccttggctctgtgctgccgtgaggtccggtgcagcttcgacctcaccaccctgtggcacgcagaggaaagagctggcattagttggccctttaactcgctggctgagggcgagcgagcaacctcagcagtcctgccccttgtcacggcagtaggcttgactggggatgggtttcagtggagttta

SEQ ID NO: 65262 - DNA, 1059 bp, Homo sapiens
ccttaaaatgtggttggtgcaactgagcaacaatttctgatgtagtttaatttctgataaacgtaaatagccaccagtggctggtgcctgcctcattagacagggcagcagtcaggcttcggtttgagttgtgctttgtcatcatagagggcctggcagcttcttttgcttggggtccatttctctggccggaggagcctgattgtatgcttcagtcctgacctcctttcaggggttttatgtctccagcccccttcttattttttaaaaccctactccatcttaatctgggatctgtttagttgacataatatctgtgagttatccccgtataaaatgggaacgtaactacttcatagggtctccggaaatacctggcccagtgtccacatactcagcgtgagatgagagcaaccatctccctttccacaccaggatgcttttgagagtaaagggggcagtttgctattcatagttatgacaagagtaggtataaagccaggcagaccgacacatatgctcattgtagtactaggcaagttgtcactaggattagggtagcagcagttgtgtggcctcctgaatgctgacgaagctgtgtgcttttgggcaggagcctaggccactgcaggctgtatttccaccctgcctagtgcaggttcctaagctctctgggccttggcctcaatgtggagaagggtgactcctcaccaggggagaggggcccagagccacagagccacagacagaatgggacctggtaacccatcaccaaaaggccactggtgctctgtttggcctctgtactctgcctcccctgatgataatgggaggagtccgagatattccacatcttcccctcagagccacaaaccggagggaagtggagagccggagctcaggcctcgagtctagtgaggcgcgtcagaaattcgcaggagccaaagccatctcatctgacatgttctttgggcgggaggtggatgcagaggtaagtggggctgtctgccctgaggtccgaggcagcaggcagaagcatgagctttctccctgccgctg

SEQ ID NO: 65263 - DNA, 1460 bp, Homo sapiens
taagaagggggctggagacataaaacccctgaaaggaggtcaggactgaagcatacaatcaggctcctccggccagagaaatggaccccaagcaaaagaagctgccaggccctctatgatgacaaagcacaactcaaaccgaagcctgactgctgccctgtctaatgaggcaggcaccagccactggtggctatttacgtttatcagaaattaaactacatcagaaattgttgctcagttgcaccaaccacattttaagggctcatagccacatagtagtggctaccatattaaacaacacagagaacattcccatcaacacagaaagttcttctagacagtgctgccttagaattctctaccttcagcttgtttaaaaaaaaaaaagaaagaaaaaagaaaaaacagcccactctacctttctgaaataggccggatgcttgagatggtcacttctggctccttctcctctaccctgtccataccccaggcagcatctgtatcccagcgggagccaaagctttcccctaaggaaaagggattgtccttgtacctagggagacagtagagtggctcagagaagcctgatgaggaacacagcagccaagtttacagctagaaaacagccttactttgggggtccagaggcgaaagtaccaacatcgtcaaacaagtccagctgcgagcgagaggattttgcactcactggggtttcctgctcaatcacctgcatctcagacagcacggagtgggagacagagctgcgcagcaaagcagagccaggcatgagaccaaaggataggcatcagcatcaccgcacaagagacaatgcccagcaactgggttctccttcacggagcgtcacccagagccttctgtccttacccaagcacagggctgggccagaccccaacagaaggctagctgtgtgtggtgacctgtgaagcacacctcagaattctttacacatcagctttgtttattccacgtaggagttccctggccagtgacggtttgcctgttataatttaattttatttatttatttgagacagattctcactctgtcgcccaggctggagtccagtggtgcaatcttggctcactgcaaccaccacctcccaggttcaagcgattcttgtgcctcagcctcccgagcagctgggactacagtgcacgtcaccacacccagctgattttttgtgttttttcagtagagacagggtttcgccacattgcccagcctggtctcaaactcctgagtacagacaatccacccgccttggcctccaaaagtgccaggattataggcgtgagccactgtgcctggctcgtgttgtaattttaatattgtgcaccagatgccagtggtctctgtcctgaacaactccctaccttgtgcactatgaaccccatccttcactgatggggttcacaaagcaaaggaatggatgaagaaa

SEQ ID NO: 65264 - DNA, 1051 bp, Homo sapiens
tgtaggttgacctcatttcaatcctcaccagactcttttatatgctgtgcctgatgtcacctcccttgttaggctgctggggtccttgagggcaggagctgggtcttgggactgattgcccctagtggctagccctgggtctagcagcctatggcagtgtctggtaaacactggtggagtcctgggtggaagaaggtctggttctcaccaggcccctcctctcccacccagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagtatgaactgcctggtgggcatggagatctggggtagtactgggtctcctccatctccccgaggccctggctgggactgagggatgcagggtctagacttcctagactgaggggtgtgccttgggtcataggttccatgaactccaccgtgacttgcaccagggcattgaggcagccagtgacgaagaggatctgcgctggtggcgcagcacccacgggccaggcatggccatgaactggccacagttcgaggcatgtgttccaggcggggtggggatgggaggtgggatgggctcccactcagctcggccagggctagggatgaagtaagtgaaggtggttcagatggccccacctgactataagcactgtccccacaggagtggtccttggacacacagaggacaatcagccggaaagagaagggtggccggagccctgatgaggttaccctgaccagcattgtgcctacaagagatggcaccgcacccccaccccagtccccggggtccccagggtgagagccaggagcgcggctgtggcaaagaaacagctctgcctcccgccctcctttcctttctccttggtttcatttctttcacacctgaaatgggttgaaaattggtgccagggacctgagggcc

SEQ ID NO: 65265 - DNA, 1304 bp, Homo sapiens
caggcgtgagccaccacacccagcctgggagacattcttatagttggccatcgcttctcacttccccatgctgccctggacgccaggcctttggagggcaggcccgggttgtgtgttccccacggagccttgcgggccctcagtggatgtgtggagtgagatgagtatcttccgtgactgcagggcccctcgtatttctggtgcgttgcttggtttgagtttcacaccagccctggcatggcagctgagcacacagaggagttccatcttagagggagctggggcctccttaggaggagacagttacatacacttgttcgggcttcctggccaacacagaagccaggcctcttggttcccttcgtgccctcctcagtacagggagctactgggatgtggccaggcaccctctgacttggcctctcgggtaacagggttgtcttgtcactcaagggaaggcaacagaggccctagcctgggcaggagtcctctcatcggcagttgggggagtggggccttctgcccaccgcccacccccgcctgccatttaatccctggctggatcgtgtgacctgcctggcattctcctccctggaatccggcgcttctgacagcagttgctatattgggggtgccgggcaccgccctggacgctctaggcccccaccctcacccccgctctgttctccttcaaggcagagtcacggtggcagcattgagagttggacacccgggtccttgaagtgatctctaggccccaggtatgtgggggggcggggggggaagtgcagagcagtgagaggaagagctttgagactccatcctcacccatcctggcccttcttagggtcttcagcaccctgcctgctaagtcctagctctgatgactccttgggtggtggggatggcagtggggcgaggcccaggtatagagagggtcttttcctatccccagaaacataatgtccagctttcctgcttacccctctgccctccacagccccaaatccgccaccattccgtgctgcggggacaccatggctccagaagaggacgctggaggggaggccttagggggcagtttctgggaggtgagcagctgggtcctgggctcagctacttgtctaggggaggagcccatctgacagccccagccccaaaggaagcttctccctggtgatggcacccttttcctgtatgcccaggctggcaactacaggcgcacggtacagcgggtggaggacgggcaccggctgtgcggggacctggtcagctgcttccaggagcgcgcccgcatcgagaag

SEQ ID NO: 65266 - DNA, 1149 bp, Homo sapiens
ctgctcactgcagccttgacctctcaggctccggtgacctcagcctcctcagtagctggcactacaggtatgtgccacgacactcagctaatttttcttttttttttttgacatagagtctcgctctgtcatccaggctggactgcagtggtacaatcttggctcactataacctctgcctcctgagttcaagcaattcgcctgcctcagccctgccctgagtagctgggactataggtgcataccaccatgccagactaatttttgtatttttagtagagacgtggtttcaccatcttggccaggctggtctcgaactcctggcctaaagtggtcctcctgcctcggcctcccaaagtgctgggattacaggcatgagccaccacgcctggcctaatttcaaaatttttaaattggaggaagacgcggtcgtaggtgctgtgagtctctcgtccgcactctcctgctcctgactcactgctgttcactctcgctgaggaaaaagtcggtcaggaagccacgcagcagccatggcttttaaggataccggaaaaacacccgtggagccggaggtggcgattcactgaattcgaatcaccctaacaagccgcaacataaaatccctggaaaaggtgtgtgctgacttgatcagaggcgcaaaggaaaagaatctcaaagtgaaaggaccagtccgaatgcttaccaagactttgagaatcactacaagaaaaaccccttgtggtgaaggttctaagacatgggatcgtttccagatgagaatccaccagcgactcattgacttgcacagtccttctgagattgttaagcagattacttccatcagtattgagccaggagttgaggtggaagtcaccattgcaggatgcttaagtcaacaattttaataaattgattaccagttgttaaaaaaatttttttttaattaaaagtttatgttttctcttttttttttgagacggagtttcgctcttgttgcccaggctggagtgcaatggagcaatcccagctcactacaacctccgcctcccaggttcaagcaattctcctgcctcagcctcctgagtagctgggattacaggcatgagccaccatgcccggctaattttgtatagtagagatggggtttct

SEQ ID NO: 65267 - DNA, 1045 bp, Homo sapiens
agaccatcctggctaacacggtgaaaccctgtctctactaaaaatacaaaaaattagctgggcgtggtagcgggcacctgtagtcctagctactcgagaggttgaggcaggagaatggcgtgaacccaggaggcggagcttgcattgagccaagatcacgccactgcactccagcccggggggacagagcgagactccgtctcaaaaaaaaaaaagaaatactaggaaactggacagtagccaggcattgcatgaccaagacaaagccagaggaatggagggccttggctatagagaccactgtctcccagccatcttcttcgtgggccactgccctggggtgaatgtggcagggcggggctgaggctggcccgcactgaaccttgggaagtaggatcggacttggcaagtcagagacattctcctcctactcacccattgcagaggccagcgtgtcccccatgggattgaattcattaagctgcagagacaagagtgtcaacatgaggagagggtgaaggtattagcagagacacctgatttctggtcacttttggtcaataaggtaggttgaatccctgcttcctcccatcattatttgaggacccaagcctcaccgaactgatgccagaagattctgggtcatagagctgacacatcatcttccctgagtttccatcgaacacgtcgatcgtcctcaattcataaggggtacaacttttgaaattaggatctgggtatcggcccacaacaatgaggttgtagcgaggatgccaggctgcctaggagatggagaggccggccatgagggtaaacacagaacatgatcaagggggacatcaaaaacaaatatgaacaaagaggaacatcaaaagtattctttgggctgagtgcagtggctcacacctgtaatctcaacactttgggaggctgaggcaggcggatcacgaggtcaggagatcgagaccatcctggctaacatggtgaaaccccgtccctactaaaaataccaaaaaaaaaattagctgggcgtggtggtacatgc

SEQ ID NO: 65268 - DNA, 1053 bp, Homo sapiens
ctggccgctcagcctgcctggctgccctcaccgctgcccactgcaggacttccttcgcctcacagagcccgtcgtgcccaaggattggcagcaggagtgccagctggcaagcggtcctgcagacacaggtgagctgtcaccggcctccttgctagtcatgccctagaccagcctgcagttcacatccacgcatctcaagagctgtcgcacttccagccatttgactgcatttgctaggagttccctccccgaccccagactgctttataccttctccccacttctcaccctcgggtgatgtctcacttgtatcaccgagaaaataagagccaagagagaattggctcgttctcccaccaccaggttacttcctgggggaagccaccgcttagggtggcctctccacccgcacttgggttctctcctcatctctgcaaggagctctgacgcctctgcttctctactggatcacttccctcccaaaagcccatccatgacctctgagagccacctcttccccagccaccagcctcttccctctcagaatggaatccttgaaagagctgcctagaatctggctctgcttcctcaccacttgttctcttagactcacattagacagtcttgtgtcaccttccactaccctgaagccatacttgtctggtgaccagtcacctcctaccaaagccagtgactaattcttagcttctctcacctctcagcagcattacataattggtcaccccttcctgaaacactttcttggcttctgactttcaggcgtcccttcctcactaaagaacggatgacccaggactcatccctggagctttccccatctgtgcacactcccaagtgatctcatgcagcctcatgactttatgcccatctccatgcccacttctgtccttacgccctgactcacagattcacaacctcttctctgagctagagactcatatccagctgccaacttgagatctctacatgcatgttaagtaaggcatctcaaagttgcaatgtctaaaaccagatgcttttccttccacagct

SEQ ID NO: 65269 - DNA, 1050 bp, Homo sapiens
agtgggctcacctcacagaagagtgtgtcatagacattccagacggtctccagtgtcaggtctgtaagccctgtctcgttggccaccatgtccagaaattgctatgaaaaatggatcagggtctcagtcctgctctggggaaaagacagcgtggtgagctgcacctctgcccccactcactgcattccgagaactctcattctgatactctggtgtctgccgggtctcgttctgcagctgctcataacggggacatgggcccaacgggaacttcagcagctgtagagcgaagcggggaaacaggcagcgggaaaaggagcctggcatcagcaggcctacggccagagctgtcccctcaccaccccagggaagggctggccactcttaccctgtcctcagtgatgggcacagtgtgcacaggaataggctgccacgagatgttcgggttgaagcgctgcatcccgttgggagggaagagtccagccaggttggcctcagcactcatgagagtccggtcaaagtctgtgcttcgcacataaacctgcagcgatagcaacacaagtcgtgtgtgtgtgtgtgtgtgtgtgtgtgttggggaagttttggtcaccctgaagtggagccttgtatgtatgtgtgtgtgtgtggtgggaagttttggtcaccccaaagtggagccccagaggagaacctgttcctgatggtcacccagcaaactaaacctaccatacatctggccctcaccctcctctggcctctggccttccccatcccccaaacactccactgggggttgtcaccactctgtgaagaactcttgtgggaatggccttagttgaaatgccccttccagtcaaaagtgctgagtcaatcagtaaggctctctggtctgtctggtttcataacaacacctctctccctgtctagatcagggtccttggggcagaaactggctccagtgacgacccttagagaccagggagaaaaaaataagataaagggctgggcctggtggctcacacctataatcctagcactttgggaggccaa

SEQ ID NO: 65270 - DNA, 1017 bp, Homo sapiens
cctgcattggcctcccaaagtgctaggattataggtgtgagccaccaggcccagccctttatcttatttttttctccctggtctctaagggtcgtcactggagccagtttctgccccaaggaccctgatctagacagggagagaggtgttgttatgaaaccagacagaccagagagccttactgattgactcagcacttttgactggaaggggcatttcaactaaggccattcccacaagagttcttcacagagtggtgacaacccccagtggagtgtttgggggatggggaaggccagaggccagaggagggtgagggccagatgtatggtaggtttagtttgctgggtgaccatcaggaacaggttctcctctggggctccactttggggtgaccaaaacttcccaccacacacacacacatacatacaaggctccacttcagggtgaccaaaacttccccaacacacacacacacacacacacacacacgacttgtgttgctatcgctgcaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacagggtaagagtggccagcccttccctggggtggtgaggggacagctctggccgtaggcctgctgatgccaggctccttttcccgctgcctgtttccccgcttcgctctacagctgctgaagttcccgttgggcccatgtccccgttatgagcagctgcagaacgagacccggcagacaccagagtatcagaatgagagttctcggaatgcagtgagtgggggcagaggtgcagctcaccacgctgtcttttccccagagcaggactgagaccctgatccatttttcatagcaatttctggacatggtggccaacgagacagggcttacagacctgacactggagaccgtctg

SEQ ID NO: 65271 - DNA, 1068 bp, Homo sapiens
actaaaaatacaaaaattagccgggcatggtggtggacgcccgtagtccagctactcaggaggctgaggtagaagaatcacttgaacccaggaggcagaggttgcagtgagccaagattgcgccattgcactcctgcctgggccacagagtgagactcagtctcaaacaaacaaaaaaattcctttctttgagtaattcctcacatccattttttattgattgattttcttcttcctctgcatgctgaacacagtacctgaaggtaacacatgacaaagcttcattcccttcctctgccttatgtgttgtacaggaacaccagtagataacactgtgtttatttttaggaatccctgctctcatttgaagggcctttagaaatctttttctgtgttgtctgaagtacttagtagtatctctagatgctatgtttgggtttaaatgggtcattgtgtttcatccctctcacctcagttgcttcatcactgctaatataatatgataccttgttactgcagagtctagtgggaattttaagttcagaaagttctctagctgccttcacttgctgtgttttcagtcttgatgattgctttagtatgactaatgagatggagaggttaataaatggaattatatttaattaaattaattaattaatttatttatttattttgagatggagtcccactctgtcacccaggctggagtgcagtggcacaatcttggctcactgcattctctgcctcccaagttcaagcgaatctcttgcctcagcctcctgagtagctgggattccaggcacacaccactgtgcccagctaatttgtttgtatttttagtagagctggggtttcatcatgttggccaggctggtctcaaactcctaacttcaggtgatccacttgccttggcctcccaaagtattgggattacaggcatgagccaccgtgcccagccagaattatattttaaatgtttgtaggagctaagatccttggactcattgatcctgtgttctaactcctgctattcaaagtgtggtttgtgaaccagcaacattagca

SEQ ID NO: 65272 - DNA, 1026 bp, Homo sapiens
tttcttagagccttggttgtctcctggtcacttggcttccagctctgaggtgcccaagaaccaaggttatgtgcattcctcaagctttgggagaatgctcagattatctggcttactgctcctcggaggggtagaggggttgcggtattgtggtacacctactaattgtgtattttgtgtcccagtatttgggctaaatactctaatggagattgttactgaagccggccccgggagtggtgaaggtgggtcttgcctgtgagctgtgcatgatcttttttttttctctagcatcttctgtgcctgcccgagggccatccttctcatggagcaagcagcgtcacatgagtgacctgcttgccccgtcccccgtgacgcccatgcttgcccatggggcttgctgctggtgcatgtggagtggcctgagtctccatccccacctcctccacattgccatggctggtttctacctacgtatgatgccttggtgctaccctcacccagcccttctgaggaacgggcatggaacatggctacttagggctgtgctggcatgagctcctgtactacaatagtgatgtctctcattcctgccttccctgccacaggaaacaggagggcgttagtggatcagaagtcatctgtcattaaacacagcccaacagtgaaaagagaacctccatcaccccagggtcgatccagcaattctaggtaataaatggtagagctgttttaaaagttctcaggcagaggtggggtggttcctctacagaactttagggatgctcaagagtgggagagaagctctcaatggggtagatgtaatcaatttcttgccagcacttctcattctggcttgatctccatgcaactgaaagcttacagtgttgaggggggttaatcagcagcggtgggtatttggacaaatcgcgtgctccagagaggtggggatgtggtgcacttggacattcagagacatggctttgtgttttacccctggaggcagacatctagtctgggtgaaag

SEQ ID NO: 65273 - DNA, 1036 bp, Homo sapiens
agctggtgtttcttatctcatcgggcccaaccttttctacctcctttagacacatttgtttgggaagcattaagggacctggggaccattaaatggtttcaggtaccagtgaagctcagactcttgagtgccatggaatgtggtttagacatttgttcgtggagcttttctttttttttttttttgagatggagtcttgctctgctgctcaggctggagtgcagtggtacgatcttgcctcactgcaacctctgcctccagggctcaagcaattgtcgtgcctcaacctcccgagtagctgagattacaggtgtgcatcaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggtcctctttttccagtgggtcctgagtggggggtagtccttggaaaggtgactaggatgggctgaacgggtctgggaacagcctgtgctgccgtcccaccccctttaccagcctgcccctagcctttgtgcacggagtaacagaagtcttcccctactcagggcctgaagtaatcaaacctgtctttgaccttggtgagacagaggagaaaaagtcccagatcagcgcagacagtggtgtgagcctgacgtctagttcccaggtttgtgacaaccttgttgaaatttgcaagtattaaatatgctgtctcagaatacttctttaagttaaaatagaacagtcagacagccgggcacagtggctcatgcttgtaatcccagcactttgggaggccgaggcgggtgggtcacctgaggtcgggagttcgagaccagcctgaccaacatggt

SEQ ID NO: 65274 - DNA, 1073 bp, Homo sapiens
ggatggtcctaaggtctttggggttggctactgccctaagtcctaaattgaaaatatactaaggggctgctggcagcctgcgcagccatttcctgttaaaccaaagctgcccagctacgttcctgaaagagagctacaacggctagcggagggagggagacagccacgtcagtcaggcatccacctcccctgagggtctgcggcctggccagggtctgtggggcttcacacatttgggtctggctcagagcctcagggagaggaacccggacatcagggaaagaggagggaaggcacttgtgtgaggagtcagagctgtgaacggacctgggatgatgcgctggcctcagaaaggaattagcttaaggaatgtccactgagagaaaaaggtaacactgtgttaaaagaccaagagagaaaaaaaaaagtcagctcctatggtggaattacaatgagggaaagatgtatccacaagtgctccccaatcaaaagaaagggaatggggcctgtggagcaggggacagagtgggaacactcagaggaaggaaaagaacaggaagaagaatccgcagaagaaaaaggcaaataaacacactccagagaggacagatacaagctacttacacacaagcacgcaggcacgcacgcacgcacacgcaagctgcacgcacaccagaaagacacaaggagatcggccagtctagactctcaaagcaaaaccaccaagcagaagcatatcctgggaatagaggaaggcagagacactgcaggggaagggccaagtgagacgctcccactcacactgtgtggagtccaacggatggggcagcgtggccacctggcctcgctcctgcccagcctcccccacgggctccctggtgcaccttcacagcgccaggtggtcgccaacgtcactgtgccctcccctggggtttctttcctgggtccagctgctccagttctccctctagctccagagggccctctctcatgcttgctggggaagtactgggggcttggacattggtccttcttacagatggaacgacagggagcctcgtgctgccgctcgc

SEQ ID NO: 65275 - DNA, 2874 bp, Homo sapiens
cgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcgaaccagctcctcacactgccagctcgtctcttcctttctcccctaccctctttcttcctaccttgcctcccccttctcaccggctcactggactttcctccccgtgtgttcccttctctcttctgtcagagagatacttgggggaatcttccaactcgggagaatggcctggggcttcttgctctacctttgatgagtttattccctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcagaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcacacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccacggtgcgcagggctccctgggggaccttcggacaggaggaggggagggccctctgagcgcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatggaggagtctcagtatcgtgatccgcctggttttctctcctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcccttcaggctccctggctgccttgtgttaaatgac

SEQ ID NO: 65276 - DNA, 1001 bp, Homo sapiens
agcaagttcagccctgtcttcagccctccaagctcccaccctgggcctctccaccgcggactcggagaaacagaaatgcagagagaagctctggaagctggcagaggaggccctgaggcagcggcatcttagcctctgtccctggatggttccccacctgcctggggcccccgggctgcattttgcgctcactctccctgtctgagaaaccagctcttgggaggaaaagccagcctgggaaaaagggcctagctctggaatagggaccctgtgataagatgagcagggccctttgaaaagacaaggaaactaataatgacagctcccaccatgggcccagcacatgagatctttacaatagggttatccattttacagatgagaaatggggctcagagtggacgcttacacctgctccaggaagaagggccaaaatcaggatttgcacccaggcttgaattcctctcaagcctgtgctcttagcccaaggctgcctgagtgtgtgccttgagcccttgggacaaacaagggagagtgggccctgaggggccagtgaatgaggagctgaattcagctttgaggctctggggcccaagaacagtgcagggatgcccaggggtcccggttaggggttggggggcagcccagggtgaaggagcaggaggcctgggcctggaaggagttaactgcgtgaggggcccgagtgaatcagaggctccgcaagctatgatggaaattccctgtgcatggcgtgtggtcacccagaaaagggaaacggtgcttttcggagcaggggacggcgggggctggagctagggagcagacaccagcctgggtggggctggtgagggtattgtgacaaaggaggcctggcgtccaggtctgctcaggccttgggcgggaagaaggagttgaggagccaccaggccaggccaggcctgattgtgccatggtgtgtccatgggccctgatggatgaataggagttcaccaggcccagac

SEQ ID NO: 65277 - DNA, 1014 bp, Homo sapiens
ggagggagggagggtcattgtcctggtctctgggccctggtcccagtgggagttctgggccccagctgcccaacccacccttgtcactgccctggtgccctggatgagatcccattccaaatggccccctcctatggccctggcttggcttggcctggcctggcctggcattgccgccccctgcaggtggtgaggggcagagcctgcagcagcagcaacagctggggctgtgggtcattgctggcatcctgaccttcctggcgttggagaagatgttcctggacagcaaggaggaggggaccagccaggtgggccccacactcaagggcctggatatatcagcctctgttctgtggtagtgcccggggcctggaggcccagggtctgagttgagccctgaaaagaggggtctcctggccctctcctgggagctgcgggaggttgggccaccttctttgggactgacaccattagcccctgatgtagcttgttctggtagcctgatggtgacagcagttggggagggtttgttgagtttgggggcacccaactgatatagcagcagaggattctagctagaaaaaacaggggttcctatctttttttttttttttttttttgagacggagtctcgctctgtcacccaggctgaagtgcagtggcacgatcgtggctcacggcaacctctgcctcccgggttcaagcgattctcctgcctcagcctcccgagtagctgggaccacaggtgcgcgccaccatgcccagctaacttttgtatttttagtggagacggggtttcaccatgttgtccaggatggtctcgatctcttgacttcttgatccacccacctcagcctcccaattattattattatttttttgagaagagtctcgctctgtcacccaggctggagtgcagtggcgcgatctcggctcactacagctttcacctcccaggttcaagcaattcttctgcctcagcctcccaagtagctgggaccacgcccagctaat

SEQ ID NO: 65278 - DNA, 1969 bp, Homo sapiens
ggacagcgtcctggagtttgtggtggtgaggggctaaaatggcatacggccaggctcatataggtgctcagtcattggaataaaaagttaagccaggaagacatggaacgttcagagatgcactggggtgacagttcagagacaagggcctggcagtggcagtaaggaaggccctgcctggccatggaaggccgtgcagaaccaaggcagccagtatgtggataatatttatttgtatcttatctatagaacaaatatttacagatacaaacggaatcacagcaaagttgctataaaaccatccagacctctcgatggccacttctgaaaacatccacggtgaagggcagggccaggcctggctgtggagtgggccagctgagtacctgggcgtcagccaagggaaatggttggggattatggcttcagcactctgccggagcacattcctgagcgctgacaacgtggagccctcaccgcccccacctaccccaacctcaatggggaaggaaaggggcctgagctgggcagggctgcccgggctcactatgtgcctgctccaggagtccctggcccctgtgctggcaggagcatccctgagctggaccgggaggcctctctggcctggggctgctccctgcccggcaggctgctgtttggcagctggaggtggcaagagctgctggtgctgccagggcgtgttggccaggaatgagctcccagggcagccctgaggaaagggtcttaggaagcgcctcccagctcactactaggagctggggactgtcagtgctgagtggggctggggtacaggagcacctgcctctcctttctttggcttagaagtggggaaggaagggccaggaaaagggaccaaagccgccccagccttggcccctaggccgcctggggactgtgtgtgtgctgagggggcagtgggaggtgggcagctctggagttccctgcaccctggatccttgggctgctctcactcccggggtcccagcagggcaaggcctctgcttgggaccagtgctgctcttcctcgctgcttactccgggaggtgaaggtgacagggcggcaaggagaggtaaccacagcatggctggggacaggcgctacactgggccccggacccagcacagggatcacagtgtcggtctcgcgcacacacctctggccacatgtgcacaccacatacatccacacgcacctccctcctgtctggcgggaggctcattctctctcgcagccactcgccctctctgcctctcacatatgcggtcacagagtgaatccgagcatcttattgctgcagggggcaggggcgtcggcatcagggaaagttaatccacgaagagcgagaacagcaccattaccacgatgcccgcacagagcagaagcagctgctgcagggagcgcctgtggggagggaacggctcacggtggaggcatgggcagggggagcaggcagcggccaggagcccttccctcctgagcccctaagggccctgtgagtggcagtcctcttcctccaacaggtcactcaccacgggtcctcttcttccaagaggtcagggagcacgttcaccaaggcgatgtagagaaagccgccagaggtgaagggcaggacccaggctgccgtctcctctgcagcgggagaacacccaactgggtacccaaggcactgtgtgtgctccccacctcccgggcctggggaccagcagtgcggtagccacaccctttggctggtgcccctctgctgatgccacccgccacaaccacccgccacgcccgtacctactcccttgggggactgggtacagatggcgaagccagcgcccagtaggccccccagcgctgttgagagttgcagcttggctgcgctccatcggtcaaagccggcccggagcaggatggcaaagtcgcccacctgaagggaggtccagaggttcaccctgcgcccca

SEQ ID NO: 65279 - DNA, 1029 bp, Homo sapiens
ctgagcctgtggtatctgtcctgtccccagtcctgacgtgaactacgaggagctggcccgctgcacagatgacttcaatggggcccagtgcaaggctgtgtgtgtggaggcggtgagtggtcagctggggtgggtgcgttgctttgtgccttcttgccccctccctggacaggatgggggcatttggctggtggagacggctgagggaagaggcctgagcctcagggagccagggaaggcattcaggcgttcagacctagactctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgccgctgcttgtctgccttccctgggctctggctggaggagtgggggcgtgtgtgggaggcaccttccccaggtgctgacgcctggaaacccggagacagccgtgggccccataccactggtcaggatgaggctttctggggctgtgtgtggtgctgcagctgctgcctgggccttcaggcccctcagagccctctctccccgagcaccactctgctctgagctttcagaggctcatggccctgcagttcctgcacagaggacctggatagaagccaccctttcactttcggcattttggtgtctggcactagtccttgcctcctggtaaagccaggcttgggtttaggctttcagcatcctcccttgtttcctggcccttgggtccccttttctccagatacccccttagctctttctctccctatctttggccaaaaactgagcctgaacaggatccactgggagcccctctaggactggtctgtcacgctgtgctcccctcccccaattctgctatctcttcactccagctggccccttgccttccctgggtggccctgcttggcttccc

SEQ ID NO: 65280 - DNA, 1042 bp, Homo sapiens
agtgagccatttccctgccctggacgggttaggttaggcttccagggggtagaggaggggagggctctgcctaagctgtgccctcaccagcatctcgggcttcctgtgccctagctttgacagtgagaaggctggggaccgggaggtgcagaggacaatgctggagcttctgaaccagctggatggcttccagcccaacacccaagttaaggtgagtattagcactcccaggcaaagatgatgaggctcagaggtcaggagctgtcaggcccccagctagccagtggtggagctggaatgagaattgggatctgtctttaacatcccatgtgtctcacctgcactctgggggctgcctctctgccttttttgaccgtgtctgcccatctgtgaacaccttgctcctttcaagttgtggcttctcttcctcaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcaggtgagcaggagcacgggcagggcacagagacctgaacaggcgcaggaggatgtctctgccatgcttctctgtactgatcttccccagcctccacgaccaccacctcccaggccccaggcacacacagcaccgttccacacgccagcctccgtttctcctcagttgtgtgatgtagcgtcttgccagggcccatgtcgtaattctgggtgctctgctccttagactccacccctcatctgaaggcacagaggctggaggcacttagtttcctggcctcacacctcagcccattaacacacgccaggaatggccgggaccagatggacttgagttcagatatgtatgactctcagcaggtggcatgccctctctcagccttacttttttttttttttttaatttttggagacagtgtctcgctctgtcgcccaggctggagtacagtggcgcgatctcggctcact

SEQ ID NO: 65281 - DNA, 1128 bp, Homo sapiens
agttcttcccacgtggacaattccgtgaagcctgctctgacgttaggagcagcagcgatttctctttaaagctggttaatgattccctcccgtaactccgggtggccagcttgtacttaaataattgtaaaaatgcggactgaggtggcatgcctttttggccctttgcacacggctggcctatgtcgtttattaattgggaggcagtgtcattgtgtaaatccccttattcctagcggggtcacggtctgagtttgaacgcgcccctccgcaagcatctgtcacgggccagattaaagactacatttcccaaaggccctcgcggatcccacccttctccctccctttccggttttacacataggccccgcccccaacgcgcgtgtcggccaatagcggccccacctctcgcgcccggcaaaaataggacgcgggcgggaacgtttcggggtccgcgggggcggggcctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgaggtgggcaccgggcgagctggcggtccgggaaccggggcccgcagggagacgccattgacaagagggaaggaggtggctgggggtcaaggtctggcccgatcccggggacggggttgtttgggatgtgggcaggggtcctgactccatcctggttttatgggcgtggaaactgaggctgtgagtgggttcggagaacgagggatgcttgtcctgagtaaaagtaaatatataaataaacaaataattttttacagcaagatggaattggggaggaggtgctcaagatgtccacggaggagatcatccagcgcacacggctgctggacagtgagatcaaggtgggcgcacagctcctgtgcgggcgatggagcccccacaggacaggccccg

SEQ ID NO: 65282 - DNA, 1024 bp, Homo sapiens
atgttaacttggagctgcttgttaaatattaagtgaaagatcaaatagatttaccttgaaaaagaacagtgaaatggggctttagctgaagggaaatgacgtcacgagaaggtgggttagttttcttttttctttccttcttttcttttcttttcttttttttttttttttttttttttttttgtgagacagagtctgcctctgtcacccaggctggagtgcagtggtgcaatctcagctcaccatatcctcgacctcctgtgctcaagtgattctcccacctcagcctcttgagtagcttggaactacaggcgtgcaccactatgcacagctgattttatttttgtagagacagggtctcactaagttgcccaggccattctccaactcctatgctcaagcgttcctcctgtcttggcctcccaaagtgctgggattccaggcgtgaaccactgtgcctggcccagtttttattttttaaatgagatgagaaatgccagacatgtttgcacgtggatgggaaagattctgtagaaagagaggacctgacgatgcagagactgctcatcggaggctggcatttgatgggaacaggagccatcctccacagtgacaggaaaggaggcagggagcgtgggagcagaggtgcggagatgggagatctggtggagacaggaggggaaggagcttctccctgattttcttccttttcctcgtggagttgaggcgaggtcatcagctgaccatgagcaggtagaaaatgcatttggaagcttgaggaaaaagtacaagccaatggttgcatcgcctcgctgagtctgtctgatgttcttttgagcctgttgtgctgccagtctgccactgagcttcagtgaacacctgcttccgggtgccagcaggcaagctctagtggagggatctggtatctcccatccctgtgcatctctgaagctgaggagcccatttggcattgggagaaaagagaagccaactgtgttttcttgtcttttcattcattcactca

SEQ ID NO: 65283 - DNA, 1047 bp, Homo sapiens
ccccatttttattcattaaaaatgtttaaaaatcagaacttatatgcaaataattatcctagctaatgttgattgtttaccaccatcaggcgctgcaggatacacatgatacccactacatgttccaggcttcatagcatccctaggaggtagctagttttcccatcctcgttttacagatgagcaaacaggttaaaagaaattgggttgcctgctagaaagtggtgtgcactgggaatcaaaccacattgcccaactcctgagccctttctcctaaccactactgaatagaaagaattcaaaagccaataaatgtgctttaattaacctgtgtctcatcacagattgattgctctctgtcctctaggccccagtgagaggagcttagaggacctatggcttttgtggctcccctgggaggtgactcattgcagctgcgccctccttaaagcagccattttggtgtttgagaggttcacttgtaactggttggtcagcgggctcctgcagggcgctgctgcctgtgggggacgggcaacttctaaagagcactcctctccatactctcacgtcactagatctgagaccagctcaaccattgtttacccagtgtcgtttgtttttattgtgacaaaatcaaatttgccattttaaacacttttaagtataatttttaagaattttgttttactttggagtatagattcaagttgccctgaatatatactccctataattttataatttactaccattaaacacattcacaatgcttgtgcaatcatcatcacctgattttttgtttttgagacagggtctcactgtcaacgacgctggcatacagtggtgcagtcattgctcacaacagcctcagcctccccaggctcatgtgatcctcccacctcagccttcgaatagctgggacttacaggcacatgccatcatgcctagctaatttttgtattttttgtagagacaggtgtcgccatgttgcccaggctagtcttgaacttctggactcaagcagtctgcctgccttggcctccc

SEQ ID NO: 65284 - DNA, 4377 bp, Homo sapiens
acttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcagagttactgattgttggggagggtgatgtgtccttggagcaggtggggttgccatgttcctgaagagggggtgtgggtgccctataaggcttcatttttatgtacctgaagatgtgcagctgaaccccccaaaagctccggaaggaaaacataatttctccccagaaaactgccttccccatctttttgtattctccaggatttctacttatgcggaaacaccttaaaacttttttgcccaccctaatttttgagcatctcctgttctccttggctgccacaaaacagagctggtccagacctgccagtgcacatctcttccctagtgcgcagagtccctgctccctaggactctgctggccagcaccaaatcccagagccccggcagtcttcctccctccagacctttaaagctctggcccaaagttcttaagcttctacttccctcactctgacctcagtacaaggcccctgaatggcatgcttctaaggctctgtggactactcaatagtgctggatggaccaggcctcagccttctcctacatgtccctctatgtggagtgggtcttgggtagcatttctcagtgagggttgcattgagtactagaccatgatatgttctatgaaataaggattcttaacacaaataagtttgtgaatgttgtccctgcaataaagaatgttctctctgaaattaggcagtaaagaagcctcagacttgatttagccaagcgtctcccagactggggatcccttttgctgtccacttgttctcaaaaacaagtggcagcttgggggttttagattttgtctaccaagttctgcat

SEQ ID NO: 65285 - DNA, 1212 bp, Homo sapiens
aggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggcc

SEQ ID NO: 65286 - DNA, 1572 bp, Homo sapiens
ttggggaggccaaggcaggaggatcgcttgagcctaggagttcgagaccagcctgagcaacagagtgagacctcatggctacaaaaaattagtcagacgtggtggcgtgtacctgtgttcccagctacttgaggctgaggtgagaggatcacctgagcccaggaggccaaggttgcagtgaaccatggtcacaccactgtactccaccctgggtgacagagcaagaccctgtctcaagaaaaagaaaaaaacctttaaattaccatgtagctgttaagtggtactattaagaacctaatttatttcgtatgacataatgtccagatttcttgtccctgctgaataaaattgggatttgagatgaagcacataaggtatcttgcataaggaggactgagaatctccttgcctcattatgtccctcacctaggtttctgcttggacacacaggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaag

SEQ ID NO: 65287 - DNA, 1314 bp, Homo sapiens
tctccaaaaaaaaaaaaaaaaattagaacataggtaaagtgctgctgagcacattgcatagtacagtagatgacacatagaatgtacttagtacctgttagttgctgttttaatggtagggttcacccacatcttgtcagaaatcacatgtacccctttgagtttgcagtcttgggcctcttcttttatgacattctagctcattatgagaaagtggcagaatagccagatagaaaatggaggctctcattccacagattggatgaaggtaatggggagcacaacacccgcgtatggcatttcttaatgtccccattagcaaggcctggtgaatgtcctgaaatctagccagtcagatagtttcttctcagggagaaactaagagggagataaaggggagaactttggagttttccctcttctagatgtcccaagtagacttgtctttggcatcagtttagtctttctagtatattaatccttctcttcctccaaccaaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtgagtgcaaagggagatcggggtcaggtatggggggcggttttcctcctataccagaacggaaaggcagagcaaaggctgagggaaccagttaggtcgtcagaccattgtttttctttgacagtgtcaagtgtagactgagaaaccctgtgaagtgtgatctgctttttaaatgttttctggatgtggctcaaatcagaacctctgtgtgccctcttgggatggggctgcagtttttagatgaagcaacagacactgaccttatcgggtctgacacatttgacaagaatgtttctgttaggaggtcttctctacagattacaaatctatcagaggatcttctgtctggatgtcttctgtttcagtgtcccttttagctatatcatttggcattttcctcactttctgattgatgtttgtcctgattgaagacaaactgaggggtgatgggacagagtttggcccatgagttgatggagtgggaagtatgtcgtttgacacaaatggtattcaatttaggagaaaaataggagagactctttagccagaaagaggcctgaaggtgacttacatgaatagaaggtcctgctgacacctctgtgctcagatttgactgggtttttataac

SEQ ID NO: 65288 - DNA, 1825 bp, Homo sapiens
atagttggctatatttttggaaagttgctagattgtaatctgtattgtattttaattctcgtttactctttccactccccccacccctcaccccatccatctttccattgtctagtaaatggtttgcagcagcgacagcacagtttagattccttcttcccctttcaactgtgttgtctgggctctacttggaagtctttcactcagtgatttttcctctctcctctttctggtgatgaatctgctattcaagtgacagtgtctttattctttgtgtcattgctgctctgctgtgttctcccttgtttgctcctgggccttctgcatctgccatgttttctgcgtgttcccctctattacagagagcgaatcccctgtaaagtgtgagtgaggggcctggatgcagtcccattctgtgctgtaggttttggcattgttctcctgtgctcctggccctatggtaggcagtttttcttggtttcctaattgcccacacctttattaatgtacacttggcatggtatgctattggattagccatctcttctctgaggaaatgatttcaagtttcttaatgagtgatacatgaatcatttttggagccctgtaatgttgtttgtaaggcttatctagaacagttcctctttgtcagggaccagccctctgccagtgtgtgcttgtcattgctggaatggatatgaagcacccttatctgctggctaatctcttgctttggatgttgtagggttgaatgcaatgcagttacagaatttggctgcactagctgctgcagctagtgcagctcagaacacaccaagtggtaccaatgctctcactacatccagcagtcccctcagcgtgctcactagttcaggtaagcatgaggatgacccagtgtgccattatgtgccttggacagatgctttgtgtttaaaggcagagtccagagagggaaaatagttaacacctgtttccagagaggtcagattatgagcaacaaattttcaaatgtcatcttttgtacttaagagaaatcttcctgattttcaatgtgctgtggccattatttgtctctgtcctgcaaggacagttgttagaattagtaactgaaaacctctttacaaatagcatacttggatagtgacactttttcttgtatttggcgagaatgccagtgatgggttgaattttaactccttgctttctaatagcagggtcctcacctagctctagcagcagtaattctgtcaaccccatagcctcacttggagccctgcagacattagctggagcaacggctggcctcaatgttggctctttggcaggtaaggggcagcacctggctgtcatcagactattctttgtgcaggtagcacatcttaaccctggtaggggcaccactggaatgattgcagtggcccagtgaagttaaaaataatcatgagggccaggtgtggtggctcacacctctaatcccagcactttgggaggtcaaggtgggcgaatcacgaggtcaggagatcgagaccattctggctaacacggtgaaaccccgtctcccctaaaaatacaaaaaaattagctgggcctggtggcgggcgcctgtagtcctagctacttgggaggctgaggcaggagaatggcatgaaccggggaggcagaagttgcagtgagccaagattgcgccactgcactccagcctgggtgacagagcgagagtccgtctcaaaaaagcatgggatttttaaatcagacctgagttaaatcccacctgtgtccgttagctagctataacttcggaccacctttctaaggacattttctc

SEQ ID NO: 65289 - DNA, 1286 bp, Homo sapiens
gggaaacaggttgaataaaaggatcctgtacaagaataccaattttccataaacaatactaattgggtttagttggagcaaaagttttcagcaagctggttagatgaaggttgtggtttgccaatatacaaagtaaactaatgccacaaactcagggacaggccctcttactttatttgtcatgggaccatcattgaaggagaacgtactctgaacctggtatagactaatccatcagtcatttggtcatctgcaacagggaagaccagtttggaggggaggaagtaaataaggttggatagatgtgtagctggagtgattattagtcatgtggtccattgtgaccaataaagggtaactccaagaaatactatgaaatgtttagatttgatatttaaaatagttgtgtgaagtagaaattgagtatccagatggaaacaatctgcagagtgagatgtgtggacctaactaaggagaacttgggagagggtagctggaaatggcattcattcattcgcagacaataatcacagttgactgcgtagctcctcaagtttagcttattatcctgctgtagttctgtcctttgctgtgctgaattctgctgcccagggacttgagcttggctcagtattcagtgaacatactatcttctgggccagtgctttagctgtgttttttttttgtcctgtgctgtcataagcctcatgtttctgttgtgttggcttgggttcttgtctttgactttcttctctctgggggcctctgcactctcgctttgctgtgctgtagagttatcccagatgcagaaccagccctcactctcactcttgttctgttttttggtgtaatgtctagctttatttgcagctccttcagcagactgcctcctctgggaacctcaacaccctgagcagcctccacccaatgggaggtaagtgtttcactgctgcagaggagcagcagcacccaggccagcagacccagctaacaacagtcttgggagtttggcatcgtttctgtgaaaacatttttttgcttattatgtaaacctgacctaggataaacatcccaggactcaattttcttgtctctatacagtggctctatggctagttgatgccacattgctctgacgttatctggtgcctcctaaccttttaggtcactgttgaagaagaatatggaaaagggctgtttagctcctatagactgaggctgttctctgataaggggaaaaaattgcaagaactctttatttccattataaagtgacttttccagtg

SEQ ID NO: 65290 - DNA, 2676 bp, Homo sapiens
cgggcgtggtgggtcacacctgtaatcccagcactttgggaggccgaggcgggtggatcacctgaggtcgagagttcaagaacagcctgaccaacatggagaaaccccatctctactaaaaatacaaaattagccaggcattttggcgcatgcctgtaatcccagctactcaggaggctgaggcaggagaatcacttgaatccgggaggcggagcttgcggtgagccgagatcgcgccattacactccagcctgggcaacaagagcgaaactccatctcaaaaacaagaaaaaaagagatgtgaaaaatacaaaaaacaaatgtgtgtctttgaatctgtaaaatatggtacagagccaggattcaaacccaggcggtctggctcccaaatctgtgccacattgcctctttaagtagtaatattcaagtcttttctgttttactctcttagcagtggaagacaggaagctgtttattggtatgatttccaagaagtgcactgaaaatgacatccgagtcatgttctcttcgtttggacagattgaagaatgccggatattgcggggacctgatggcctgagccgaggtaggtagttttagcttttaaataatcttttggttttttgttttggtttggtttggggtttttttttttttggagacaaggtcttgctctctctcacccaggctggagtgcagtggtgccttcacaactcactgcagcctgaacctcccaggatcagcctcctgagtagctgggaccacaggcatgcatcatgacacccagctaatttttaaattttttatagagaaaaggtctccctgtgttgcccaggctggtcttgaactcctggactcaaacgatcctgtcatcttggcctcccaaagtgccaggattgtaggtgtgagccactgcaccgggcttggaatctttttaatttgaccggtggaaactagcaacagtgattccctagccaatatggcccagtcaagataaagaggttgggcctgctgcttcctgctgtatatctatgtcctgtcttgactcctcctatcagttcattctttttgtctcccagcccctctaaggagtctacattctatatttcattgtcatgtattaaaattttctcttttggtgctttgcaagatccttgatgccaaaatggaaatactttcttcttccattttcttttattttcaagaggaactagaggatatgagtcctcctttctcctgtcaagcattttttttttctgtcagtggttctgttttttcattatagcacatatcaccctgttgcaacataccagcacatgattccctgaaaacagggactgtgtctgtattgctagcatgatagtcagcacatagtaggtgctcagttaatgtttgtcagagaaataaatgaatgcatgagttactgactcttctcttaccaggttgtgcatttgtgacttttacaacaagagccatggcacagacggctatcaaggcaatgcaccaagcacagaccatggaggtagggagcagataggtgatggggaaaattcctcagcttgggaatgctgggacagttggccattaaagtccagcagcatgtgcagcatctgattgcccagaaggttaaacagccaacatcttaaagttaaaaaccactgatttctttaaaattaacgtattggaaatgctctccctacccctttttttgagatggggtcttactttgtcacctgggctggagtgcagtgggaatatcatggctcactgcagccccaaccacccaggctcaagtgatcccccctacctctgccactcaagtagctgggactacaggtgcacaccagcacgcccagttaatttttgtatttttttttaatagcgaccgttttgccatgttgcccaggctggtctaaaattcctgggctcaagtgatccacccgcctcagcctcccaaagtgttgggattacagtctcttctctcttgtgtctatcatgaggagaatcatttggcagtgaatgaaattagaatgtaacctgcatgtcatccaaaaggaagattttttttcttcttttcagatggaggaatttgaccctttcgttatggtcttttcacagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctctatatatatgtatctctggacatgcatctctggttatatcttgaggcttttgctgcaactaaagtgaattcctggtttcccgttttaaagatttagaaacatcttgtgtccttgcctccaagaaagaaattcctgagggaatcttaactaccagtgtctttctccatatctctttctaccagatgtagagggcatcattaaaatccttattgagtctttcctaa

SEQ ID NO: 65291 - DNA, 3357 bp, Homo sapiens
gttgccctcagtaagggaatcttaactggtcttagagtaatagcagtaaattggataactcagaaacagaaaatctaaaatgatggtaacattgtttatgttcatcgcacaatcatctggaaatataagaggtggagctctgttttggtctggagacctaactcgagcattatgattatacatgagtcagctacattcaaaggccagcattctagtccttagtttaatccttgaaaatcaagtgcttcttttctaacttctactgaaaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagttaagatcattaaagaaaagaaaatttcctctggaaagcaacattattacataatagaagtttcattttatctcacacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaaggttagggctttgggttttggtttatcttattttttccactgactctcagagcaggtgagggctttgggtttttaacaggatacaaaaaattggatttttatatgtaatttctttcatgtgcattctctctgtcattgccagaatactcctgtctgtctgtctattggaaaaaatctgtccttttatagtagtaatatcttgtaatccaaacatatttaatggctttaaaaagttaaggtgttagcatgaggataatttgtaaattgggtcttgggcagtcctttgtgagggttctaaatttaagagacagactcacgtgagtgtcttatttgaccttgggaacagataacaaagataaaattgaagttaaaccacataaagttttctttagtgtttgggctagcataagctgaaggagaaagactgtccacatacccattggtttcttgttagtattacagaggccttgcgggatagtttatcaaatagaaaggatttgtttaggcagcttgtttgctgttgccacaaagtgaacaggagaggaaaggcggagctgcttccagaattgcctagcagagtggaagtttcacaagactgatggtagataggtattaactttgccccgtatatacacacagacatgttcttattttccattttaccagttttcaaataattttctgtgaaagctgtccaacagtgcaaatgtaagcaagcatgattatcatattgaaactagcttaatagcagaggatctagaagcagaggaattactttctctttttggcatggttaactaaaaatataaagtataatagtttctgaacatgactggcaatataaccttcagtaatttgtagttctaactgctgcagcatgatttaaaaaaaaatctatattgtatctcatgagaatatgggagtgtcagaacatttaagcccaagatttacaagatatacttcctctcctactacccaaaataaagatacaaagcacaaaatctacagatctgaggcagcaccatgtgcttttagaagcttaattatatttgatgagaaccaagagtccaaaaaaagatgttaagaggtgcttgctcttaagtcattttataatttaataagtgataattatgtttgaggcatatggtagaatctggctacgaagtagggagtggtttattctgagagagcagggaaagaaagagttcctggtagactacaggctgcaaaagtatagagccccatctgtcttcttgtctcatataccacctggtgttccaagtagggtaggttgagtcaaatggcacatgacctttctttatgagaagtcgtattttccagagaagttacatgagcagctaaataagacttatagtgtaactaactaggaggagactaaaacaataaagtgtatagaaaataatctcttattcctctgctagatattctattcgttcttttccactaccctccccctctcactaattttaataaacccagccctcttttaagatctgatctgtcagtggaggaaggattgctctaggaattctctgctttccaaagtttgattttatgaaatcttatttattgcagggtgctgttttgttacattttacacccgtaaagctgcattagaagctcagaatgctcttcacaacatgaaagtcctcccaggggtaagaaagctcccactagtaaatggaaatgtggtaactttgatatgtgggatatacttacacatatcagacacacactgaaaaccattttggggaaaaggtaactgctgcaggaattgatgtaaaggaagacataaagggagcagttcagagattacctgacattagttctctctcagtcaagagtcttgtgtattttgacttcttgactcacattctgttttctggggaaagatcatgaagcagacatgagttcagagagaactctttaaagctctagttctggtattttagagtccatatgtatttttgaataccatcaatatatacagtgataataatcatatttttccttttcagatgcatcaccctatacagatgaaacctgctgacagtgagaagaacaatggtaagcaaatgtatacaatcttccccttaagatttctgcctaggccaggcacggtggctcacacctgtaatcccagcactttgggaggccaagacagatggattgcttgaggccggagttcgagccagtctggccaacatggtgaaaccccgtctctactaaaaatacaaacattagctgggtatggttgtgcatgcctgtaatcccagctactcaggaggctgaggcatgagaatctcttgaacccgggaggcggaggttgcaatgagctaagatcatgccagtgtactcccgcccaggcaacagagtgagactctgtctcaaaaaaaaaaaagatttctgcctagtttgtttgctgtt

SEQ ID NO: 65292 - DNA, 1028 bp, Homo sapiens
ttaagtttgaagattgcccctggtccttaggccacaccttgtgtgtgtgcacgcccttttttttttttttttttttttctttttgagatggagtcttgctctgtcgcccaggctggagtacaatggcacgatctcggctcactgtagtctccgcctcccgggttcaagtgattctcctgcttcagcctcctgagtagctgggactacaggtgtgtgccactacacccagctaatttttttttttttttttttaagtagggacggggtttcaccgtgttgttcaggctggtctcaaactcctgacctcaggtgagtcactgtccccagcctcttgggccacagtttgaacagtgctactctatgggagtcttctggctattgaattggtatataaacagggaaggggaggttcatggtgtaggtagacctggaaaaatagagaaggatttggagagctaaagaagagcaaaggatgacatttctctagaatcttgagtccctgctaaacttttgggtaaactgtaatctacatatattgacttgtgtttatgctttagcactaaacaggatgcaaaagttcagaattggcacacaaacaacagagggaaggggcaatctgggagcagttgcctccgtaatacagattgataaaactgcttttcagaaatagctgtcagcttccttatcaaaatgtattctgggcaccattggggttctttgttaacccactctagaatagaaatagaatgaaagattagcaacattctagtaaaatgctattacaactggtaattaaagttgtcgggacaggttgtagggagccagtgtttcactagtgatagggctgccttttttttctggagacaagatctcactctgccacccaggctggagtgcagtggccccgtctcagctcactgcaacctccacctcccaggttcaagcgattcttgtgccttagcctcccgagtagctgggattacaggtgcacgccaccacacccagctaattgctttgtattttttggt

SEQ ID NO: 65293 - DNA, 1656 bp, Homo sapiens
aaactttgcaagggtgcctgggcgtaggccattgccccgattttaaacatgagaaacccagttgagagagagattgaggacaaatagtaatcagtgttgggcctgaagtacaagtttaaaggtaaaggtctttttatttttgcccactagaccaggctgcctctagtgtcagtgaacggttagccaatgttcttgattcttcattgatcactcttaagcttccactggtgctactttgcctgcatcctaagatatggatattttcatgagttgtgtcccagacttttttcttttcattctcccattgcttaaggggacactgatgtgcttctctgcttctcagatctctgttcccccaaatgtcttctgaggtctaagactttattctaaatactgctcattgattacttttcatctagagacttccccacaaaaagtaattcccatattgtcttcactagaacccaagagttgttagtttctttctcttcctctcctccttggagttcaagtgaactccagatcctagtgtatcctggcccaaaattcctcagtattggctgagactgggtgctaatcttaggtactagtttatgcaagagccttctgatctccatgttccctgccttatttcatcctccagattatttttaggtatcttttaaaaggacagatctgatcattcacttaatctaaaatcttggaataaactccaaacctgtctataacatggaaagcccttcactgggtctctctgacctacctctttattcttagtcagctttctagtatgatctcttctctgtttctgtactctgcccacaactttctcaagtcctttttctcccttctgatgttatcccacttttcccatctctcctcagtccttaccatttcttcatcacccttaggcctctttcctccatgccacgtagcactttttctagttgcctactctatgcagctgaaatctctgcacacacacctccccctcctccaaataaagtaaaatcatattagccacttctttcatagaacttttaaacattcctttataggatttgtagaggattatagttgtgcccttctactttttcagtgacattgcctcaagggcacatattgctcagtcttacagagccctatagtgtgtagtatctggcaccatagcaaaagcttgggaattacagttgaatgaatgatattaaagatgattgcagagataagatctccagatcttatctccatacctcagggaagaaggctgaaaacctttaaaagcatattgttagctattctgttgttggatggtgactttaaattattattgtctttattgtccttagagatagctttttctagtacctaacaccccacatgataggaagattgacctttatccaaatgaaaattaactttctcacagcataaatgtattattctgtcttgttctcactagggagcagctggtaagtaactcaggccagtgtttctgggccctttttattctcacgcacttctgttccagtttttccacagcactgtatgtgagccagagggaccttgtataagggtgggtggtagcagaagtttggaatgcaacaagtatttttgcctgctggggaggtggagggattggtaagtatctgaattttt

SEQ ID NO: 65294 - DNA, 2491 bp, Homo sapiens
atgctagtaagaagcagaatattactattccatttttattttctggcagatgaagcttcagagttagtaaagaaaatttccctgtgccatctaatgagtgttactgaacaaaggatttttgaagtctttcacccagatgaggaaccattagatagcacaccttgctctaaccattagatagcacatcaagaaagcaaggtcagttgagaaattgatgctcttttgaaaatatcaagaaaaaaaaaaaagcaaggctgatcaactgtaggcagttgtatgtgagtggtaagtttctggtggccagtttattcaaccagtttgcctctggcctgcttctgatggtcttatcattcctctttatgtgactgttctgaggttagtttggacctaagcactgtgctcattgctgtctttggcacatggaaacgtaagtttaaaagcaaggctaacaacccatttcttcggtgagccttttcttgcttcaggtagtttcaggctttgggggaccttaaaaactggtttgcagggaggagtttggaggatgtgaaacaagtttgtgtttcttctgctctgttagccactgctatcttcatggatctgacactatttatctgacagtgcacttagtactgcttcgccagggaaaattgcacaaaacaagcctggcgcatcagcactttcattgtgtgctgggctgagcctcccttcacatggtcacatccccattttaatccaatactccctttccctaccccttccccagtcctgcctctttctgtggcacttattgctggtttccctgagctcctgtttccactttgtgttttttgtggggcccaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtgtaagtatttttgttgtctaatttttatcataagcagaggaactgggctgttttctttatttgatgaaattggttcctttttttaagaaggggaagagaaaaatggggaaagaagccaaaacaacctgaattctctcatgctattattttcaattgtagtctgtctcattactgcttatttcctcaaggctttaagttatttacataaaggtgcacttgatatatgaccagcagcatcagctcaagtgtgctagctccaattcctttaagctgtagtgttttcctatatgatagattacaaggtattttttttttaaactgtagcattgtcgctttgggttggacatgcaatttcaaataatcttttgggaaggaagtattttattattttaaattactggattcttagtctcctatcacagagaagactggtagctacagtcagtgtgtttagtatcatctacaacattctgtattaacatacaaagtgcaatcctggaccttgattccccccacccccgccgagtctaattgaaaatacagctcagcacgtgattttaggaacatcaaattgtcctttaccctccaaaaaaagcaaaactggatcaatcttgattggcaatttgcccaaataaattgtgagagtgagaaaccttgttagcttgcagtactgtccaagaactgctgttgtacacagccaaaatgctaacctaaccctgagttgtagctgctaggaacctgaattctggactttgtagagaaggacacatttccaacccctgatttcagtcactgtaaccaggcttcagagtattttggaacctccagcaaatgagctttaggttattcaaagccaagaatattaaatggtagaatattctctagataacaagtgttaatgcaagtctttgaggttaggcctccatgtgcaaatcagtctaccctgggattagatgtaacaggtgtggataatagtagataccaaacagttctttgtggaatagttggggggcagggctcaaagttagctctttctctctctgtttttgaaacagggtcttgctttgttgcccaggctggagtgcagtggcacagtcacagttcactgtagcctcaacctcctgggctcaagcagtcctctcgcctccgcttcccaagtagctgggaccacaggcatgcaccaccacctggctaatttttaaactttttgtagatatgaggtctccctgtgttgcccaggctggtcttgaactcctgggctcaagctatcctgctgcctcggcacctggcctgtcttactcttttgaagtggatcttatgcctcctctgtagtctccaaaattacggtaatttaaatgtctttttatgagagttctttactactaaaattttattttagctgtaacaggtgaaattaaagtgaatatcatgataaagatttaatacataataaggatatttccatgtcccaggatttatgatccttagaaacaaggctg

SEQ ID NO: 65295 - DNA, 1303 bp, Homo sapiens
ttttttggtgggggagacggagtcttactgtcgcccaggctggagtgcagtggcgtgatctcagctcaccacagcctctgcctcctgggttcaagctattctcctgccttagcctcccgagtagctggggttacaggcgtgtgccacctcgcccagctaatttttttttttgatattttttagtagagatggggtttcactatcttagccaggctggccttcaacttctgacctcaggtgatccgcccgccttggcctcccaaaagtgttgggattgattacaggcgtgagccaccatgagctgttgttgctcagcctttttaaagcctggaatgtctttttagaggaattcttgcactaaaagatctaatttggttgtcgactcagttattctttggtctaggcagctttctataggaagaggcatgccatcagttccaatgtacgtaggagaaactaggacaaacatagccagtaatctaaccagccccagctagggttaccatcttctgcctgacaggcatgggcttggtaaactgtgtactgtgtgtcagttgcacagtctcctctcacttgcagtttgtttttgccgctttaatagggtggaagagagctcctgccacttctgcctctatagtagtaaatcagatgagcgagtctctggcaaaaatagaaaaagcagtaagctgctgttacagtacagttctagattttggatgatgacgtctggacatggacagaagagacagttttcaccttcctgggtcaggtgcagacagatgttagccattgttacacagattagaacttctaggcctatgccattgtgtgttgcctttcttttttttttttaacgttaactctgtgtgtttagtagttcattcgttttacttctttgcaggctgaacataacttctttttttcaaagttccctgtgttgtgaactgagcttgggtgaagtgaaatctttgaggtaaggcaactctaatgataaaaatggaaagaaagcctgtgaaatttgggagccttcagagataacattttagagtcactgcctaaatattgaaatgccgccatttgttgtttggggggatgtggagctaaattgagaacgggagcacacatctgccttgactgctaagtatatccatctctactgctcacccataatagaatttttatgtgtgcactcactagtcttggttttatcaacagtttaaaggaggaaaaagagaatgaagagacttcatttcttggtttttcccttacatgtttgagtgttgtccctggtaggccctagttc

SEQ ID NO: 65296 - DNA, 1010 bp, Homo sapiens
tatggtcacatttctctagagagacagacctaccaagaagccacgggcaggttatcttccttagcatctgaatccttagggtagtcctcaccttaaatggtcataatgataaaggattgaatgaagtttgtgaacttagtaaatggaagttcctttcttcttggtaacttttgatggtagaggcaggtgcaagtaaatgcttttaggaagttctgtttttttttttaattagtttaaactttgcccttaaaattactggaactatcactactttattagcaaaattggaaactaattaaatctgcatgaaaagttaatacttgagcacctattttatgccagttaagaaatctctctgtcttcagggaggataggcagtgtcttactagttagttctgggtctggctttgtctttcagaattcttgtactttccagtttagacattgtccttggtgaatttgaatagtttattgtctgtagtgaaagccagacagaaatacagctggcaggagttgtatttggaagtttgtaggaatttgggcagttttatagaatcagtctttacttgcaagattgttcgatatgcttaaaaataaaacaaattggttttgtggttcctctgtttgcttttaccatcaattaacttccccatcttctgatttttttttttgtttcagtggttcaccgccaccctagggccaccaagatgcatttacagtggcaggaacgtggttgcttttgtagagtttcatgcccggcacctatgtattcaggaaggttgctttggggaaatagtgtggtctctccacatgaataacacgatccttaattgctaaaagaattatacagccattagcttttcttagtctccaatccaaaagcagatgttaaaaatgattgttttggtgacctagatgtactgaaattcaacctcataaattttagtcattgttttgctatttgttacgacattttagggcaagactcttttaaaccttttagtatttta

SEQ ID NO: 65297 - DNA, 1177 bp, Homo sapiens
caagcaattcttcctgccgtagcctcccaagtagctgggattacaggcgcctgccaccatgcccagctaatttttgtatttttagtagagatagggtttcaccatgttgaacccgggaggcagaggttgcagggagccaagattgcaccactaccctctagcctgggtgacagagcaagactctatctaaaaaaaaataaataagtaaataataaagagaggcaaagtaatattttgagtttcccaataaaaggcattttacaagctgccttattttaccaaatacagcactgtgactcaagaaagtccaagtcccagtggttggttgtggaacccaggtctcttaatcccttatcttccctttagttccttcatctgaaaaatgggaatgaaaatgctgaagaatctcctttgagcactcagaaaaataattatagtcctttccaaaggttatgtgttataatgactccgcaagagacatcaagattataaggtgattttaaaagtcgctctgacagggcttgagaaaaaaattagtcacattctgcctacatggtactaacatatggtgcagccctgatgagctgcacaagtgggctgaaatcaaaatgcagttggaaagaggagcagtagtgactcactagataagacagatttggcctcatggcagggcagtgaaactaagaaggaactgtggtcttagaacatgccagatttgagcaagtgatcatgaatattatggaaaggttgaatgactgagcctttgggtttgaattaggtactttgtctggtgtcacagtccttggagcgagcaccctccctcggtgggttcagagctcccactccctccacctccctcacttctgtgtattacttctgtgtatcattccctgtgcctttgaaggtagaagccaccaggcaaatacttaacactggtgtgcctggaacattgggttcaaactgcaatgataggtagaagcgttagtaattctgcccagagaaagctgtgcattagcttagctaccatatgtaaattgctactgctgcatccagcaatttgttgtccattgttgacagtactgccatggtaaagaaacaggaactatagaaagaattagattcctcctcccacctcccagctctcaccacagtaggaagctgtttggggagcagagag

SEQ ID NO: 65298 - DNA, 3325 bp, Homo sapiens
aaagaacagcaagccaagtaacaagtttgtgaaacatctctaaaattactagtttatctccactagtaccagactatttactgaagatattgaaagcagaattaattttagccttttttgggtcgggggggagcgcaggaagagattggttctcactgacccaggctggagggcagtggcacaatcttggctcaccacaacctctgctcccagggtcaagtgatcctcccacctcagcctcctgagtggctgggaccacaggcacatgccgccatgcccagttaatttttttgtattttttgggtagaggtagggttttgccatgttgcccaggctggtcttgaactcctgagctcaagtgatctgcccacctcggcttcccaaagtgctgggattacaggcatgagccacagtgcctggcctgcttctttacctcgttcctgcaccacacatcttccggagatgcccttacaaggggagcatgggaaggtagaaccagcaagttttgccatatccataaacttataatctgtgtgagagtgacaggaaaacacagagaagtctgttcaaaagaaatgatgatgaaggaattattagtaggccatgtaattcagtggagggtagcaaaaaatgtattgtatcatggacagtgtgatgaaatagcacaaaaatttgatttagacagggaaataagaatcagctctcctgagattttttaagtctttcacatttatggtaacattttcccttagatagatgctctcccatgtttcttgtttctagtgcaagtcgtattttctgaacaagaccattaactccttaaggacagggattgtgcctttttttttggtatcctctttagttctgggtatatagtagatgttttctaaaaatgtagttgcttttttgattgatagatctcctggcttttttttttaagagcttgtttttgtaaaaatgaaatcaaagcactgacaagttaaattttgtggaacagttgagtttttttaggagtgatttgaaggatgtgacagatgatttaagtgggtatttaaatgtgagaagcactccttttttttttttttgagacggagtctggctccgtcgcccaggctggaatgcagtggcacgatctcagctcactaaaagctgcgcctcctgggttcatgccattctcctgcctcagcctcccgagtagcggggactacaggcgcccacgaccacgcccagctaatttttattttcagtaggggtttcaccgtgttagccaggatggtctcgatctcctgaccttgtgatccacccgccttggcctcccaaagtgcaagtgctgggattataggcgtgagccaccacgcccggcgagaagcacctttaggagcacaattgcagagtgatgaaagcatgataattgaagtaccttatttatttatttatttatttatttatttatttatttatttatttagagatggagtctcgctctgtcacacaggctggagtgcagtggtgtgatctcagctcactgcaacctgtgcctccctgttcaagtgattcttctgccccagcctcccaagtaactgggattacaggttcccgcctccacgccgggctaatttgtttgtatttgtagtagagatggggtttcaccccgttggccaggctggtctcgaactctgacctcaagtgatccacctgcctcggcctcccaaaatgctgggattacaggccagccaaagtaactttttttaaaaagtgataatagaatagaatagaatttgtcttagggctgtgcgtcctttagggtgaatcaagctttgctgaacatgttccctgattggctgaagcagaggtacaaaatttgcattttctggcctataacctaactgtctcaggaagtgtctctacagaagtagtttctggtttctctagttttatagaattaagaatttaagaacagaaagaaaataaagtttcctgcttttcaacagaacagggcaaagctcctgaaacaagaccatatggaagcatcccgcatgagtgcccgtgtgtttgatggtgaggttggggcagatggtaaaggcagggttcttggctgcttggtcaaggattttggagatgatagaagttaggtggctagtgctaaggaaagactgttgtatgttgtgtgtattgggcctgtctgcctaagaggtggagcagcctcacagagaggaaggaaattgatgtgtttggtagggtagaggtggtaagataagaaaagaggcaggggagatgcagagttggaatgataaagcttgcaattgcatctaaacctgcccctgagataagggagagagagacaagatattacagtgtgagaaataagattccagttccctggtgtcttctgttctctagagccttcaagtaagatactgcagggactgtagggtttttctgtttaaacttgaagctcttttgattcctttttgagatacaagccaaaagctgtatttatagaacttgttttgacatattatctcaccctgtcccttgccttctttactggaatccagctaatgttgcactttgccttggcaggaaaggttgattgaagaaaatgtatagctatacagctgagtgattgaaatagcttcagactttgtaaataggccatacatgatgaggtcccagctgcatgaacgttatttgagttgctggggtcatttaaaatggtgtgatgtaattatgatatactgctggatcacctggacaatggcagtttccacacagaagtttcaggcaaagcaggaaaaaaatacaaaaccaaaatgctgttttggaaaagagtatgagttgaggtttttctttactttgtgctttatagttccacgagttttcctttttttaagtggtaggaatggacttatgggttgcagggggaagtggacaaggggatacggtgtctgcaggctaggttgccatgctccaaaagctcaagttttctttaaaaaaattttcagtaggccgggcacagtggctcgtgcctgtaatcctagcacttcaggtcgatcacctaaggtcaggagttcgagaccagcttggccaacatggtgaaaccccatctctactaaaaatacaaaaaagtagctgggtttggtggcaggtgcctgtaatcccagctgctcgggaggctgaggcagtagaattgcttgaacccgggaggcggaggttgcagtgagccaatattgcgccattgtactctagcctgggcaacaagagcataacttcgtctcaaaaaaaaaaaaatttctgtagaataggtaacgtgttcacatgtaaa

SEQ ID NO: 65299 - DNA, 1018 bp, Homo sapiens
gaaaccccgtgtctactaaaaatacaaaaaaatcagccaggcttggtggcacatgccagtaatcccagctactcgggaggctgaggccggagaatctctcgaatccgggagatggaggttgtgatgagctgagatcatgccattgcactccagcctgggcaacaagagcaaaacccgtgtcaaaaaaaaaaaaaaatcagcatagctgttgcattttaaaaagtgaaactacacactatgtttctagctcagtaaacagatgaacctgttgtctttgagtaacataaccattgagcgttgtacagtacatcttaagatcaggtactttattttgaagagatagaatcatcatgtaacaggctgaaattttttgggactcattcttttccaccataaacaccaagcttggtgcccagaataataatagtagcaaatgtttattgagcactttctatgtgtcaggcactattctaaatgctttacatgtataaatttaattctaacaaatatcctgtaaggtagatactgtttgtgtaaccattttgtgcatgaagaaacagaggtatttatgaagaagttaaacaatttccccagttacctggctagtaagcagcaaaactgggattagaaagcagtggtatgactctagagtctaggtatagggtacattgtgggtttgtagtaaatatttgtctattttattagcacactttgttatttgagattattaaattatgaatcagtctaacccattttcattttagaatttccttatgaaaataactatatgattttggttttgcagatcaccatcaactgtactagttcatttattttttattttattttttatttttggagacggagtctctctcagtcgcccaggctggagtgcagtggcacgacgtcggctcactgcaaactccgcctcccaggttcacgccattctcctgcctcagcctccggagtagctgggactacaggcgcccgccactatgcccggctaatttttttgtat

SEQ ID NO: 65300 - DNA, 2666 bp, Homo sapiens
gccagcctctcttctcttaatgtgtatagcatttatagtttgtaccccacgctttagtgcagtagtcatgtactgtctgcctttattattaatatctcatgttaatctcatctaggaattagattggaggtcactgatactatggttttgatttgtgctgtagcccctatgataccgaataaatacataaccaggctgggcttggtggctcatgccagtaatcccagccctttggcaagccgaagtgagtggatcacttgtacctaggagtttgagacccgcctgggcagcatggtgaaaccccatctctataaggggggaataaaattacataggtggtatgcactaagtacttcagtaagggctgaagaatagaatcatttgagccaatcagccatgcatttcttattgttggaaaattcactctggtcagcaattaagcttttcacatacttcacattgaagtgaatctaaatgaattgttctaagtaaaataatttttggaacacaaatatttggcttctggttatataagccatcatcctcagacatagattttaaaaattatattagagtttattttaacttgtatcaaccataaaataaaaaagagctcaaaacatacacagttggaatgagaccttcattctgaaagcagcaaggaactagtgaaagttaacattgttcactcgaatggagaataacctttttttgcatgttaaattttaggatttaaatgataaattgagcctcaccactactgctgatctgggaagaatctgacctagtaaaggttttcaaatgtcttttccatttcccgtggctgagggattcttggtgtcagtgactgaaattatttggaagttccttgactgaaatagaatatctcaaaccttatttcaagtaccagcctgtgtgtttctgttttttgtctggagcatgtgaacagaatgcatgtgtgtgagataattgggctttcactaatggccccctttcagcaaccatgtatgggtaaagctgttcagttccctgctcctccctctctgagcacggagcagaatctgttctgctgaagctgctgttccactttttagcttgctatatttgtacagcaacagcaggagcagcccactagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagaggtgactcgtttgtctttgttgttttgctgtgttcaggtttgtcaattgtaaattgtagagaatgcttcaggttgttagggatggggtgaggagacaagatttgtatttaacaaaataccgtcttggcgagagggtaccaaacagggaaatgtgatgtcagaaatggtctttgggttcccttagaaacataccttgttgaagtggtagtgttttttttttcctctttgttttgttacaggtcacaaagatcagctcttggggtggtattgaattcctttcctggcactcaaattttttgacataaaatttgagtataaaaagatgaggcacctccacccctttaagaaatgatttagtgcacatcttgaaagagtgcagtaggggttaagtgtgttgacttcgctgtctgccaggaaaggaactgtggggaatgccctgttgctttgggccccacagcaacctatgctgtttgcgctgtttgagtgctttgtaaagtttggccttacagaggccttgtaatgccttttggtgtcatgtctgtttaaggaatagcagaagacatgacatgtagacaaatttcaggttattttcagaagatactgggtttgttactgtattttaaaaggatactttcttggtttgttatgagatattctaattaaacagtgatgaattcttactcctggtcagtgtaagtctaaattcaagtttgttgctttgttttacagtttcctttcactcccctcccccatcccctcatgagtcataagcatgcagtgttgggaatagaacttgtcagctgagtggggatgagacagttctctgcccatactatttgtaactgtagtcaatgaggagaggaaaggacgttattaaatgctggagaaacaccttgattgaggcagcttcttctgtggctgtgtggtatggatgcagagttctgtgtgactatacactgatgtattctggctctgaatcacttagggatctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagtaagtgacactctgattagcacacctatattctagctttctttttgttcttggccttttttaaaatttataacttccctggtctcattttattagtttatatttttcc

SEQ ID NO: 65301 - DNA, 1065 bp, Homo sapiens
ctggagtgcagtggcacaatctcggctgactgcaacctctgcctcctgggttcaagtgattctcctgcctcagcctcctgagtagctgggattacaggcacgcgcccccacgcccagctaatttttgtatttttaatagagacagggtttcaccttgttggccaggctggtcttgaactcctgacctcaggtgatccatcgtgggattgcaggcacgagccaccactgcccggcctggaactccttttgatgactggttaacttagcagtgttttataatcaaggatctcatagttatatcagcataaacatttctagttccaccattctatttccctgtgacagggtttttgtttttgttttttcttaatagtggtttaaaatttattcaacaggctaggcagaaatgtctcagatggaagaacattttcctgaaagtgttacatgagaaatgttacagtggatgctgagttatggtctgaatttatttttatcttagtttagaatatgttttctctaaagtaggcaaaaactataattttgcttccataagcagtgtggtattaatctcatactatgaaacatttcaggttgaaaccacactcagagtttcagaaatggagggatcttagaaatcatcttgttcaaattctgtattcttcacatttaagatatcgcaggtgccttctttttttcttccttgagacagagttttgctcttgttacctaagctggagtgcaatggcacaatcttggctcacggcaacctccgcttcccaggttcaagcgattctcctgcctcagccacccccacacctggcatgcaccaccacacctggctaattttgtatttttagtaaagacggggtttctccctgttggtcaggctggtctcgaactccggacctgaggtgatctgcccaccttggcctcccaaagtgctgggattacagacgtgagctaccactcctggtgcgcaggtgcccttaatgagagttctggtaggtgggataagcaagaaagtctaggtctgtctgttctcagtctctcttctctcttttcttt

SEQ ID NO: 65302 - DNA, 2025 bp, Homo sapiens
gtgtgagccatctcgcccagcccaagacataatatgtttgtggagtatcttaataactattgcctacggtagttaatggtatatcttatctccatagaaccattttttttttcttttggtttgtgaatttgttgtatgaattggttctgagtttggttttcaacacatttaaatggaatttatatttaggtttcagtagttattagtgtgagggatactcttgaaatttgtgccaggtacttttctggctcaaactattatggatcaggcgtagggtagctgaagttctagattattactgtgaaatcaagtgctgtttttgttaatgttcatttgtctggtataagtttgctctggggctaagctagatctatggaaagacttaacccttttccagaaagcttccaacttagggaaaaaaatttttttttttctaattctgactgttccacttctgaaaaaaacagatccacagatcagacttgtaaatgatctgttttcttaagatatcttctaacagaatgggtctccagggaactgagtgacaacacacatttagctgggagtggcagttcatctccctaaacgtaatttaacatcacatttatctacacactacagttttggaggcatacttggagattgaacttatacttctcttggcttattttattttattttatttatttttgagatggagtctcgctctgtcgcctaggctggagtgcagtggtgcgatctctgcatactgcaagctccacctcctgggttcacaccattctcctgcctcagcctcccgagtagctgggactacagttgcccaccaccacgcccggctaattttttgtatgtttttagtagagacagggtttcaccatgttagccaggatggtctcggtctccttaccttgtgatctgtctgccttggcctcccagagtgctgggattacaggcatgagccatggcgcccggccagctttatttttataattttgtgtctgatatatttctaacataattgtgtagagaagctgagatttcttgaactttggaaaacattgaaatcttgatagaaaaaatactaaatatggccaggcgccgtggctcatgcctgtaatcccagcactttgggaggccaaggcgggtggatcacctgaggtcaggagttcgagaccagcctggccaatgtggtgaaaccccatctctactagaaatacaaaatattagccgggcatggtggcaggcgcctgtaatctcagctacttcggaggctgaggcaggagagtagtttgaactaaggaggcggaggttgcagtgagcagagattgtgtcactgtacttcagcctgggcaacaagagtgaaactctatgtccaaaaaaaaaaaaaaaaaaaaaaggaaagaaaaaatgctaaatataacttatgttgtggtctggaaagaaatagcagcatacataggtcatagaaacttcagttgagtttatattgatgtagctgcttttatgaagagggaggggaaaaactaagagttgaatatatttaactattgtgcaacagagtgtcactaaaatagttataaatattccttttttttttttttttttttttgggggagagtctcgctctattgcccaggctggagtgcacttgagcaatctcagctcactgtaacccctgcctcttaggttcaagtgatgcttctgccttagcctcccaagtagctgggattgcaagtgcccgccaccatgctcagctaatttatgtatgtatgtatgtatgtatttatttattttttgaaatggagtctcgctctgtagcccaggctggagtgcggtggtgcgatctcagctcactgccacttccgccttccggagtttaagcagttctcctgcctcagcctcctgagtagctgggactacaggcatacactgccatgcctggctaattttttgtattttagtagagagggggtttcaccatgttgcccaggctggtcgtgaactcctgagctcaggcaatctgcc

SEQ ID NO: 65303 - DNA, 1095 bp, Homo sapiens
gattacaggtgtgtgccaccattcatgcctggctgattttttgtatttttagtagaaacagggtttcaccatgttagccgtgactggtctcgaactcccgacctcaggtgttctgtccgcatcggcctcccaaagtgccgggattacaggcttgagccaccacacccagctgttgggaagagtgctttttcccccataccctccttagccccaggcaaaaggccgctggaggtcttgactccttcagtatatatatttgcatttggtgtttagaatgctttgccagatcaagattatgagtttatttttttaacaagttttttataattatttgtttttaatttttttaggaatatgagcctgttaaaaataatactgctatttcagataggaaacttaaagtgagccatcagttttagagaatttttgtttgtgaggcatatggattcagtcttttcttcatttctagttaagtggcgtttgttttagtttcctgattgtttcctcttaaaaaaatgttgatgggcttgagtggaacacaataatgtgggttgaatggctgttgagactttaaacaaagggtaatggtgaatggctgtgtgcccagttgatggagtctctctggtcccagctcagtaacttcatgaatgatctgtgagaggagcatcacagtggtgtttttctctttgagaaatgttaataagggagagggggaagctctgagaaagacagtttagcgcttctaacgtgattttgtttttttcctgtgatattttggtttgttaggttgaaagactttattccagagaaatgtaaacattccctgtaatactaatgagcaggaattaaaaagagacaagctagttttgaaatggagattttttttttttttttttttgagacggagtcttgctcttttgcccaggctggagtgcagtggcgcgatctcggctcactgcaagctctgtctcccgggttcacgccattctcctgcctcagcctcccgagtagctgggagtacaggtgcccaccaccatgcctggctaattttttgtatttttagtagagacggggtttcaccgtgttggccaggat

SEQ ID NO: 65304 - DNA, 1760 bp, Homo sapiens
ttctttcgttctttctttcgttctttctttcgttctttctttctttcgttctttctttcgttctttctttctttctttctttctttctttctttctttctttgacagtctcgccctgtcaccaggctctggagtacagtggtgagatcttggctcgctgcaacctctgcctcctgggttcaagcgattctcctgcctcagcctcccaagttgctgggattataggcatgcgccaccacacccagctaattttgtgttttaagtagagacggggtttcaccatgttggccaggctggtctcaaactcctgacctcaggagatccacccgccttggcctcccaaagtgctgggattacaagtgtgagcctccacacctggccaagtagtttccattttcatagtaacattgctactctttagcaaaataatcattaagttagaaactgtcaccactttctccttgttcttttacctttttgtttcctgtgagattgagtaagctcttgcagactgtgtgaatatgtatgatattggtgataatgtgaggtgactaatagtctactgtgagtagattgtcttttttaacccagtattatttggacatctgttaagtttttgttaatttctgttttgtacagataatttgctgtacgctttttccagttgctttgtacttctagcttttgtgtatgggaaacattctacttttcagctccagccgctttccctcacactgcagtcacatagctcagctagtgtttctttcctggatgaattctgtctgggtgttgctgctgctaacttaccatgctagatcgggtgggatattctcagtgagaaacacctgtgccatttactggctgcttgcctgttttttgttttgttgttgttgttgttgttgtttgagatggagtctctctctgtcgcccaggctggagtccagtggcgcgatctcggctcactgcagcctccacctcctggtttcaagccattctccctgcctcagcctcccaagtagctgtgattacaggtgcccaccaccatgcccgggtaatttttgtatttttagtagagacggggtttcaccatcttggccagggtggtcttgaactcctgacctcgtgatccacccacctcggcctccccaaagtgctgggattacaggcgtgagccaccgcgcccagcctgcttgcctgattttgagtgctctctgagcaagagtctcgtgggggccgaggagtgaaaggaagtcagggtggtgatgacagcttgaaaatgcataactgtttgacatttgtcagctagtgggtgattactgcatgatgaagcagcactgctttgtgttcaaagtcattttatagcaggctttcaacaaggatattttactggaagctgtttatgtggtaaaagattatttatcccttaggtctgtatttcctagatggctagagcaagaggagcagacatcacatttcgtgtttaggaatgctcttcagcccctccatgctcatgattcagtatttgtcatttagtgcacagctaatctttttcatgaggcttttcctgtccattcattcctgtacctgatttagtattttattatttcagcaagattttaagctttttgaggatggaaactgccttactgcttagtgtattgcatatactttaggggagtggttcaggcatatagtccctactctaattataccttgtgatttagcccctcttgtaatatcttattgcaccagaggtggaca

SEQ ID NO: 65305 - DNA, 1310 bp, Homo sapiens
gggtttcgccatgttggccaggcttggccaggctgatcttgaactcctgatctcaagttatccgcctgtctgggcctcccaaagtgttgtgattacaggcatgagccaccatgtctggcctattctttgattcttgatttttttatttttatttttttgagagtgagtgtcactgttgttacccaggctggagtgcagtggcaccatctcagctcactgcaacctccacctcctgggctcaagtgattttccttcctcagccttccgagtagctgggattataggcatgtgccaccatacctggctaattttgtatttttagtagagatggggtttctccatgttggtcaggctggtctcaaactcctgacctcaggtgaactgcccgcctcagcctcccaaagttgattgctattaatataatcctatagttaccagaacacgtatactagaattacagtacactgaaatggtcaaaaggcaaataaaatagaaataagaaaattttgatgaaaatctggagaattaagtctttctgtaattgagagttgattttttgattgtggaatccttgaaatggtttgaaagaatgatgtgacttgaatgggctttataaacacagcctggtaaggatagctgtgacagcttgggacagtggatttggggtaccaccagttaacatttctggccctgttttcctgtctttaaagtggagataccaactcagaatagtaatgtgaggattaattgaggtaacttatgctaggcactgaacagtgcctgatacagtattgataatgctgtttctttttccatgtgtaaaatgggcataccactagtctcttgggtcagtaatgcatttcagccaaatgaaataaataacacaggtgaactgcctaggagtgccatacatagatgagcagtagctactatgtcagtgttccttttgttcccttttatgagtgcattttgttttgcattttcttgtgtctgttgtggcttaagggataagatttgtgtgtctgaaatgctgtgctaaacaggacgttgttccttgtggaatacttgggtaatatggtttcctagatttcatattcactatttctactttgagagtctactgttaggaggcttctgtgttcaaagaaaactgaaaattataaatgaatattttggatttgtaataggggacacttgggtctcttcgtagtttcaagtgacaagttgaggcggggaggagggctctaatatttagagttgtaatgcagatttaagacttaatcagttttagctatttgctttgtaaacta

SEQ ID NO: 65306 - DNA, 1724 bp, Homo sapiens
ccgcgccctttaccttcactctctaggctcagaggcctcgtgccctgcccagggccagctccgttttcctcgtctttctggctgccgtgctggacccaggctacctgcccgggacaccccatctctgcccctgtcgtctcacgtgttcttagtgtccactcctgtgggtgccgaagggtccgcgcccctagaaggcagcgcttttcccgagcctcgagagcccctcgttcctcgccccagatccgctacggccttggctcgccctccccccacatcaggtgctcacccagtcgtggcctagtagctgggcaggaatctcgcacccgggagcgggaggagcacattaaagcgctttcttcgctagggaccaggctttgattttaaagccagtggtgtcgtggttgtggtcctccgggtaggatgttgttgtaattcttggagaccattacacatgcaccaaggagcttctcattggtttaggctcatacccatagttgaggggaatgtggtaagattttgactggaatctgtttccgcaaaatggaatctctttctcgccaggagagagctgtaggtttattaccttcgagtaaaaaggctgtataacagttttaaagagcatgaaatgctttataatgtgtgcagtgtaagaggttacaaataatgaatcttttacaagaacttcatcttttttttttttttttttaagacggagtttcgctcttgttgcttaggctggagtgcagtggcgctatctcggctcactgcaacctccccaggttcaagcaattctcctgcctcagcctcccaagtagctgggattacaggcatgtgccaccaggcctggctaattttcgtatttttagtatagacggggtttcaccatgttgatcaggctggatggtctcgaactcctgacctcgggtgatccacccgcctcgacctcccagagtgctggggattacaggcgtgagccaccgcccccgcccggaacttcaccttttaaagttcttttcactgtctttgattacccatgaattgggaaggctttaattggatgctttccccttgcccacaagtgtagcttctctccaagcgctttggaagtttcagcctctctattaatccttggtgagaatgaaggcgtctcaatatagaatcaccctttctgttttagcattaaagagtccacttagaaaatcatggaattacaatagcatgcacaaactgttgctacagtgattttcttctcatgttaatttttatattcttcaggctttacttacctagtatgtggtttctgatcatgagttagccaagattgaagcagcactgttggtaaagcaaagctggagctttcagttgttgctttaaccaggaaggttatggttcccctagtggttctttcctcatgacagtccaccacctgtttccattaagaatggcctttggcccagatcacaggcctcaacttctattcaaccattcattctgacccctttaaagaaaacccagggttttctttagagattgtgctatctagacttaagatctggtagcaagaggggctgttagagatggaatatcttttctagaaccccttcactttttggatgaggaaactgagggccctagaaattaagtgacttacttgcccaaggttatgttttttttttttttaaacaatatcacgagtaataatgcaatcttccctttgaggtgta

SEQ ID NO: 65307 - DNA, 1058 bp, Homo sapiens
taggatttggcagagcaagaattgggtagaaagactgactttccacctgacctgttgcatagtattgtgagactggctgactgcagtggttacagtactctcccatttataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagac

SEQ ID NO: 65308 - DNA, 1228 bp, Homo sapiens
agttccttgagaactactgtcatcaagttaacaatcttaatcaccctttgtctgaagcactagcttatgagagttttttaaaagctacaaggatgaatacaacagattctccgcccggcataaattgcctcaaagaaagtgactagaggagagttggatgccatacagtaattagagagtagtatgataaagctaggaacaagtgtgagggccaggatcttaaggatatgtgtcttagctgagccttagcctagaatttaacagctgtcatataattttaattttgccaataggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaa

SEQ ID NO: 65309 - DNA, 1033 bp, Homo sapiens
agggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggtatcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttcctattggcaaaattaaaattatatgacagctgttaaattctaggctaaggctcagctaagacacatatccttaagatcctggccctcacacttgttcctagctttatcatactactctctaattactgtat

SEQ ID NO: 65310 - DNA, 1062 bp, Homo sapiens
atcacgaggtcaggagatcgagagcatcctggctaacacgatgaaaccctgtctctactaaaaatacaaaaattagccgggcgtggtggtgggcacctgtagtcccagctactagggaggctgaggcaggagaatggtgtgaacccgggaggcggagcttgcagtgagccgagattgcgccactgcactccagcctggacgacagagcaagactccatctcaaaaaaaaaaaaaaagaggccaaattaactgatggcaagaatgcatggagagtatgcagtctcaacaattaagagatttgccttaccttcaagcttgtcctgagtgactctgcaaaagcctctctttcctctttattaaagttgatccaggcttctattgcctctgttgggttctgagaacacggaactccatctgtgagagccagaggaaaggcatggtcaatgacaatccgaaagagaaattcagagtaagggactttaaagatgtgaaccactttattagactactgctgggcatgtgtatatgtgtacatgcatacatacacatatacatgaaattaacctaaaattgctttttttttttttttgaggcagggtctcaccctgtcgctcaggcagaagtgcaatggcgcaatcaccatcaccatagcctcaacctcctgggctcaagcaatcctgtttcagcctcccaagtagctgggactacaggtgtgcaccaccacgcctggctaattttcttattttctgtatagacaaggtctcactgttgtccaggctggtctcaaactcctgccatcaagggatcctccctccttggcctcccaaagtgctgggattacaggcatgagccaccatgcctggcgggtcttgcttttttttttttttttttttttttttgagatggagtcttgcactgttgcccaggctggagtgcagtggcgtgatctcggctcactgcaagctccacctcccgggttcacgccattctcctgcctcagcctcccgagtagctgggtctacaggcgcctgccaccatgcccaggtaattttttgtactttc

SEQ ID NO: 65311 - DNA, 1002 bp, Homo sapiens
tagtacctagcgttaattgagtgcttaatgtgtgcctggaacctcgctaagcgttttagtgaatgatcttatttcgtcctcacaacagccttatggggtagatagcatcttactcttcttactatagatcaggaaacagtccaaagaattaaactgcccagggtcaaagacctagtgaatgacaaagtaggcctgcctgctgccagaggcagaaacacctaaccattattctgtagcttgtgatgtgtgattgctcagtggtttagggttgcatgaatgagtatgtacatattatgttacagtcaagatacacggactgggagttaggagacctggcatttctcctttcctgggttttctcattgacacacacacacacacacacacacacacacacacacacacacacacctgggcctcagttttctcattgacacacacacacacacacacttttaaggagagagagagtctgtgagggatcttcaagccctgaagttcttagcttgagaacctggtataaacttgcgtgctaaggagctacagagaggcaaaagttcagttcccatcctcaaacagctcttagtctgacaggagaactgagactactgctttagcagaaatgcaggcaatgtgagggaagaactgtggagtaattttgagaagaggtgaacaccccagctgctatagtaagagtctttctgaggaccgtgtagttaaggtggcactttccccaagttttcatcactgtattccctagaagggaaacctttcacatgcacctttctcaaggtgcttcagggagcctttcctggatttgacatcccttacaagcctaagagactgcatgcagggctggcttttgccttctccatttcttttttaaatatgccttttccttccagccactgtcagaccacggaatgatgtggcccacaagcagctctcagcttttggagagtatgtggctgaaatcttgcccaagtatgtccaacaagttca

SEQ ID NO: 65312 - DNA, 1029 bp, Homo sapiens
ctctctgggaaggcagtgacggggaagacaccagatgcttagccctcaaaaattacctctgaggtgggaccagtaacgtgaataaagaatttcagtggtgctgcaggttatttgcaggaagatagtgtgtaatattatcactcgtgaattttatagcaaagtaactgtttagaaatgcagagatgtggtgctccagccctgctcttttagttcccagtcactcctgctgtgttagtgctttgcatgctcctatttccctcttgggctacttctgggcagggctatctccctcgcttctccctttcaccccactcctgctatctgcctcacctggtttgcctcttcactctagcacctgatgatccttaccttatccatttgatccccaagtaacaagaaaagctgtgtcaaatgtactgctttagatctggactgtgaatatgccaagggcaccgggcctgaggttgtgtatctgccagtttaggtttactcttttcagccaccgactactccctaatcctgggcaaatgcttaccattaccttgtaagagtgtgtgggtgggtgagcagtcagttcggagctcctgatgtgggagtggtgagcaggggaatctgactggtgctggcagggcatgagaggtatcctacattttggaatcacacactctagctggttgggatgtgatctgacgggtaacacaggtatggatggagacttactgacagaggctgggacaggagtcagtaaccgagaggaatgggctggggaagtcaccaatagccttgtgaaaagtaggctcctgtgtagctataataaggacttccttagtgctcaagcctgccttttgctcctgcagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctcc

SEQ ID NO: 65313 - DNA, 1057 bp, Homo sapiens
cactagctgtgagaccttgggaaagttggtcattttaagcctcaggctcctcatgtctagaatgcaaagtaatactcattacagttttcttttctttttgagacggagttttgccctttcgcccaggctggagtgaagtggctcgatctcggctcactgcaacctctgcctcctgggttcaagtgattctcatgcctcagcctcctgagtagctgggattacaggcacgtgccatcacacccggctaacttttgtatttttagtagagacggggttttgccatgttacccaggctggtctcaaactcctgacctcaggtgatccaccctcctcggcctcccaaagtgctaggattacagggatgagccaccatgcccaccctagagtattagatttagtaccatgtctggcatagagtaaatatttggtatgtgatagttattagaattttaagaattagaagggaggggctactttccaagtatagacaataatatgggcaaagttacggcgttagtaaaggctaaagcatttggaggcaagtggaattgcatctcttactgtcctaacctttcttcaaagctggatttctgccatataatgagcacctagaacagggactggcacatggtagagactccacagatgtgtgttgaacaaagtcagctgcctcctagctgtatccactgaatatccactgaatgtccttgaggatccccaaactgagttacatctcaagccctcttcccaagcctgtggtggtacttgcactctaaattctattataaacacagcattatgcccctattccccaagctagaaaccctggagatgagtttgtgtcctccctacccctccctctgcttctagaaaatcactgctggattctcagaaacgcctctgaatttgtcacctccctttctttcccgtcgcctttaggcatcatctctgctcagctgttgctgcagcctctatcttgtcttcctgctgccagctcaaggcagtaggcagtagataaagctggagttctaccatctttgaccagggtacagaggat

SEQ ID NO: 65314 - DNA, 1598 bp, Homo sapiens
atcgcttgaacctgggaggcagaggttgcagtgagccgagattgcaccactgcactacagcctgggcaacagagcgagactccatctcaaaaaagaaaaacaaagaaataaatgaaagctagcacttactgaatgttaggcactgttctacatgactcatttgctaagccagctggaaagtggcaaagccagaatccaacctgggcgttctgtctgcccagagtaagaacttaataaggagaaattgtagttagttcatagtagctcagcctttcagagaatactaatccttgttctgtagtgatagtcccagttttgtcctagatttagtcacgtctcccaattggacctctctgctgatttggattggctgatctcatctcgctagatattatttgtgttttgttttgttttgttttccaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaat

SEQ ID NO: 65315 - DNA, 1033 bp, Homo sapiens
tcacttgaggccaagagttcaagaccagcctgggcaactgagcaagaccccatttctacaaaagtgaaaaaaaaaaaaaaaagctggggcaggcgcggtggctcactcctgtaatcccagcactttgggaggctgaggtcgggagttcgacaccaccttggccaatttggagaaatctcatctctactaaaactacaaaattagctgggcatggtggtgcatgcccgtaatcccagctacttgggaggctgaggcaggagaatcgcttgaaccccaggaggcggaggttgcaggagaatcgcttgaacccaggaggcggaggttgcagtgagccaatatcacaccattacactccagcgtgggcaacaagagggaaactccatctcaaaaaaaaaaaaagtagttgggtatggtggcgtgcgcctatagtcccagctactcaggatcagagaattcttctggccttttgttaaaatgttggatgcagtggtgtgctaagaggaagaagcatctccaggctcaaaactgtaactgttgtctttccagggtaccgatgaagcgagacaagtgttagagtgtctcaccgcagtggcactaggcctttaaggtaaaggaaaggagaataaagactaggaatgatctaataacagctgccttgtttccattttacagttttttgcgagtatgttgacctatccctttgtgcttgtctccaatcttatggctgtcaacaactgtgggtaagcactttgtatttcttattctagtaggtggttgactgtatgctgacaggcggagcagccttgtagaaatttaggaaagatgaatgatcagtatcaatctctgattggtatttttttaaaaagggggggaggaaaagtataattgataccattagaagattcctaatttttttctttgtatgccctatgcagcagcagcctcaatttgtatttatttattaattattattattattttttttttttttgagatggagtcttgctatgttgcccaggctggagtgcagtag

SEQ ID NO: 65316 - DNA, 1011 bp, Homo sapiens
caacatagcaagacaccgtctcttagctgggcatagtggcttatgcctataatctcagcactttgagaggtcaaggtgggaggatctcttgagcccaggagtttgagaccagcctgggcaaacatagggagacccttatctcaaaaaaaaaaagacaccatttcttaaaaaatattttgaaattagctgggcgtggtgatgtgtgcttcaggaggtcactgcacttcagcctgggtgacagagtgaggcactgtctgaaagaaaaaaagaaaagaaaagaaaaggaaaaaagaatatattgatgtgttgtagtgttgtaggtaattaatttaaggctcttttcctattttaggtttctaccatgaatgaaatgaagagttattctcaagctgtcacaggagtgagttttttaaaatccttttaaccttctaggaatagttgtgttttgttttgttttccttttaaatctggcttgtgtcatcactgctttaagataaccagatgtctcactgggacatctccctgaaatttgttatatttgtcaaaggtaagaataactcagttttcggccaggcgccatggctcatgcctgtaatcctagcactttgggaaggtgaggtgggcggatcacctgaggtcaggagttcgagaccagcctggccaacatgatgaatccccgtctctactaaaaatactaacattagccgagcgtggtggtgcatgcctgtaatcccagctactcgggaggctgaggcaggagaatcactggaacctgggagatggaggctgcagtgagctgagatcacgccactgcacttcggcctgggcgacagagtgagactccatctcaaaaaaaaagagagaataactcagttttcgaaggaaccacagactcacatgtgaaaataaagagagtaaggcagaacccctgcctcacatcctgcatggtttggtactgcttagctttcataaggggcgtgcctttcctccgaaataatattgttcaggcca

SEQ ID NO: 65317 - DNA, 1050 bp, Homo sapiens
ctctaagatactgcacagttactgggttgtagtcacaaaacaaaattgttctcttctcccaaaaatgtgagtagagactaaatggagcctgtcatttatctagaatgatgtcagactctccaaaatcacttaccaataagagagcaacttaataatctcaataaaggcctcatattttttatttcagcttaatgactttgttggtgacctttcctgtttctttatttttttctcttacctgtaaaattgagaaaacaacagaagcctgctttgcagagaaattttgagaagtaactataatagaacattgagatccatgagtgaaaagtatgataaaatgacaatgaatgagatctttcacatcccattcaaactcttcttgactccagccagggcaggagggctgtgtcattcactttcttatcctataccacgatatccacccacattccttctcacaggcatttgagtgtcatttgtttagatttcagaagtgtgtgttgattgtttctagacaactcgagagatgatcgctcgttctgctgctaccctcatcacacatcccttccatggtatgtttgcagttgacaactgacctttcttttataacctgatctctcctgaccacttagataggttgacgtgggagttgactaaaatgccttgcctgcatgtttttgtttgcttgcttgttttggcttttatccaatttatccagatagcaaaatgtctttaggtggaaaatctttttttttcccagggctatcaaaatctatcttaacatagtttttttttgtttgtttgttttttgtttttgagacggagtttcactcttgttgcccaggctggagtgcaatggcacaatcttggctcactgcaacctcagccttccgggttcaagcagtactcctgtctcagcctcctaaggagctgggattacaggtgcatgccaccacgcctggataatttttgtatttttagtagagatggggcttcatcatattggtcaggctagtcttgaactcctgacctcaggtgatccgcccacct

SEQ ID NO: 65318 - DNA, 1911 bp, Homo sapiens
cttgctctgtcacctgggctgcagtgcagtggcgtgatcttggctcactgcaacctctgcctcctgggttcaagtgattctcctgccccagcctccctaagagctgggattaaaagcgtgcgccccaatgctccgctaatttttgtatttttagtagagatggggtttcaccatgttggccaggctagacttgaactcctgacctcaggtgatctgcccacctcggcctcctaaagtgctgggattacaggcatgagcaaccacacctgtccccttttcttttttcaaagaagagttttcatgaccatttgcttttcttccaactgaccaatatgttaaacttagcaacaagtttatcttggagatccatatttccagttgattaatgagtagaagttaactgaagatttgcagcttaaaaaaaaaaacaaaaactttaaaaaaaacttcagctaatttactttctgtcagtagagttttcattttatgtcttctttcacatgacactgtaataaccctaatcatcctttttctttttttctatagcattaccaggagagtgacaagggtgaggtatgttggagctgatttctaagcatgagggcctttcccttgcaagttgttactgcttttggggcctcttttggagaaaagccaagtagtcagtctcctattcatctcagtgagtgttgtcctatggggtggccaccagtttggacagttctgtttgaaaccatcaggatggctgggcatggtggctcatgcctgtaatcctagcagtttcggaggccaaggtgggaggatcacttgcatctaagagtttgagaccagcctgggcaacatagaccccttctctacagaaaatcaaagattagcggggcctggtggcacatacctctgtatctcagctacatgggaggttgaggtgagaggatcacttgagtccaggacgtcaagactgcagtgatccatgatcacatcactgcactccgcgtgagtgacagagcgagaccctatctcaaaagaaataaaaaccgtcaagatcggccgcccatggtggctcatgcctgtaatcccagcactttgggaggccgaggcaggtggagatcacgaggtcaggaaatcgagaccatcctggctaacacggtgaaaccccgtctctactaaaaatacaaaaattagcagggcgtggtggcgagcacctgtaatcctagctacttgggaggctgaggcaggagaagcacttgtacccaggcggtggagcttgcagtgagccgagattgtgccactgcactccagcctgggcgacagagcgagactctgtctcaaaaaaaaaaaaaaaaaaaaatcaagatctctattttctttgattttgatttccaggagttaggacctggaaatgtacagaaagaagtctcatcttcctttgaccacgttatcaaggaggtaagagatgaattacatcctgtgctgtttgcccagatcaaactgtggtgttgcaactatggaatcagaatcatcaggcctgtgtgttcagtgtctgttcccaaatgaaattaaaccttcaaattaatttgggctttactacatgtataacattaaaaagagagaggatcagtgcttgctgttcagaatagatgcatttcaagaaaactcattttgcccacacattccgtctttagaatactgaaagtcttctaatagtgttgaaaacctcaggaataaaagtgttaaaataggccaggtgtggtggctcacgcctgtaatcccagcactttgggaggccaaggcaggaagatcacttgaccccaggagttagagaccagcctatgcaacatagtgagacttcctctctacaaaaaaaatagaaaaattagctaggtgtgtggtggcacatatctgtagtcccag

SEQ ID NO: 65319 - DNA, 1611 bp, Homo sapiens
ccggctaattttttagttctagtagagacagggtttcaccatgttggccagactggtctcgaactcctgacctcaggtgatccatccccctcggtctcccaaagtactgggattacaaggcatgagccactgcgcccgaccgacagcctgttcttctaacatgaagttagcttgtaattctttcctaagtgaattatccagctatatctgcatttgccttttgagtgttttgtctgggttgccaaatatgcagctgatgctggcgtaatggatgtcttctagttttgttcaaatacaaaatgtgccttagattttatttagaaggtatttttgagcccccttagtaaactgtagctttcctaacgcaaaagttcccttctttcagtttgatattagcctatttcagctacatggtttacgtcatagaatttgaaccaaaatgaaacttggagtttattgaactcagtattaccaacagaagaaaaacctacaagaatgatgcttcatcattgccttggaaaacctatgctgcatttttacttgtgtttaaaaataacccaaattgtgttctttattcaagaccttgcaagcaagacatttctggaaatattgctttaatattgatatattccattgtttttaaaggtgggatatgagcctcttcctccaacaataggacgaaatatttttgggcggcaagtgtgtcagcttcctggtctctttagttatggtaagtgcctttgatttatttgggtttgcatgacgttgaggactgtgataggcaggagttgttattgaaagaaaatatatagaaagcttgtttctttgaaattgtagtatatccatttctcttgaccagaacttgacaacatctctgacttgtgttcttagctcagcacattgccagtatcgatgggaggcgcgggttgttcacaggcttaactccaagactgtgttcgggagtccttggaactgtggtccatggtaaagttttacaggtaagaggaaaattaaatcaatcttcccatagatgttgcttacctgttatgcatagtttgttctaaatatcaagagcaatttaaaagatacatttataaccctgtcctttcttcctcttgaaaaacactttctttttttttttttttttttttgagatggagtctcactctgtcgcccaggctggagtgtagtggcgcgatctgggctcactgcaaactccgcctgccgggttcacgtcattctcctgcctcagcctgagtagctaggactacaggctcccgccactgcgcccggctaattttttgtatttttagtagagacagggtttcaccgtgttctcaatatcctgacctcgtgatccgcccgcctcggcctcccaaagtgctgggattacaagcatgagccaccgcgcccggcgggactcagtgaaattgttgctgttacttccatgaaatttacatatggaaaggcagttgtcatctagccaaagaggtttgtgtatagacttagagaaaaagagaaagtgctgcttgagactaagttactttatgtaactgtaaagtaagacaaacttgaggtaaccaggtaccctgaatatgttccaaatgtagt

SEQ ID NO: 65320 - DNA, 1072 bp, Homo sapiens
cagggtacctggttacctcaagtttgtcttactttacagttacataaagtaacttagtctcaagcagcactttctctttttctctaagtctatacacaaacctctttggctagatgacaactgcctttccatatgtaaatttcatggaagtaacagcaacaatttcactgagtcccgccgggcgcggtggctcatgcttgtaatcccagcactttgggaggccgaggcgggcggatcacgaggtcaggatattgagaacacggtgaaaccctgtctctactaaaaatacaaaaaattagccgggcgcagtggcgggagcctgtagtcctagctactcaggctgaggcaggagaatgacgtgaacccggcaggcggagtttgcagtgagcccagatcgcgccactacactccagcctgggcgacagagtgagactccatctcaaaaaaaaaaaaaaaaaaaaagaaagtgtttttcaagaggaagaaaggacagggttataaatgtatcttttaaattgctcttgatatttagaacaaactatgcataacaggtaagcaacatctatgggaagattgatttaattttcctcttacctgtaaaactttaccatggaccacagttccaaggactcccgaacacagtcttggagttaagcctgtgaacaacccgcgcctcccatcgatactggcaatgtgctgagctaagaacacaagtcagagatgttgtcaagttctggtcaagagaaatggatatactacaatttcaaagaaacaagctttctatatattttctttcaataacaactcctgcctatcacagtcctcaacgtcatgcaaacccaaataaatcaaaggcacttaccataactaaagagaccaggaagctgacacacttgccgcccaaaaatatttcgtcctattgttggaggaagaggctcatatcccacctttaaaaacaatggaatatatcaatattaaagcaatatttccagaaatgtcttgcttgcaaggtcttgaataaagaacacaatttgggttatttttaaacacaagtaaaaatgcagcataggtt

SEQ ID NO: 65321 - DNA, 1143 bp, Homo sapiens
ggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtatgaggcgtcgccgctccctaccccgcccggcgccccgttcggtcgctgctgctcagggcgcctgaggatcggctcagccttgcgggcctttcattctcccgagatgctgctgctcctccgctgccctttacctccccgcagggacagcttcctcagtcccgcggccccgcttgggggcctcgccgagccctcgcctcgccgcccagcgttgaggccctctcctcccttagccaaccgccacccggccctgccctgcccggcggatcctctgaactttggttcttcgtcactgaggtggatcctggccggtcgccaccaaaggcttccgaaccctccctctcgcccctccgaaattcacattcaccactactccccccaaaatctcagacgcaaaacacgaaatactcagttgaagacaaatgtgaagttaggtgggaaccaacattttattttttattccttttttttttctttttatgctactgttactactgcttttctgttccgaggttttcgcaccagatactgagagaaacacaaggagctcattcagaagtgttaatgaaggggttgctctgtcagatttcggaaggatgcattgagcgctttccagcagcggcccatgtggctcctgacaatgaaaatcacatttgtcagagctggaaattagtgaagctgagttttagcgagtttaaacatgggagttagtttctaatctactgtcaaataattattacatggtattttatattcacatgcaggtaggccaagtaagtgatagacttagtgtttccagttcctttgctatatccctgtaatgggcaggtcattcttttttttatgcttttactgagagttgacataattacctcatgcactgtgcctaggaatggaacagtttt

SEQ ID NO: 65322 - DNA, 2851 bp, Homo sapiens
ctggagcccaatttcatttttcagaactctgctgcgtacttgggatgttttttgagacggagtttcactcttgtcgcccaggctggagtgcaatggcatgatctcggctcaccacaacctccgcctcccgggttcagttgattctcctgcctcagcctctcgagtagctgggattacaggcgcctgccaccaagcccagctaatttttgtatttttagtacagacagggtctcaccttgttggccaggctggtcttgaactcctgacctcaggtgatccacccgcctcagcctcccaaagtgctgggattacaggcgtgagccaccatgcccggccttaagattattttatgagatgaagatggggtttattttcctctctggtctactgtcctgccagagcacagggatatagtcttggagcagaaggtttatatcccctttgcctgtgtctcctgacatgtaataataagtctttaacttatttgtctgtttattctagactcgaattgcagactggcgggaaggggctcttaatggaaactaccttaaacgaaaacttcaggatgcagcagaacaactaaaacagtatgaaataaacgccactcctaaaggctggtcctgccactgggacaggtacgcactcttctccccttttcacctttcacctttgacatctcagacatgatttgtgatcaccaccatctgacgacatgacagcctgtctggagactgagagcagctgcagttagcggtgctgggcaggcaaagcaccgcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcacaaaaaaagagaaaagtgttttctaagtctcatctgttggagtgagagggttcagggctgtattcacagagttgctggcagtgcaaatagctttgaattatccttggttctccattctcaattgtcaaagctctttgttgcctttgtgaatagcagtccattaagaggttcgtccctgtgaaagcagactgctgtcctgggacaggaccaaatggaagtgtctttgtaggagaacgggttttaaaacatgtgttttctttcttgtaatttagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggtgagacaatttaccttgtactaattcagccaaaatgactttagaggaaaaatcttattaatttacattattaaaagattttatgtcataataatataagcttctgattgagaatagtggtgtgaactaaaacaaggaatgcatgagttattatggttggaaatcagcatactattgttatcacgtgtaaaactgtgccccaaagtgaaaagataggctaacagattttgattttaaaaaattgttttataaccattctatcatgccactgactaagctgtgggtctccaaaaataggaatgcttgtgctgaggaactagatagttgaactgtcaatatatgtggcatgctgagatttgttatacatttctatacaacacttagtctgttcatattgcaacctcatttctcacctccactaatcttacaaaaagcgtggttggtacaaatcaaaatgatatgaagaaatgccattagtacttgtttcagagaagcaaaataattgatcatgaaaaatcaccagcaatcttctggtctaaaacaattggcaataggatgtctcattccatttttaaggtactcttggaagaatttagtttagttacatacattttttaaaagataggctttcatgctcctcagttcctttagtttttaaaaagtttccaatgtgtaaagaaacttccacctgttaatcttaagaattggtagctatttgttaaactgatggcatatgaaggcaagagtctatgagtcgtttctaaagtaatagatctttgaaaattttaaaaagtgaaatttgtcaataacagagttaagagctgaattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaaggctgattttattctacttcacattttagaagtgcat

SEQ ID NO: 65323 - DNA, 1543 bp, Homo sapiens
tcagatctatactcttaacaaatttcaggtattgttaactgtagtcaccatgctgtgctttagatttcctttttttttgggggggggggtgttggggtgatggagtcttgctctgtcaccaggctggattgcagtggcacaatcttggctcactgcaacctccacctcccaggttcaagcaattcttctgcctcagcctcccgagtagctgggactacaggtgtgcaccaccatcctcacctaatttttgtatttttagtagaggtggggtttcacgatgttggcgaggatggtctctatctattgaccttgtgatccacctgcctcagcctcccaaagtgctgggattacaggtgtgagccaccacacccagccccaaaatttattttataactgaaagtttgtattctttgaccaacatctccccatattcccctgtctccagcccctagcaaccaccattctaattctactctttgagtttagcttttcaatattgggatccatttgcaactattgaattccatgttgtattagaatgcattatgatgggctgggcacagtggctcacatctgtaatctcagcactttgggagactaaggcaggaggctgacttgagaccaggagttcaggagcatcctgggcaatagcaagacctttgtctgaaacaaaataattgttttgaataatttttaaaatgcattgtgattatgtagatatgcatttgattcctgtcattatttgtcactttgttatgtgtattatgttactataaattagaattttatattctggataactaaatacagctgtttggggaaggctgtttataggcagacccatatttctaatatctataagaataaatgaaggattgtacataatacagaaaatgttacggattctagttttactttttttcttttttgcattgtagtttcagattggagaactggcaaataccctgacaagtaaattcgagtttctaggcattaatagacaatccatctccaactttcatgtgctgctcttacagactgaggtaagtctttttttttttttttttggcataaacagttaagtgtttgaatgaaatgctgtatgtgttaacgattctgtcttgcttacattttaagcctaaatttaaatttttaaccttgaagaatatttgagccgacaatccaggaaataaaactgtgttaaccaaagcacagtaaatagacttttttctcacaaattaaaattatattatcatggtcagatgaggccatgtaatgttgaaggtactttgtaagtgttaaagcattataagtctgtttaaagagaaaagttgagtcctatttgtaacctgcatactttacaaaatggcagggcaggattaggtaaggagctcctgtaggaagctgactgattttcttaagaactgaacccttggccaggcacggtggctcacacctgtaatcccagcactttgggaggccggggcaggtagatcaccaaggtcaggagttcgagaccagcctgaccaacatggtgaaactc

SEQ ID NO: 65324 - DNA, 1062 bp, Homo sapiens
taaaggatttttattttatttatttattttttgagatggagtctcactctgtcacccaggctggagtacagtggcgcaatctcggctcactgcaacctccgcctctcgggttcaagcatatctcctgcctcagttgggactacaggcacatgccaccatgcgtggctaattttttgtatttttagtagagacggttctactgtgttagccaagatggtctcgatctcctgacctcgtgatcttttcacctccaaatgccaaagtggtgggattacaggcatgagccactgtgcccggccctgaattgtttttgggttatatagacagtaggctgacatgtttgaagagttttaacaagtaagtaaaacaggcaagagagaaagaactaataatcttttgcagatatctgctatgggggaaaaggtatatagtgttctataagtattggtactttggtttaattttacatgttttttttacagcaattggtgctgaaaattcagaaaaaatagatgagaattcagataaagagatggaagtagaagaatctccagagaaaataaaagtacagacaacaccaaaagtagaagaagaacaggatttgaaagtatgtatattacttaatgcaacttgacaaatttttattattattatcattattttgagacggagtcttgctctgtcacccaggctggagtgcagtggcacgatctcagctcactgcaacctctgcctgcctcctgggttcaagccattctcctgcttcagcctccccagtagctgggattacaggcacgcacctcaactcccagctaatttttgtatttttagtagaaacggggtttcaccatgttggccaggccggtctcgaactcctggcgttcatgattcccccaccttggcctcccaaagtgctgggattacaggcgtcagccactgcgcccggcccgccaaattttttttttttttctttttttttcccaagagagagtgttgctctgccatccaggctggagtgccgtggcccgatcttggctcactgcaacctctgcctcccacgtt

SEQ ID NO: 65325 - DNA, 1002 bp, Homo sapiens
agatcacttgagcccagaagttgagaccaatgtgagcaacatacccagatatcatctcttactagaaaaaaaaagtatgatgacatgtgcctgtagttccagctacttggaagggtgaggtgggaggattgcttgagctcagaaggttgtagctacagcgagccatgatcatgccactgcactccaacctgggcaacagagggagagcctgtctccaaaaaaaaaaaagtgctttctgttctcaaagaatttaaatttcaacaacatagtcttgtttattattctgattatacatattaataagcagttaatgacactaacttaattgtcatgttctttgtaggcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactggtaatttgtgcttcacattaaacttcagagttgaaagatatagaggggaaggaaactcttgtctttttttgtttcctcttcaacaaaacaggagattgtacttttactctttgggagaagtgctgggaaggaagcttccatccacctctctaccttttccagatctttttctagtagaggagtaagagcctgagaggctgacacccactggatggtggtgtattcagagtccagtcccatttcttctctctgtctacgttgcccagcctctgtgtgggtgggtagagagtttgattgtgtcatgaggacccaagttgtcttcattcaggtaataaggaccttatcattcattcatggtaaggtcgaagagctcctgctgcattttttaatctattttcagagatccctggatgaagctaatattttaatctccatttggccctaatta

SEQ ID NO: 65326 - DNA, 1050 bp, Homo sapiens
gctctcattcagtcagtgtctgtctaaagtaataatgtaatggtataaatatatactcacctgttgggagtaagtggttttggccgggcacggtggctcacacctgtaatcccagcactttgggaggctgaggtgggcaaatcacaaggtcagtagtttgagaccagcctggccaacgtggtgaaaggcctctactaaaaatacaaaaaattagctgggcatggtggcgggcgcctgtaatcccagctacttgggaggctgagacaggagaatagcttgaacctgggaggcagaggttgcagtgagccaagattgtgccactgcactccagcctgggtgacagtgcgagactccatctcaaaaaaaaaaaaagtcgtttttaccttgagtattcagctactgaaaacagttaatatgaatgtgtgtgcaattgaatgtatgtgcaggtgagatttgtttcagaattaaatgagactaaattattttgttctttataggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagtaagcttttgaaagttacttgtagaatgttttttcctcagtactactctacagggatcattgtgcttgacttacaaccattattgggattttgtttttcttatcccatcatctaggtatgttgaagcttatgcagcaaaaactttaaactacagaggtgtaggttttttggtccttgatgatacttttggtagttatcgggggaactcacccc

SEQ ID NO: 65327 - DNA, 1333 bp, Homo sapiens
tgcatgttgatcaggctggtctcaaactcccgaccttaggtgatctgcccaccttggcctcccaaatgctgggattacaggcatgagccactgtagccggccaaactgtttttttttaaaaaatgtgttcaaaggtgactctaaatgttagatattgagaaaataattcttggtgttaggccagtggttctcaaccagtgttggggggtgcccctaggggatatttgacaatgtctgtcaaatattttttattgtcacaatgtaggaggcagggtggatgggagtgctactgtatctagtgggcagaggccaggggtgctgctaaaacctccacataggattgcccctccacaacaaagacctgtgtgcccaaaagttaacagtgctgttttgagaaactgttaggtgattttggcttttgagcttatatgtaagccagaattgtagagggatttgtgcttaaaatttgttttatcttctagtcggaattgagatgggcgattggcaggaagtctgggatgagaacacgggatgttattattattggaatacacaaacaaatgaagtgacttgggagttaccccaatatcttgccacacaggtacagggattacagcattaccagcccaggtaagaataaatttaaaagtgaaattgcctagaaggaaattgaagccttatcttttgctgatagtatttgtcttatatttctcttgctaagtatatatttttttagttctgtgccaggtgctgaaactagttttgtggtaaatacagacatatattctaaggagaaaacgatttctgtttccagtagtaaaagtggaccagtcatagccaagcgagaagttaaaaaggtcagtgtcgaaacttacctcatttgtttattttcagatctaataagcgttactctgagcacaggagtggaagccttctcttaatattttatgtcatacatgtgaaataggataagtttcataactttcactttgtttctgtgtattatgtagcctttatagcggttactcacttgactttttcttttttcttttttctttttttttttttttttttttttttttttgagacagagtctcgccccgtcacccaggctggagtacagtggtgcgatctcagctgactgcaagctccacctcccgggttcacaccattctcctgcctcagcctcctgagtcgctgggattacaagcacccgctaccacacctggcttattttttgtatttttagtggagacggtgtttcactgtgttagccaggatggtctcgatctcctgacctcatgatccgcctgccttggcctcccagagtgct

SEQ ID NO: 65328 - DNA, 1104 bp, Homo sapiens
acccaggttggaatgcagtagcgtgatctcggctcactgcaatccccgcctcccagattcaagcaattctagtgcctcagcctcccaagtagctgagattacaggtgcccaccaccacatccagctaatttttgtatttttagtagagacaagttttcaccatattggccaggctggttttgaacttctgacctcaggtgatccgcccgccttggccgcccagaatgctgggattacaggcgtgagccaccgtgcccagcctaattttttttatttttagtagagggagatttcaccatgttggccagcctggtctcgaattcctgacctcaagtgatccacctgtctcagcctcccaaagtgctggaactgtaggtgtgagccactgtgcccggctcatgtagaatttttaaaaagtgattgccatttccttaagtttcttgtttttgatataattactgcatttgttactcttttcatactgaaggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggaggtaaacttgatcctttgatttttaaagaaaagtaaaatccttaaagggattctaggcattcacttttctggttttttgtttgtttgtttgtttgtttgttttgagatggaatctcgctctgtcgcccaggctggagtgcactggcgcgatcttggctcgctccaacctccacctcctgggttcagacagttctcctccctcagcctcctgagtaactgggactacaggcgcacactgccatgcctggctaatttctcttttgtattttagtagagacgtggtttcactgtgttgcccaaggctggtctcgaactcctgagcttaggaaatcagcctgccttggcctcccacagtgctaggattacaggtgtgagccatcgctcccggctggcattcagttttctaaagatgaaagcccagagactttaac

SEQ ID NO: 65329 - DNA, 1099 bp, Homo sapiens
tgagtagctgggattacaggtgcacgccatcacacctggctaatttttgcattttttttttttttagtaaagatgggatttcaccatgttggtcaagctagtctcaaactcctgacctcgtgatctgcccgcctcggcctcccaaagtgctgggattacaggcgtgagccactgcgcccggccatgaattactttctctgttgcaattcccctataatcccagcactttgggagactgaggtgggcagatcacgtgaggttgggagttcaagaccagtctgcccaacatggaaaaaccttgtctctactaaaaatacaaaattagccgggcgtggtggcgcatgcttgtaatcccagctcctcgggaggctgaggcagagaatcacttgaacccgggaggcggaaggtgcagtgagtggagatcacgccactgcactccagaatgggtaacaagagtgaaactccgtctgaaaaaaaaaaaaaagcagactcaaagctgtgagaaaagtgacgtggaagtatgggggcatgctctgttctggtcgggactcaaaatgaggagcgtagaatacaatggacagaagagctgggctgggttgagcatgggttctaggccttgaacctaaacaagcacaggaaaagttggtcagcatcttgtgaactgccaccatggaaaccactgcattgatcagcaacacaaatggggggagtgggggtttctggaatagggctagtctctcactacttcttgccctccagagatggctacaatagggtttggtctcattgtcgcccaggctggagtgcagtggcatgctcaaggctcactgcaacctctacctcccagattcaagccatctttccgcctcagcccctctagtagctgggactacaggtacgcaccactgcgaccagctaatttttttttttttttgaaagatgtggttttgccacgttggtcttgaactcctgatctcaagtgatccgcctgcctcagcttcccaaagtgctgagattataggagttagccaccacgcctggcccttgatgttttcatactatgggttatgatccattagtcactcatgaaaacatcagg

SEQ ID NO: 65330 - DNA, 2167 bp, Homo sapiens
ttccttgagtcattatagtgatggcttattttgtttaccagtgagatagagtgcctcctgagcctatctaaaatattagttctatatttcacttggcagctaataactagttatatcagatgcagcatttctggttctgagaaaagagttagtgatccttttattagaaatactggtacgatttccatacttagaaaattcattcagaaaatgagactgaaatgttgtatataacagagaggcctagttttatcagtagagtcacagaggagactcctataacaaatggtgattttatgaagcagagtggctaacatctttataaggtggaatctacttggtgaagtcaaagttattaataacttcaatatttttccattgttgagctgttatgtaatgttttccttcttttctcttatagctgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtggtactgttgttgatagatactgaggtgtgtgtttcttttttttttttttttttttttttcattttagctctactatgattaatacgaggcatttggtgcaattagggactgggagagcccctgtcctcccagctctctaaacctgtggctttcaacgacagtaagaaagacattttgacctacatacacatatataaccaaaagaaaagtttcacaaaatttgtatcctcacctacagtgtatcctgatgttttcatgagtgactaatggatcataacccatagtatgaaaacatcaagggccaggcgtggtggctaactcctataatctcagcactttgggaagctgaggcaggcggatcacttgagatcaggagttcaagaccaacgtggcaaaaccacatctttcaaaaaaaaaaaaaaattagctggtcgcagtggtgcgtacctgtagtcccagctactagaggggctgaggcggaaagatggcttgaatctgggaggtagaggttgcagtgagccttgagcatgccactgcactccagcctgggcgacaatgagaccaaaccctattgtagccatctctggagggcaagaagtagtgagagactagccctattccagaaacccccactccccccatttgtgttgctg

SEQ ID NO: 65331 - DNA, 1024 bp, Homo sapiens
ggactttgggagacctaggcgggcggatcatgaggtcaggagatcaagaccatcctggctaacacagtgaaaccccgtctctactaaatatacaaaaaattagccaggcatggtggcatgggcctgtagtcccagctactcaggaggctgagacaggagaatcacttgaacctgggaggcagaggttgcagtgagctgagattgcaccactgcactgcagcctgggtgacagagcaagactccatctcaaaaaaaaagaaaagaaaaaagaatttttcatcattaattttatcttggaagtaaattgtctcttaatgcttactcatgttcttgtaggtatccagttgtgtaacttgaggaagagatgagccaatattccagtagtgaattcagcaaaagactagagatgaagttgtcatctatctctctagttttagtatcaaattaaagtggtacgtttcagcgttcagttttcaagtgtggaaccattttcattccagatgcatcaaattgcaatttggaggagaggcagcacaagcagaagcctgggcctggctagcagccaatcagctctcatctgtcatcactactaaggagtctaggtacaaccctggtgttcaaccctgggtagttttgcctttctaaaagctgtaactgtctttctctgactaaattgtcctacatagatcatttcacttttttctttctttttggctaagtttttataggggctggaaagtttataattaaggtgacatcatgtcatttattgtccaaactaggatgtctttgcctatgaaatgtctccttctccatatccccctcctcaaagacttactgtttcatatcaggaaagggtactcttacaggcaaaaatctgtatttacttgtttcggagtgttatcctccttttttcccccatttcttccactgagcagtcactgcatggtttcatcacagtgtcctcttatatcttgtctccagctgctgttcagcagtctgtcacccatcagcccccatcatc

SEQ ID NO: 65332 - DNA, 1065 bp, Homo sapiens
ttttctccttccttcatgcatttggaaattagattgaatgttacttaatgttcagtggaaattgacaggttgcgttaatctgatggatacttctttgtattttgggagttcaaaatatttttctttgatgtatagcaaatcgacaaattgaaatcctggaactggaagatctggagaaagagtgttccttggctcgcatccgcctcactttggctcagcatgatccatcagcggttgcagttgctggtaggaattcaagagtttaaagcctctgacttgtcagcaccacgagcacattttaggtccaggcagtgtatgtagcatggtagatgggtataaagcctgggttattactcagagatactcatcaacaaaacaaaatctttggtttcatttgtgtataccttggctacacgaaataatctttttccattttcacaggaagttcatcagcagaggaaatggtcactctcttggttcaggcgggcctctttgacactgccatatcactctgtcagacttttaagcttcccttaacgccagtctttgaagggcttgccttcaagtatgtataaaattatttttttatagtcttttctaatgcaaatatattatcctcttgctcagtgtgaaacagtcgtcataagccaagtagcccatatatcatttatgatttgaagaagtgttttgtttaatccatccaagcattcttaaaaagaatttcaggctgagcgcagtggctcacgcctgtaatcccagcactttgggaggccgaggcgggcggatcacgaggccaggagatcaagaccatcctggctaacaaggtgaaaccccgtctctactaaaaataatacaaaaaaaattagtcgggcgtggtggcgggcgcctgtagtcccagctactcgggaggctgaggcaggagaatggcgtgaacctgggaggcagagcttgcaatgagccgagatcgcgccactgcactccagcctgggcgacagagcgagactctgtctcaaaaaaaagaagaagaatttcttggccaggcacagtggctcacatctgtaatcc

SEQ ID NO: 65333 - DNA, 1038 bp, Homo sapiens
ctacaactacaggcgcatgccaccacacgcagctaatttttaaaaaaatttttttgtagagatgggggtcttgccatattgcccaggctggccttgagcaatcctgctgcttcagcctcccagagtactgggattggaggtgtgagccaccatgccggcctacttaacctttctcaataattttaaaccataattgagtttgaagtacattacaatattaattttaatggaaatttcttctatttctcgttaggttttacgactactagatgtcattggtttgcctgaactggttattcagttggctacatcagccataactgaagcaggtgatgactggaaaagtcaggtaagaattggctgcaatttggttgttttctttaaggtttgttgtgggtgtggtatgttcatttctattgctctttttgatatttgatctacatttgatatttaggctactctaaggacatgtattttcaaacatcatttggatttgggtcacaatagccaagcatatgaagccttaacccaaattcctgattccagcaggtaatttcatggccttttttagagaagacaatttaccaactctgtttaacctactaagatagtttgccctcatattcctttctttccttctaggcaattagattgtttacggcagttggtggtagttctttgtgaacgctcacagctacaggatcttgtagagtttccctatgtgaatctgcataatgaggtaattttacttatccagtgatggctttcaacaagtatggtggttgccatgattgctactgacttagttatctgattgcttccccttccctaggttgtgggaataattgagtcacgtgctagagctgtggaccttatgactcacaattactatgaacttctgtatgcctttcacatctatcgccacaattaccgcaagggtgagcaatgtaaccagacagtatcttgcagacagccttattagtttaatcatgttttaccaaaatattgtgtgttggacttaggtaatttttaatatgt

SEQ ID NO: 65334 - DNA, 1022 bp, Homo sapiens
gctagactgcagtggcatgatcttagctcactgcaacctccgcccaccaggttcaggcgattctgctgcctcagcctcctgagtagctgggattacaggtgcacgccaccacgcccggctaatttttgtgtttttagtagatatggagtttcaccgtgttggtcaggctggtctcaaactcctcacctcgtgatccacccgcctcagcctcccgaagtgctgggattacaggcgtgagccaccccacccggccaatgtttactttttaattggtagcacttaagtgtgagatacatttttaaaaatatgaatgcatcacatagaattcatatgtgtcagaaactatacatagagtagaccatgttaagtaatcttgtttcttttttggctttcccttacatgtgaacccctgattcatagcacctagaatttgaatgatctgttacaagtcattttatattttatttctccaggctctggaatgtttttgtcaggcagcatctgaagtaggcaaagaggaattcttggatcgcttgattcgctcagaggatggggagatcgtgtctacccccaggctgcagtattatgacaaggtacatcatgtcttggtttggccttataccaccctgtgtaaaaacacatctgaaatacattgctttgctatttttggagaaaaatactataaaaattcagttgctccctgaacttccaaatttaaaaaaaatgaatttgcctagagaaattaaagaaacatggccgggcacggtggctcatgactgtaatcccagcactttgggaggccaaagcaggcagatcacctgaggtcaggagtttgagaccagcctggccaacatgccaaaaccctgcctctactaaaaatacaaaaattagcctggcgtggtggcgggtgcctgtaatcccacctacttgggaggctgaggcaggagaatcacttgaactttgaggtggaggttgtagtgagccaagatcgtgccactgcactctagcctgggtgacagagc

SEQ ID NO: 65335 - DNA, 1144 bp, Homo sapiens
gtactggaattaacagactctggtgctttaatggcaaataggtttggtaaggagtggactatgtacacatttcattttaaactggggatttattgcatattcattaaagtggtcttttgccacctttgccatagaaaggttggctaggctctttgctttcagaaggcatgagtaagctgtggcctgagatctccgtttgtggcatggggtctgtgaaactgtagtaccagatcaggcatatgttaaggatatggtatatatatgtgtgtgtgtgtgtgtgtgtgtgtgtgtgtgtgtgtgtgtgtgtgtgtgtgtgtgtgtgtgtatagctgctttcccattctgttttgatgctccagtgattaacaaaatcatttaaaaatttattcgttcatggtaacttttgtaatcttagtcaacagatatttaaaagtatccctcatgtttgaaaaccattattctggagaatttattttgtattgttctggtataaaagttgaaatcctggggctaattgtatttatcatgaagaatttctagggaaggcacttaagtcttgtgagatcagtgaaaagaaatgactataactttgatgtgaatggtgtttttattgcatttttatagtgcctcacaatttacagactacttttatttatattgccactggatatatacccgtgatacattttctgttttgaagtgctaaattgtttgttacaagcataaaatgaattgatagactattttaattgaaaattgataattaccactacacaaaactgtcataactttttctttttaagtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttgtatccttttatttagaagccagtgaaaagctctcttctggccgggcatgttggctcacacctgtaatcccagcactttgggaggtggaggcaggtttatcacttatggccagaagttcgagaccagcctggccaacatggtgaaaccccacctctactaaaaatacaaaaattagtcagg

SEQ ID NO: 65336 - DNA, 1220 bp, Homo sapiens
aatcaatagattgtcattggcttaagacataaatgttaactttctcttatttgtagatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtgtaaggagaattagggtaaagtgcatttcctaatggaaattcagcatttttagcgccaaagttggaattttaatgtatgttccagagcgtacagaatagtagcttaaagtcaaactgatgcgccatgattctaagtacatatttctacttttaacagaaaatttaacacgacttcaagtctagaaatagacttataaaatatgctttaacaattaaccgagctaaaaattctaaaaagcaaaagtgttcttctcatgtttgttttgtgtgttgtttatgaaaaactgagaggaaatttgctatgcatagggactgtatcttatatgccagagtgattatcttcattcctttatctggttctcttgtttcataatgtatttagcttataggacatatagaacttgccttacgtattctcggtagtaataagagttttgtaattgtccttatagagaaaatgtgatggaggatatttgtagtaaactgcaagagattaggaacccaatccatgcaattggactacttatacgggaaatggattatgaaacagaagtggaaatggaaaagggattcaatccaggtaaatgacagaacaacaaatgtgcctctttgattaaaacaatgatgcattcaactccatttttcttctttttacagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtaagtactgcttgagggaaaacttgtaaaatctaaaacctgttataggcctacaagcacttaggagcaaaatgtcagccctactagcacagatacttttgtcttggttcactgctttattctcccaagcttggccttatgagatgctctataaatatttttgaattaagaatgaataag

SEQ ID NO: 65337 - DNA, 2370 bp, Homo sapiens
gcctgtgaaccaagtggagatgaattctgagcggttggtcaggattgtatcacagtttgcataagaaaatggacaggtaccacgaatatgatcaaggaaaattctgcccatttttatggctgaagttctaaaaaccctgtgcagcagtgagatctgtggctgccagtggctccttgctcctcagctgggattaataaacaagctccttttggggagggtgggggaaaaaagaaaaaaataaataaacaagctccttttgaggagtaataatgaaagttagaatagcttagtatagaaactaaccctgatatgttcaatttgcgaaggtatttttatattaaaatatttatttttgtaatatttttgcacatacatgtaagcgcatgtataaaattgctattctgtgtgtgtgtgtgtatatgtgtgcgcatgcatgctattgcaggttaagaagtaatagaaacaggaaataaccgcaattattaaggtcagttttgtttgatgctgtagtatatatggaggccacattccactacaagcaatggccggggtatggtgttaatttttattatagtagagttaattgcataaaatattgtcctaaataaatggcctatcaagtttggaaatgtctctatgtaacagaatcacagtgaaatttggattttgttatgctgttttttataaatgtacataatgtgatttggcatgcaaaagtggtccaaatctgtttatccaaaattttcaaatttggtgagttcacttggacactgttctcatatatttcagtagaacagtcagtgagaaaagcataaacttttcaaacaaatgtctctttttcaacaggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtaagaatgggaactgagcatggatttaactttaaacaaggaatgttaacattgaaacagttcaacctcgtcatccaatgcagggattgcatctctactgccccggaactggtcattcattattgcttgcctaatgagtccctaatgctttacttttatacagtggataaggaactataaagcatattggagcacggaaaaacaaatagacaagtataagacagcctattctaaatcttgtagtagagatgggttgcctaattgtctgccctgagatggaggcattataacattataattaaattaattgaaacaaagacattaaataccctgcaccaagttgccactgtgtcttgcctggattattgtattagctttctatatatctccccagatctgtcttaaccctcttcagacacttctcaggtggactgatatatttaaaacccaagggccaggcgctgtggctcacgtctataatcccagcactgtgggaggccaaggcaggtgggtcacctgaggttgggagttggagatcaacctgaccaacatggagaaaccccgtctctactaaaaatacaaaattagctgggcatggtggcccatgcctgtaatcccagctactcgggaggctgaggcaagagaatcgcttgaacccaagaggtggaggttgcgataagccaagatcgtgccattgcactccagcctgggcaacaagagcgaaactccatctcaaaaagaaaaacccaagttgggtcatgtcactgcactgtgtaaa

SEQ ID NO: 65338 - DNA, 1050 bp, Homo sapiens
gccaaactcccctggaaggtagggtttggtgtataaattttcgtcgctgtacccaaagtgctattctagaagcggtaattgacacttagggaaagagaaagattgttttttcagttcgtatcagaatcgggaaaactgagacacagagttctagaagagatacctctccccctccccccccccacccccacacacacatacaccaagcaacaccagaagcagaggaaatgtagcttaggggaataaagcccataagaccaattttaaacatgaacccgttatgtttttatagtgctttacagcttccttcattgtacaaatacgttcgagcttcaatatgtcaggcattgtgctaggtaccaggacgaaatgaacaaaactgcaattttcatcatgcaagacgttgtagcaatgtcagaatagatgtagacccacttttcatggggaaattttttggaggaaaacttgccctagaggaaaaatatacgggttatgagaggctaataagaggaccaaatataattagtggggcagggaaaggctttaaggaattcacagttaccctgagatctaaaggacacgaggttagccaggcatggggagtggacagagaggagtccagcaagtaggatcaccatatgcaaaggtcatgaagtggaaagaatgtggcgggtttggaactgaccaaagatctgtgtggcttaagtgcagtgggtaaaacagaaagtgatgtgagatactgaggctggagaggtaggcaggactcggaccatgagggacccttaggccatttttaaggatttttggattttatcctaagtacattgagtaataattgaaagatttttaaagagttactaacatcaaaattgcatttttggatgggaacagttaacactagggattccaaaaggagggagggaggggagcaaaggttggaaaacctatcggatactgtgttcacaacttgggcggcaggatcatcagaagcccaaacctcatgtatataggaatatacacacaatatactcatgtaacaaacctgcacat

SEQ ID NO: 65339 - DNA, 1744 bp, Homo sapiens
tgcacctgcccgagcgtacccccccggggggttccggggaagggggcgggggtccggatccccggatccccggaaggcgacttgcggggaccccggccggcctcgcacgccggcgatcgatcccttttccggctgcccaggatcgggggagagaggcgggatccgggtgccgcggtgcccgagcctcccggggaaagcctccgcgcgggctccaggccgtccctggcccggctcttcccggcgctgggcacatctggcgggcacgggcccggcttcctagccggaggcggccggagggggcgtgtttgcggaggtctggggacgcagagccgggcggcctggctgagcctttgccgacagacctccgacccggcctgcaggggcccgaggggcggcgggggcgacagggcagggccaggcgctgggcagtggggccctgggcgaggcgcgggactccgggccgagggccctgttcctggggaaagttcccaggccggggaaaaggtggccgcacgctggcttttctcaaggcagccggccctcttggcgtcgtgcttgatttcatgggtgtttaattcgtgctttgtgggcgctggctccccctccccaccccaccctcaccctcttttctggcttcacttttcagataatgctgtccctggcgttttggtgaccgacctttccccttcctggcatttccataggggctgaggcagagcagctgaaggggcattcccatttcacagatggggaactgagggagagaagtgaaatagcggagcacccagcccgtgccatgggagctgagccagcgggcacgtcctcttagcctctggagcctgttggggtttgaacccgcaggggaagcggtctagggctgccttgctgtgcgtttctgcaaatgaccatcttgcttgttttatacagacaccatctctgaggaaatgagttattggctggggatggaacctggtttcagggaaaacttctccagcgcgaatacaggagagagcagaagcatcaccctggggcagcaatgccgcctagcaggctgtaggagaagggggctggggcctgggggctgcgtgaccctcggcacccaagggtctctcctcgcagtttccccagcaggttctgcacaggctctcctgggggccagaaggcaatgtgacctcctgcagagaacctgggagtagatgtcaggagactggctccagggccgggccacagggctggacttgctcttcaggcttctctaccctcagttaaccgcatctgtagaatgagtatagcaccctctgcccaatggaattgtttgaggggcttccactggccaatgtctaaaagaactttgtaaatattaagggtttccacatgggattctcattattaaggtacagtgcctgtgggggctgtcttctccctgtccatgtaaggaaattcagggaagcagtgtctgaagttaaaaaagccttgtatttgaagatttcttgtatcaaaagtttatgctaaaacaaaaaccacaaaaaacagaaaacccccaaacttaaagcttcatttatttttaaatgtataatatatgtaattttttttttgcttcagcaaaaaaattttaaattatatatatataaaatttatttatttttgctccagccatagtggttgctagctgtgttctcaatcagcaaaaagtttcttgggtaaatttattgcttgctcaatccttccttgtatttcattagca

SEQ ID NO: 65340 - DNA, 1003 bp, Homo sapiens
atttagatatttccttcctctatggtttgttctgtagaacctcaaaaggactctcttatttcttttttttttggacacattatgaaataggaagtctaaaaggctcccagaagaagcatcttcaaaatccacattcagcagttcattttgataatggatatttcagggaatcagtgcatttttgagctggaccagactttcaagacagctgaaacccctcagagctcttagatgaggatattgatgtccagagaagacagggagcaggctgaggtcacccagcaaggtattagagaagacaagatgggaacctgggtcaccggcctgggcctcatattttcaaagtgctatttttttttttcccgtgttttcactttgatcttacttttaatgatagggacgtatcactgtgtcttctcaaaatggtgggtgtgaatggaatttttcaaagttgaatcaatttgagatatttctgaagtttgtttaggaaacaagtatgtgactaccttcctaagagctgactggttttttgaggcctggattgtgtgtgtatgtgcttatgtgtgtgttataaaatggaatcaactataccaggttaaacaaatggacaagtcatggaaaagacacagctctgtttggacattaataagggcgggtgtggaagctggaaagctgagatgccggaaggctcagtgcttagtaggcccggaaaagcaatttttgaactggcatctcattccccttttctaagacaggaaggacggtcagagatgattccaacatgaggactttgctagttgcagtgtctgactcctcccattctcatagcagttttgcacagtagttttggtttgtgtgtatgttttaggcaatgtgacaaagcagttttcctcctgcctccttgagaaatttaatcctgacaggttctttaagaaatcagcttgatgtgggctgattttaaaagaataaatgaaaaaaaaaagctggtgactgatagctgttt

SEQ ID NO: 65341 - DNA, 1010 bp, Homo sapiens
ttattgttttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtctgaaaggtgaaaaattgtatcttgttttttttttttttttttttttttttgagacggagtcttgctctgttgcccaggctggagtgcagtggcgctgggctcactgcaagctccgcctcccaggttcatgccattctcctgcctcagcctcccgagtagctgggactacaggcgcccgccaccaagcccagctaattttttgtatttttagtagagacgaggtttcaccgtgttagccaggatggtctcgatctcctgaccttgtgatccgcccgcctcggcctcccaaagtgctgggattacaggtgtgagccaccgcgcctggccgtatcttgttatttttatttatatctttaattttgagttagttgagttttttggtcatttgcctctgcttcttcttctttttttgttttctttttttttttgagacagagttttgctcttgttgttcaggctggagtgcaatggcgtgatcttggctcactgcaacct

SEQ ID NO: 65342 - DNA, 1024 bp, Homo sapiens
gagtagctgggattacaggcgtgtgccaccacgcccagctaattttttgtatttttagtagagatgggacttgttccttaggaaccatgttggccaggctggtcttgaactcctgatctcaggtgacccacctgcctcggcctcccaaagtgctgagattacaggcgtgagccactgtgccaggccccattttttgttttttggttaactccctgttcattaaaaaaaaaaaatctatatctatagatagatagatatagatataatctttgttatcaatttgtataagctctttggaaattagtccttcgattgtcatttgtattgcaaacacattccccctcccccatgccaattattttagatgtagcacttgttccttaggaactcagagataaataagaccctagggtggtgaagagagcatagaatttggaacaagactcctttgttggagtcttggctctaccacctcattagctgtgtgatcttgggcaggtatcttgacctttctgatccttgctcttcatattccaaaaatgctaataataggagtacctctgacacagggtagttggagaagctaagtgtgatcatattatgctaaaattccttgtaaatggctatggaaacataaacacagcattttataaaataccacgaggtattccatttactgaagagttacatcagaagagtatttctgattgtgccactgcactccagcctgggcgacagactgagattccatctcaaaaaacaaacaaacaaaaaactagccagtcatttataagaatgagttacagctataggtgcaggcggtaaatactctccaagatatctaaataaattaaaaggctatgtagagaacaatgtatatataatgttacctttaaagtgacaaaaaaaggtgaatatagatacttgtgtatcagaagagagaggtattccatttactgaagagttagggcaaagaccataatattgtaattatcaataattatgaattgtcaaaattatgtca

SEQ ID NO: 65343 - DNA, 1135 bp, Homo sapiens
aacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttagcatgaaaaaatccctcaacagatattggctgctattttattatcttattgtgctgagacactggcataatttacaattcaaaaattaaatttttttaatcttatactgtagtttacaaggccctttcacatatatgagcttgttcaatcctcacagcgtccttgagtttgtcattgttattgccatttaaaaaggtatgactcagagtggctgtaattgacttgtccaattcaggtttcatctgtcttttgcagaataataatcatgtacgttcatagtataggccacctctttttttttttgttttttaagacatagtctcgccctgtcacccaggctggagtgcagtggtgcgatctcagctcactgtaacctccgccttctgggttcaagcgattcttgtgcctcagcctcctgagtagctggcattacaggagcccgcccaccatgcctagctaatttttgtatttttagtagagacagggtttcaccatgttggccaggctggtctggaactcctgaccttgtgatctgcct

SEQ ID NO: 65344 - DNA, 1036 bp, Homo sapiens
gttcacacataattattaggttgaaccatataaagttactgtttttggtcctgtgaatattagtatttatatatggttccaatctgatatgttccagaaaatacacacttaagtaaagtttggaaaaccaaatcatagacttacatactgtaaggcggtgtatttgaaactgggatgtaaaatcaatttagtgagttatgacctgcattaaaaaaatggtagaatatcagagtttgctggtaagtattgtaaaaataccagagtttgctggtgagtattgtccatttcagttatatatgtgcgcacgtgtgtgtggtgtgtatgtgtgtatactaaattgcatataaaatgaatttcttatcatgggttcacctgttgccagaaaacactggaagtcactgttccagggaatggaatggtggaagatgcctggtgggggatggaggtggattctgtttccagacacagtaaaaaaaaccagtataaagtccccaattatgcattgtcagtgtctctatgtgtagctggaaaccattcctgcagcaggtaagcaggaagaaccaaattgtcgagaggcacttcaggaagggaagtgggccgactgaaagctttggaggcctgcctttaagtagctgcttttctggaaacttcagggtgaccagcctagtgaacaagctatgggtcagcgttgtgtgttcctttggtaaatggatttggtagagagctaacactactgcatttgtagtttatttgtttgtttgttttctttttgagacgagtctcactctgtcacccaggctggagtgcagtgttgcgatctcggctccctgcagcctccacctcctgggtttaagtgatcctcctgcctcagcctcctgagaagctgggattacagatgtgcaccaccacacccagctagtttttgtatttttagtagagacggggtttcatcatgttggccaggctggtgttgaactcccgacctcaagtgatcctcccatcttggcctcccaaagtgctggggctatagggctga

SEQ ID NO: 65345 - DNA, 1336 bp, Homo sapiens
ggtgaaaccctgtctctactaaaatacaaaaaattagtggtggtgcacgcttgtggtcccagctgtttgggaggctgaggcatgagcatcacttgagccctggaggtggaggttgcttgagtcctggaggcggagtgagccaagattgcgccactgcacttcagcttgggctgcagggtgagattctgtctcaaaaaaataaataaataaataaataaaataaaaaaacaattgaggtggatgtctccctaggggtaccccaggaagccacaggataaaaagcaggcatcttgctggagggtctctgttgctcagtagaaattattttgtaatgttttttgaaaaccacaaacatggacatattatggactggataccacatttgcatcaggatttttttttcaaccagtacagtacataacaaagaaatctctaccctgcagaccctctgggggtgtgagagcgctccttgctattctcagggtcaatgtatggcaatctgtgaaggactgacaatatattgcaaacgtttccccctgccagtaaatattcttcttttgtataactgttagctgttgcatccattccattatgtggaggtaccttaatttatctaataagtcctgtgattagtcttatagtttgttttcaaaattttttttgtcacgataggccctattcagttgactttgtgatcagctctgaacatataatctggtgattgccttaagataaattgaataataaaagtaacaatagtagctaccatcggttgaatatttatcatcaactgttgtgagcacgttgtacatattaactcatttaatcctatgacgtaggtatagggaaggaaactgaggctcagaacctctgccagctagttgtgggcttcctttgaggcacaggggagctgaatgggagggtctacataggacagggcgtgtctgagtccaggaaggacagctggacttgggccagtctcacaggtgggaaggctgtctttctgtgaggatgggtgacttgttgacctttgatcctcagagccctgatgcagcaggagtgaaatgattcccagagccacagaaaacaagagtatctttgtcttggattttagatcctggagctatcaggtggtaagaaggctgtctgacccagattaagtgatgtcatggtatcatgttggggtgtgggccttcctgttgtaaattatttgggatttcatagagatcgaagtcatgtgtggatgacatgacttcaggatgtcccattagaagaggaacgtgggggtcaggcgtggtggctcacgccagtagtcccagcactttgggaggctgag

SEQ ID NO: 65346 - DNA, 1036 bp, Homo sapiens
acgacatctcctgactttggggctgcagagtgatgcagagcactggccagtgttgccatgcacccagggtgcagggagacctgtcttgcaggtgttcaaacaacttttgtcagcctcagtgtcagggacttttgttgcgtagagcagtcaccaaatcctatggtgagaagagaaatcgttggagatgggggtgcaggggtggaagctcttatttcagaagacctgttgtgaggtaagactcagaccctcagcttctatccggccacagagtttgggaccagcctttcgatgtcttttggaagatgcacatggaatgcttagcctttgctcttccctggaacctggcttaggctttgcacctatcccaccatgtggttggggtgagtgaggacaacttcttttcctccagaacatggtttctccatctcagccctattgacattttgggctggataactcgctgttttgggaggctgtcctgtgtgccccgtaggatgtcctgcagcctccctggcctctgcctgctaggagccagtagcgccccctcccccacagacaaaaatgtctccagatattggcagatgtcccctaaagggcaaactacccttgctgtaggtaatacttgctttgaagtactggtgtggatggcctatgccctggcagtcttactaggtgggactggctgtcctctcattctcatgggattggcctcatgctggtagctgacttcctccccgtgagaccgtaggtctaaactaacaaggtttacacatgtgacaaacatccaggttgccagggctcaaaagagggttcacatcgactcccttctcattcactgagtcctttttcgggagctttggccgagtttgtgctgcgtctgggcatctaggtgtcgagttcttccctagtgttttcagcctcggcttcctcctctgtaaaatgggagtaactgatacttttcctgtctgggtgggaaaggaaccccgtgctaatgtgattgatggtgtggtgctaagctctgctgcaagggatgtga

SEQ ID NO: 65347 - DNA, 1084 bp, Homo sapiens
catatcccaagtacattgatttgatctttacaaattgtgtgaatgtattaaattaccacatgtgctccaaaactgtgttcttgaaaaaattatcacgcccattttagagatgaggcacagagaggtggagggacttgcccagatccaggtatgtggctctcctgtaatctcgcttctattgctttgtgatcagcagcaacttagtagctttcaaagcttcaattttcttgtgtgccaaatggggctaataaataccttagaggattgtgatcaagattccgtgaaaaaatgtatgcagtgcccccggcaaggtgcctggcatacagaaagtgctctgtacgcaccagctgctgtcattattattgtttcaactaccagtgatcataaaggatgcctgctttgatgagcttttccaggaatatggactggtctgccctgatctacttgaataatctgtctcaggccctattcggtaaatacatgtaggaggtgcagctgccagggaagggagggatgttacctggagaggacagagtctgaagttcaggaaatacagcaagagccttcctcagggatgaaacatgtgatcttatggtctgactagcctcaagccagctgagctcattgccatgcaacttggtagttaatgattgctagtaagaagtttaaaaggatcatcccctcaaagaatgtcagagttggaaaagaccttagggacattaggctaggaaagacaatgtcctagtgagtgactgcttgggccctgtatagaagggattctcagatcacttgggatgtcctggctcagcaggaggctaaggtgggatcaattagtgatgtctgccatggccacaagagaggcaaggagtggcacatgtgctgtttatttgctgtctttggctgcagctgaggacactgaggcccaagacttgcttgcttactggacgatcacccaagtcattaaaccacaaaaatctcttttggaaggaatctgttaagaatgtctgattataagagttgcacctttgagcaagtattttttgcttgatagtcttcagtgaggaggaactgtcttcaaagagca

SEQ ID NO: 65348 - DNA, 2454 bp, Homo sapiens
acattaaaagaaatgtagaaactagagaaaggaaaaaaaaaagccctttatcccccccatcacaaaactattataatttcaaaatagttacaagtacaatgtattccaagtggcttcttatttaagataattatattcacagagcagggaccgtttcaggtcctttaatgctgaaaggctaaataaagagaactttttattttttccatgttaatacatggatgatattaaccatgatgtttaatagctacagaatactgcatgaaatggatgtactataattcatttagcctttttcgtatttagagatttaagcagtagccaatttttcaccattacaagtggtgcaaggaccaatatcttcatgaatacagcattttctgtaaagcagaaattctttcttcaggattaatttccagatatctttctggtattagacacataccacttgcctaataacgttccaaaaggaattcattgtttacattgctattagaacatatgagattgcctgtttcattatgtccgtcccagcactgggtattatcattaaaaaaaaaagattttaaatttatttattgagttatttacttgagacagagttttgcttgtctcccaggctggagtgctgtggcacgatcttggttcactgcaacgtccgcctcccaggttcaagcgattctcctgcctcagccttccaaatagctgggattataggcacccaccaccatgcccagctaatttttgtatttgtagtaaagatggggtttcatcatgatggccaggctggtctcgaactcctgaccacagatgatccacccaccttggctcctcaaagtgttgggattacaggcgtgagccaccgtgcccagccaatattttaaatttaatgtttacatttgcacacatgccaattgggcttcatggtggctgcctcacaccactttttgtccgtgtgtgagactcacatagaggctgttttctgtgatccttttttaaaaaataattacatttttttaatgctcagggaaaatgtcaaataattgtttatgttttgtactgaaatctgcactggtctgatggtacccagaaaaactcttaactgtagccagaaaccagctgagcctagttgtatgcaacctgactgcaaaggtcatcaggtgctctcattttatttttagagctatattttagctctaacgtgattgttgggtgaacacttgcagaatgaaatatgactgacacctaccagctgtctacacattcctggttatatcttaggaaggcagtgtgtgctagcaccttgggaagagaatgttgagttcaaatcctagttttgccccttgcaccaataccttgatcagattcctcccctgcgtcctccctaccctttcttcaacttcacaccttagtttctttacttgtaaattgggttgatagtgggctgctgtcagaattaaggacatcgttttgtcaaggattttgcatacaggaagtcatggtgacagctgttgttactgttgtcctgaggagtggggacaggagaggaggaaaacaggctggtccaggtgtctttccttaaaggaggctccagcttagttggggagatagatgggctggtcagagtttcaagtcataggcagtgcaggcctcaaaggaacagccaggacttgagacaagaatcaggccaagtgagtaactgttgctgctgtggcagtgaatgttagcagcccaggcctgcaggggggaagactcatttggggtacagtgagaggtcttgctgggcaaatgcagggtgtttgcggcaaggtaggctggggctggacttggaggatgcctgcgtgatttagattctatcttgtagagaatgaggtatcatggaaggattttcttttcatgttgtaaatattaatcattttattgttttgtatttttgatggcaatataaaaataccagctttgttgagatataatttacatacagtaaaattcatccatttagaaagtatacagttcaaagctgggcgcagtggctcatgcctgtaatctcagcactttgggaggctgaggtgggtggatcacttgaggtcaggagttcaagatcagcatggccaacatgatgaaaccccgtctctactaaaaatacaaaaattagccaggcatggtggtgggtgcctctaatcccacctgcttgcgaggctgaggctggagaatcacttgaacctgggaggtggaggttgcagtgagcagagatcatgccactgcactccagcctggacgacagagtgagactctatcttaaaaaaaaaaaaagcatacagttcagttgtttttagtatattcagaattgtgcaaccatcactgctgtctagttccagaatattttcgttactcacaaaagaaaccccatgcccacgagtgctcactcctgatttctccctcccccacctcctg

SEQ ID NO: 65349 - DNA, 1078 bp, Homo sapiens
gttcaagcgattctcctgcctcagtctcccaagtagctgagattacaggcatgcgccaccacgcccggctaatttttgtatttttcatagaggtggggtttcaccatgttggccaggctgatctagaactcctgatctcaggtgatccacccacctcagcttcccaaagtgctaggattacagtcgtgagccaccatgcctggccacaccccggtttattgcatttgcttctaatagagaaatcaacccagtaaacaaatgaattattgttagcaaaactggggggtgggttgggaaaggaaagtagttccttctataataaaacttgctgatatttcgttgaaagtcattgtcttactcatccttgtataagataagtcacacaatgagtggtatcagggttgcagggtttccccctgtgaggacacaatgggatgaaccgtgtgtgggatggtctgttaaagaaaaacaagaagccatgtgttggaaacaacctaagtattgagcggtggaggattgctgaaattgtggactactatgcagtcattaccaacgcactgaaaaaatgttccatgatatggcaggatgtttatgctataagaaatttaaagacgcgagcttcaaagtaaagtataaacctaatttggtcaaacaggctgggcgcagtggctcacgactgtaatcctagcactttgggaggccgaggcaggtgggtcgttggaggtcaggagttcgagaccatcctggccagtatggcgagaccccatctctactaaaaatacaaaaactagctgggtatggtggctcatgcctgtaatcccagctactcaggggtctgaggcagaaggatcacttgaacctgggaggcggagggtgtagcgagccgagattgtgccactgcactccagcctgggcaatagagcgagactctgtctcaaaaaaaaaatattggttaaagaaacaaacgttagacttgaagccgtgctttatatggatatgtggtgcactataatgtggtgcttaaaaagcaacttaggcagacctgggccaagtctgggctctgccacgtaactgctat

SEQ ID NO: 65350 - DNA, 1077 bp, Homo sapiens
tgattggtgttaataaggcagtagagagttgggggtactctggcagaccatgagaacctgccctgtttgaaggagaatgctgcctcctcttcctccttttaaaattcacacatatgatgctcactaagtgtctggcacccttttttctttttctttttggggcagagtcttgctctgttgcccaggctggagtgcagtagcacaaacacacctcacttactgcagcctcaaactccctggctttaagtgatcctcccacctcagccttccaagtatctgggaccacaggcacatgtcaccacacctggctaattaaaaacatttttttgtagaaatgaggtcttaccaggtcgcccaggctgatcgtgaactcctgggctcaggtgatcctcctgtcttggcctcccaaagtgctgacattataggtgtgagccactgtgccccgcctcagtttttaaaaatacttgcttaaggagagagcactgaaggaagatttagatctgctctgttgaagtgacagagtacggtggtttccatttatgcgtattttgtagttcggatggcttcttgtggggagtcctgtgagttcacacttgggggcatggtgtgggggacctgtgaagtgggtgttctggggtgagtgcgatgctagtcactgtcccagttttcttctcatttctttttttgtgagtgcttggctagtggcagccttgcagatcagctagttttgacccacatcctccctctaagtggtgctcattgaattgagccacagccccaaggtcatgttttcaaggttggcatttgggaggccttgtcagaaggtcttataccatattccagtcacccaaagtgctgcccgccatgcctgttcgttcagcaggatttccctgagcacctgctctgtgccaagccctatgctaagcaccaagggagtaaatatggagggcagtgtccccagagtccaggaactcgtgatctagtcggggaggagaggggtacctactctgtcttttacacagcaagtgtaacctctgaagaatgatgttccaggaggcaagagcaaccctggcggac

SEQ ID NO: 65351 - DNA, 1035 bp, Homo sapiens
ctggccccactgcgacagcctctccaggcctctgacttcactagaatctgcccctccaccccaccttcccccgaaccccacctcctttctctgagcctgagaggagttaattgtgttagagtgcactgagaaacctccaggaaggggccctagtccctgtgttgcctgttcagcaatcacatttgctcacgtctagaaagtacaatataatgactcaggttaaggggtgaaaaaatgtggtggacattttgccagggtactgtgttaactgttccaaggtatcaccctgtgtgagactcaggaacattcagtgttttggtttcccccctattgtactgaatgccggcagctttccccttctaattatttatcttaataatttgaggaaagttgatttgctttttaaaaactggcatccaagcgtaccctatcgcactgcacacagctgagagattaaggcagttctttagaattcctagtccgtgttgtgtacacagcgataggctggggtagtggttctgggtgcaactggggacaggcgaggaaccataaatttggcaggaaagatttgtgttggtaccctgttatatttgctttgcatcacatattgtttaaaaagagcgatattttcgttaaaggaaaaggaactgtgtatttgagataagaagtagaataaaatgaaatgaatagttgggtttcgtcctgtggccttcaaaatggcgttatttctgagatccctgtttctatgctgttccagtatttatacggaacttataaaatacaaagtataggcatgtcccgagatcctggcgaggctgtaatttatagtgttgttctttttcttttgttttacagagctgagtttggtgaaacttcaggaggttttagctagtggcgatccaaagacattaaatattgctttgtgggtacgtctccaccttgcgtcttacttggtgactgttcagtggtaggcaaatgtcagaacccagtatgcaaatgtggaagtggacagatttgagtcagttatctcagctg

SEQ ID NO: 65352 - DNA, 1066 bp, Homo sapiens
tcctgggatacaagtacctgttcatcttgttgacatctaatctgtatctgcgcatagtgaccaaggataagccactgagctgctccaaacgtgtgctatgggatggattaactgtgtgggtgtggaaatccctcagaatgatgagacagggagcagtggagaggaagacagtcgatcattgatcggtgagcctgtacttgagatctggcctggatagttgtgatggtaggtggtacccacaatgatggcccttcaggggatttgaagattgtgaaggaggaccaagaggagctgtttggaccacctgtgatccaaggcgggaactaggaagacacctaccggaagtctttgtggatcttttgggattggattggattagcagatacagagcgtttgacctatagtaaccagctgactgttcagcaaacgcttcacttcctaaaaggcttcttctttccaaggcaaactggggcatgtgaggaacaggaacttacaagagcttctagtctgaactccaggtgctgacactgttaacagttgctgagtggagtccttctcacttgggtggaaagtaacctgtaaacttggcccaagtctcccttttcctgtcctttggcccatgctgttctggtgctagatgttggctctggcctttgcactgaccatctcctcgagatggcacgtggggaggatgtgctgtgttgagaagaacttggctggataggcaaagacttgagctagaaaaagaacaagtggttattcatttggtgcttccctttaaccagggcctttttttttcttttattttaaaggaaacctttaagaaaggagggctctcaggcctttcttagaatttaggtctcagttttacatcatgggattctgtttttcttgggtttccattagaagattaaataacatagtggctatgaaagcatactatagatactaggaactgttgctttgattgtgttaaaggatacctctattccccaggtcctttattgattcatcttatttttatttgtataataaatcattagaatagtgcctggtgctctattgc

SEQ ID NO: 65353 - DNA, 1072 bp, Homo sapiens
tactttctttcttcttcttcttcttcttttttttttttttttgagacggagtctttccaggctggagtgcgatggtgcagtctcggcttactgcaacctccgcctcctgggttcaagcaattctgctgcctcagcctcctaagtagctgggattacaggcacctgtcaccatgcccggctaatttttgtaattttagtagagatggaatttcaccatattggccaggccggtctcaaactcttgacctcaagtgatctgcccgcctcggcctcccaaaatgttgagattacaggcgtgagccaccatgcccctcttacattcttttcttctgttcactacagccgtggagagctccgggttgtcctgcacatgtgcactgccctctcttttatggaccttttaggctggctgcaccctccgtctgtgtcaccctcctgctcctcctccacctggctagttcctgttggccacttttggaaattcatgccagtccagtccaccctgagtacatcctctttctgtgtcactgagctcactatgctgggttttatctatgtctccctcgcaactagatcattcacgtcttgaagttaggcatcatgcgttcttcatttctgtacctcccaactcaatgcttagcacccagcaggggctcaagactgtgtgtggaatgaaggattcgtgtgaaaatgcagggagatggaaggctgagcgtttctgttccttgaccattcccgggtttgactaataactctcatacacactgctactcattgaaggcctactgtgtgcatgcattccatgtgtgctatacagtttatttattgttaacccacgtagaattcccagacacatagcgttactacaaacttcatcacaaaaataaagaaaccagggccctgtttctctttgtttctcagatgagaagtctcaccagagttgactgtggcttctgagcattatgaggcacatgtaggatttaaagctgaaaggctttatccctgagactcagggaaatatgacaatcttttattttgttttaattaatattttttgagtcagcgtcttgct

SEQ ID NO: 65354 - DNA, 1044 bp, Homo sapiens
tctttattttatctcctcactgggagagtagatcccagacaggttttgggaaccacctggtgtccccaagcgagcagaggcagagttgggcttgaatctcctccttcattgcagtgctttctctgccctgatcccattgggtgaccctggactatgaatatggattatgagtgggccctgagagtgatcagagacatccttcaagattgaagctgctttggttcctgccacatggaactgagtgggagaatgtctcaattcaggatggtgggagtgtctctttgtccaagtaataaatggaaaccgtttgctcccgacttttgcagatatcaagggcttgtctttccagagtttggttttcttcccttctctccgcctcccttttctctgcccgcctgtggttttgagcccctcatggctatctgggcagtgatgggtggaagggagctggtgcagtattcgagtagagaagttctgctgcagtgagtgtggggcaagtttcccagacccttgttgggtcagggcaggtggttgtggcccagttgtttggccttctgcaggctgcacccctgccctgctgcctgccagtggggtgagggcctggccacctggtacttaacaagtttggttctacatgtgttcccgtgagtggaggacaaaatgaaaatacctcctgatcgtgttcaaccattagttgaacaaccatttgaaatggttattgcaaccatttcagagttttcttctgtttgtgatgtcatctgtgccttataaggggtgacttgctaccttatggagcacctaggttgaggcccgggttgagcacagttccatacgttagctcatttatttattttgagacaggatctcacttctgtggcccagggtggagtgcagtggtgcaatcacagatcactgtagccttgacttcccaggctcaggtgattctcccacctgagcctcccgagtagctgggactacagctgtgtaccactatgtctggctaattttttgtatttttagtagagatggggttttgccatgttg

SEQ ID NO: 65355 - DNA, 1093 bp, Homo sapiens
tccttttgttaacattttggtgaactcttgaacacattttttaaaaagttgagagttgctaacaagtaaagtgaagtcctgtgcctgttgtaatttggactgaggagtgtgagttgtcttggtctaaaggtcagagtgagggtctctgcctgctgcaggggtctcccggttagggttagggtgaaaagctttttaaaataaacctctcaaatttgttgtcaacattaacctatggtaattttttttttttttcttttttttgagacagggtcttactctgttgcccaggctggagtgcagtggtgggatctcagctcactgcaacctctgcctcccggttcaagcgatcttcctgcctcagccccccaagtagctgggacgacaggcgcgtgccaccatgcctggctaatttttgcacttttttggtagagacagggttttgccatgtcacccaggctaatctctggtaatttttaaactctgctcaaagttttagaaaacataagtctggaaattccaagttgagccactggtgacttgtgagcatgagtatggcatgggattgggggtggggtggggctgacgtggcctggggcagatgccgggtggttctgtttggaaacagaagttccactgcacatgcagccttcacgtcttgtgggggcttttgtgggggctgtgtacttcccagtttggttattagtaactttatttggttctggtcattaacggcttttgggggcgttttgggggcctgtttgaggcccctgaacatgcatttttcagttgtcgttgtccatgttattaaaaggatatgttggagggggttgcagtttagtctgctgctgtttcgaatccttttctttgatagtgtttgccttcctcccaccaaatgctgcactgagagtctctggtacctgggtccctccttcccttgcctttgcttgggaggtcagtgccttcatccaggacatctttgggcatacaggtaatcccaagcagctctgctcagttgttgataccccttctcacagaacctgatctgcctcagctctccttgcctcctaagtggcagtgccccgctgctgggaag

SEQ ID NO: 65356 - DNA, 1029 bp, Homo sapiens
cttgacttgtttttgaaacatgaaaacccttctcttaaattcaaaagtaatacatagctgggcacggtggtgtgcacctgtagtcccagctacttaggaggctggggaagaggatagtttgagtccagaaatttgagactgcagtgagctctatagtcatgccactgcactctagcctgggtggcagagtgagaccctgtcaaaacaaagcaataacaaaaaaaaccaaagtaatgcgtattgcagcaagtacttaaataatgtagatgcataaaagcaaaaagtgagaatccccactcctcctccagtgctctgagatagactgaagtaactcttcagggatgagtgtaaacacaagggatgtcctcgaagactttccacttggaaagcttgtgtattttatacattaagtatcataaatatgtagttaccctaatgggtccccgccattgctctgcaggcagtgggctgaggttcaggagttaagtcagccccagggcacagggtggtgcaacagaagagcctgagtcgaatccagatctcccctctccactgtgactgtttcctgggaaactagtcaggggctggttttataggaattatccagtcgtattattattattattattattattattattattattattattattattgagactgagtctcgctgtgtcgcccaggctggagtgcggtggtgccatcttggctcactgcaacctccgcctcccaggttcaagcaattctcctgcctcagcctcccaagtagctaggattacaggcttgagccactatgtccaactaatttttttatttgtagtagagatggtgtttcaccatgttggccaggctcatctggaactcctgacctcaggtgatccgcctgcctcggcctcccaaagtgctgggattacaggcgtgagccaccgcccccagccttccagtcgtattcttgacaaatggttttccatgaagttgtggacaccttccagggtcacaattaaatggttaaatgagtcacgatta

SEQ ID NO: 65357 - DNA, 1154 bp, Homo sapiens
caggcatgagccaccgtgcccggcctgatggattcagtttatgtgcaaaatttaagaggatgggtttcggcagttcaggttgttaggagacaagggtggaaaggtgtcctggagccctacagagatgggcttcaagtgccagccaaggtgtttgaccatttttagaagaggaatgagatgattaaagtggaacttttaggaagagtaggagtgagcgggatggatttaaaaggcggagtgagaggcatcaggaaggctgggtaggagagcattgctacagtctaggagggaggtggcaggggtgtagaccagggatcacaaagcaatggcttgccatctgcttctgtatacccagagagctaagaatggtttgtaccttattaaatggttgaaaaaatcaaaagaatatatgctgtgatatgtggaaattctgtgaaattcaaatgtcagtgtctgtaaatagttttttttttttttttttttttttgtggaacacagccatacttttcatttatgcattgtttgtggttgctttcacacaatcatgccagccctgagtagttgctgcagagaccatatggcctgcaaagactaaaatatgtacttatgtactatctggctctttccagaaaaaatcagcagaccccaggtgtagaccaaccagggtgaatgagtgtatgactggaaatgcaaagacgggcaggatcaagggacagtttagagcaggggtgtccaatcttttggtttccctgggccacactggaagaagaattgtcttgggccccacataaaatacaccaacactaacaatagctgatgagctaaaaaaaaaaaaatcacaaaaaatctcaaaatgttttaagaaagtttatgaatttgtgttggtctgcattcaaagccatggtgggctgcatgcgggccatgggttggccaagcttggtttagaggcggatgcagtacgggagagttttcccttctcttctgatgtaactccatgtcttggtggcggtgttctagatgtaggcatctttaggcaggggagtgtgcgtggaagggtgaaagggttgtgccttcatgacgctcgtgtgtgtgtgtgtgtttgtgtgtgtgagtgatgctgagctagtcttagagtaaatgcagacactggatgg

SEQ ID NO: 65358 - DNA, 1061 bp, Homo sapiens
ctaaatgaagctaaataaacatccttcaatgagaatatgtccttcctatagtttttggaggaaaatatttccttttgtgagacaaaagtgttagtaggtggtaagtactttttatttagcatagtacaaagttgtggccctctgtcaacccttcacattttggtgtgtgtaatgtttgaaactgcattggtctgtaaaatcccaaacccaggtagataaaaccaagaagtgacagggctggaagggatcttaggaattagttcataaagaacttcaggctcagagaagacatgtgagttgcctaaggtcacacagcaaatctgaagcaaatcagggctagaaacccatagacgatggtcatgagcactggttttgagtcatccatttgaacacacctgtgttcagattctacctctgttacttatgagctgatttcttacctgtgaaagtgggatacctacccaaggggttcacgggaggatttaataagatgatttggattaggaaaaactgacaaatttccccttccttcttctccctgccttcccctcacctgttaataaatagatccttgtgaaaggtcagtgagcagcatcagccagaagggctttgttttcagcaaggtccctgcatgtatgattacaatcctaagtaatatcagctgttgcttgcgttggtttctcagctctctcttggtgatctctctctttagctgttgaatgagttcaaagatctaggaagagctttgaaacccctctagcagcatttctgtctccagtcccagcacaggtctttggaggatgagataaaaagggttttgcccagggtcaaatgctgtgtacacgcttggtcactcttccctttcttgagatgacatgtccccttcttggagacccaagatgattgacaacaataacattcctttacaacgttttcttctcatctagagcactgggaggctgccttttaacagagatatcacagagtagcaagcatgcagacattctcatgacatcctggcagatatcaagaccaaagaacatcccatgttccctcttgaa

SEQ ID NO: 65359 - DNA, 1009 bp, Homo sapiens
aactacacgtctctatgagtcagacttttattgatcgtgtacaactaaatgaaacccggaaatgaaggaaatgtaacaagcgattttatgtattttttgtttgctcaaattgcctttataaaatagattgatactctataataagcaaatgttgtgaatttggaattttcaaattgaggcttactaataatgttaactattttatccgagtttatttgggtttcttataaaatgtaatttctcaagaagattttgctgccctaaaaaaaaaaaaaagaaaaagaaaaagacaaaaagggaagccactggttgctaatggctcctgcggctctgacgatcctcgatgaagtgttctttgattaagtgtcaagatgagtggtgcagacctttgacagacacatgattgtggttggagaaagcccagcattaactgctgaccttgccatctgtgagcaggtgttgaatgagctcagttccctcccagcccttctttttccctggtgggtcattggctcctgagtaagatagatgcatgcaatagaagagctgttaatagcatttactctttcttaatccttattaatcccattcatatttcagtgtctgaaacttggcaggatgtcaagaagccacagtgcaagtagggaaattgaacagcaaggaccaagtacaatgttcccctgatatttaatttgctaaaacatgtaagaagaagaaagttcttacattgttaggtcccaaagagagtgccactaagcaaccttgccaaaaccaccttgctggagcttcttattatctttttttagcgaatggcaataaagtcattttgtcaagctaaccaagtaccataatgagatctttgtggcataaattaaccgagtggggaaataactttgacaggggttgatgtccgaaatgaagtgttgtttgtctgatgtcaagcctgtggggaatttgaaccttgcactctttcctgataagacattaacctctgcatgggcttgctggc

SEQ ID NO: 65360 - DNA, 1055 bp, Homo sapiens
gccaagggagccgggccatggtcggagagaaggctgaggctccttgagaagcatttggagtttgagtcagttgtgtcttttaaaaaaattacccattttggacttgcctgtggaagcaattagagagatcacaggaccgtttctgattcccaattctgtccagtgtctattcagaaaaatagaaaacagtcaactggaacaggggattatttgagcacacacagagtcctgttgtctcagcagcgtgccctcagacaatttgccttttagtgaagtttaagcccatgaaaggaaataaaaagtgttttattagatggcaaagaaagatggactggacttatgagactttgagaatttttgctttttctttgttaatgcaaactttggaagagagcaactctttctgtaatgcaatttatttgtacaatgtggtagttattgttaatagctaataatgatcttcaactgggtaaaataccattgtgtgtttgagagggagagagagagagaagggtaggaggagagggagaatatcttttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcctcagcctccctcgtagctgggattgcaggtgcacgccaccacacccagctaatttttgtatttttagtagagacagggttttgccatgttggccaggctggtcttgaactcctgacctcaggtgatccacccacctcggcctctgaaagtgctgggattataggcatgagccaccatgccctgcctcaagcatctattttgtgcaagagcttgcagaagttctttcctgccacagccgtggttggccacattgctcccccatgaatatgtggaaactgacacttcaggagaattggtggctcacccatggcattcagct

SEQ ID NO: 65361 - DNA, 1019 bp, Homo sapiens
tccacctgcctcagcctctaaaagtgctgggattacaagtgtgagccactgcacctggcttctatctccctaatttttaaatacttaagattttaagaaacatcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaactactcggaaggctgaggctgggggatcgcttgagcccaggagtttaaggctgcagtgagctatgattgtgccattgtactctggcctgggccacagagtgagatcctgtctcaaaaaaacaaaaaacaaaacaaaaacaaattaaaaaacaaaacaaaccaaaaaaaccaaccaacacatttgcccaaatagtgaatcacatcaaattttaaaattcgctggaaactatctgcttcttaatttgattatacatcaattatgttcaaagtaaaaaacaaggtaatttgaaacagctgcttttatccaggtgtatacacggtgtatacata

SEQ ID NO: 65362 - DNA, 1092 bp, Homo sapiens
accgcatgtttcagaaagaaaaattcgcagttctatttatttttttactgtggattgaagggagaggcaaccaggtatatggatgaaggagtagggcctggctgtcaccactggtgttcacaaaaggctcccgtttaagtcctcttatattccaaatgaggggttataggtcgagtcagggcgttgctctaacagaagcaaaaccaaaaatacacggccgtagatacaaccctgttctggtacttcctaattttgtgtgtacatgtgtgcacctggagcttcaagaaatgaaaatggaaatggcctgagtgtttctcagccctaggatgaggctgtttctgtgatttagggctggaggttatgaagacttggtttacaatatgcacagtacagaagcggggaagtcaaggtgtgctgggcaaggaaacatctttatgtgacccacaaagagtgaagcagagggaagaaccagaagttattctggtttgcagactgggagacaggtttaatgacacagtcatgtcagagagaggggaagaggagaatacgtagggggtctgttttgatgtgtatgtacatgtaggattttcatgtagaggagttggggaaaattttagaagttttaggtgtaaatgcagctggtaagatccttatgacttagtttcttttttttcttcttttcttttctttctttctttctttttttttttttttttttttttaagacagagtctcactctgttgcccaggctggagtgcagtggcgcgatctcagctcactgcaacctccgtctccccagttcaagcaattctcctgcctcagcctcccagagtgctgggattacaggtgcatgcaaccacacctggctaatttttgtatttttagtagagttggggtttcaccatgttggccaggctggtctggaactcctgacctcaggtgatccacctgccttggcctcacaaagtgctgggattacaagtgtgagccactgctcccggccttagtttttgagtgggaagaatctagtgttcagagtggaccactgatgtcatagctgcaggtttggctgaattgggatggtgcagaaa

SEQ ID NO: 65363 - DNA, 1116 bp, Homo sapiens
gctgaaatgatccttctgccttagcctctcaagtagctgtggctattggtgtgcaccactacatccagctaacttttaaaatttttttgtagagatggggtctcactgtgttgcccaggctgctcttgaactcccagcctcaagtgacccccaccaccttggcctcccgaagtgctgagattacaggtgtgagccacccagtcctctgccaaacctttaaagaagatctaatgacagttcttctcaattgcttccaaaaattgaggaggagagaatacttccaaactcatttaacaagagcagtattaccttgatacgaaaaccagacaaggatacaacccaaaacactataggccaagatgcaaaaatctttaaccaaatactagcaaacctaatttaacagcatattaaagagatcattcaccatgatcaactgggattcttcctagaaatacaaaaagggttcaacctgtgcaaaacaataaatgtgctacaccatattaacagaatggaggacagaaaccatacaatcatttcagtagatgcagaaaaaacatttgaccaaaaaatattgttaactgtgctttcttttctgaacttaagaacttgcttttccaaaaccttcccagaatccctgtatgaatcaacaaaatttagttcttaacacatttctccttctttaaaatggtgacattagctgggcatgatggtgtgtgcctttaatcccagctacttgggaggctgaggcaggagaatcgcctgaacccgggaggcagaggttgcagtgagccaagatcacgccactacactccagtctgggtgacgagcaagacttcgtctcaaaaaaaaaaaaaaaaaaaaaagaaataatggtgccatacctttctcatgaagttgttgtgaggcataaatgagaacatacttgtacagcatctgggacatggacggcctctcaaaaggagtgctgctgttcttgctacctgcaccactgtaactgatgttgtttcatcatcctcgtcaccatcattgttattgattgtaaatggaagcacagtggtcatcttccaaatatgccactctgactctgtgaacttgtcactttataaagaggaaatt

SEQ ID NO: 65364 - DNA, 1137 bp, Homo sapiens
cccgggttcaagtgattctactgcctcagcctcccgagtagctaggattacaggtgactgccaccacacccagctaatttttttttgttttttttgtttttttagtagaggtggggtttcaccatgttggccagggtggtcttgaactcctgacctcaggtgatccacccgccttgacctcctaaagtttggtctctttttgtatcagcttctatacagacttaaccccatttttaagtcacagccagcatggtcaacttctgtcagttttgcttctgttccaaaggcttctgttttactaacatacacacatacatgtatgcatatggatttaaataaattctggtgcagggaagtctaggaggcaaagagagataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacaggtaagatgactggctcccagggatgatgacaaaccatttcttattatggtgtattctagggccttgtccgttcaagttgcctgttggaaagagaatggttttcataaactagaagaggagaaaaggtgctatgttgtttcaagcctgggatttctggtggccacatcattcagtattaaggccctatgtgttttgggaagttctaactacttctgtttggtttttaaaatcttttgttattgttggttaacacctacctttctgttaagactcaggagtagagacttccttaaaaacgcgtgtcttcatggtaattaccagccttttaagctcccaggaaattgatgctgtgtttatattcccaggagtttctgttgggcaggaaa

SEQ ID NO: 65365 - DNA, 1057 bp, Homo sapiens
gaatggattttgggggtcaagactggtctctctctgctgtccctccctgaacagaggctctgggaggctagtaatgcattcgagataaagcagccagtgtggccaaggttctcctccagagcctgagcccttgaccacaggagctcacgcctcctctcatttcctgtgaatgattgtgtgcaatgtaagcacagagcttctgcactctcatgatcaagtgctctctccatggccagaaacagcagtttctgaggggctcatgttgtaggtgatgatacaaagaagacagagagagggatcaggtgtcctaagtgtacatttcatctcagtattttctgaggtggggcatccctgtctcctggagaagtatatttttaatctagttgtttactttctttgcatagcccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttccaaatattgtttttcttttaattatctaagaaaaaactttaaaaattttcataacactaatgcttatttattatatgaaatacagacaagtaagtagaaaaaacttacatggaaaccatcaagcagagataatcacttttgatgtatgacattttacaatttttaaacatatacatatagatacacaaatatatgtgtgagtatacatatatttaatacatatatatttaatatttaatacacacacacacacacacacatatatatatatatatatatttttttttttttttttttttttttttgagacagtcttacc

SEQ ID NO: 65366 - DNA, 1075 bp, Homo sapiens
agtagctgggattacaggcgtgtaccaccacacccaactaatttttgtatttttagtagagatgggttttcaccatgttggccaggctagtctcgaacctctgacctcaagtgatccatctcggcttcccaaaatgttgggattacaggcatgagccattgcacccagcctaagggctcatttttaagacaacaacaaaaaactggagaactggtaagataaactgggaagttcatgtgcgtcacagaagagctgaaattcttgagagcactgagtgtgtgcatttctcagctcgattttggagtgtgccttttgtgaactcattagaaagcgtaatggcaaaagagcaggtcctctcgacagcacttggagaggaagctgggcgtcatgatagtaacagttttcccttctccttcctttcttctgagcagttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacgtaagtctcttaggatgcccttctaaggaacagcctctctaactgtctcttggaggaggcactggttaaatgatggccagtgtgcttctgggatccaggttgactctgaaactgctgaagttgaaaacattggtctcagcaatggttctgctgtcaccatggggcactgttcttcaagctatgtgaacttagaattgtcattagaaggaagaaatgattccttgggaatggtgactgaaatggttctagtcattccttgagaatacagagtagagaagggtcaccttgtcatgttggtattggaagatactgcccagatgaggagcttcgcctgcaacagttagggaggtgttttgcgaatatttgaattaaatacatggtaaaga

SEQ ID NO: 65367 - DNA, 1035 bp, Homo sapiens
ctgtctctataaaataaaataaaaaaattcgaagggtcaaacaaaacccaactagaaggtctgattccatctctgatgccagttttcaatagccagtctcccttgtgaggttttagtgatggcagatggcatgatctgagtcttcttataaaaatgcaattttgttctagaccaaatgtgaggagtattggccctccaagcaggctcaggactatggagacataactgtggcaatgacatcagaaattgttcttccggaatggaccatcagagatttcacagtgaaaaatgtaagtaagaagtcaggatcagttgagctcatgtaattaccatatgttaatttgggggtgatatgttttaggttgatattaactaatatgttttcctatgcagtgagaaatgttttgctgctttcctttcagaacagaacaatccatatgcatgtatactccaaggcaaccccttgacttttctgggaaatttactttcttgggaataacctaagttatttctgaataaaatgaatcttaagagcatggctctacatcaggaactctttcctttctttccacttccaggtgacttgctcatagattttacagaacaaactgtagccttttggattatttggttagaaatatggcatcaggagcggccacttgctgttaggagtaattgataacagttacattaataggattccagggcatatgcacatggccttccttcccctcaaaatttacaaaagcaaatccaattaaattgtgcaggcattctaggaagtcaagtttatgtgctttttttctttttcaaggatgctttgaaaatagaggcagtgccatgaagcagcattggtatctgttgatgggtgtgtgcattggcataactctctgctgtttatatcacaggcctaaacattaggcatgtgctggcttgaagtctgagactatcctaaggaaataatctgaaatgcaaccaaaggcttattcagaaagacgagtctcagcattatttataatagaggaaaactttgga

SEQ ID NO: 65368 - DNA, 1003 bp, Homo sapiens
tgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagt

SEQ ID NO: 65369 - DNA, 1049 bp, Homo sapiens
agcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcacccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgctttttttttttttaaggaaaaaatggcctgaaaacatttttttaaagacttacaaataccaaatataaaaaaatgtcaatgcattatgcctttgcttctttctttcttcttttttcct

SEQ ID NO: 65370 - DNA, 1048 bp, Homo sapiens
ttatgtatatatgaacctttcttttcttttcttttttttttttttttttttttttttgagattaagttatgctcttcttgcccaggatggagtgtaatggcaggatctcggctcactgcaacctccgcctcctgggttcaagtgattctcctgcctcagcctcctgagtagctgggattacaggcacccaccactacgcccgactaattttttgtatttttagtagagacagggtttcaccatgttggtcaggctagtctcaaactcctgacctcaggtgatccacacgcctcagcctcccaaagtgctgggattatgggtgtgagccaccatgccctgcctatgaactctttttgacaaccatgatagctattcaagatatgtttgcttggtattctttgtatttatgataatctgattaaaggatgttccaaatataggaacattaggtatagatttccttacagctttataagtgatgtcttttatgctgcttttgctctgtgtgtgtgtgtatgcacacacacgtgtgcatctgtgtatgtgtttttagtcctgtcaatatatcatctgcagagattcttttctccagaattattgtcatatgtcctttatggttgtataaaaagagaaaaacttattgctgtgaaaaggatgtattatattatagttgtgtgcactaagaattctgatttttgtttgcttttaacaagtttgggagaaattcactaaactttaatttatactattacctttcaaggaatatcataacacatatagctgtttgatttaacagttctttacttgatatgtacagttcttgtttgctgttgggttttggcttgatttttcattttaggaaaaggctaagtgggaaaaaaattgaaaagatagagcattacacattactcatttaatgagtaccccataaattggcaggtagactgaaaaccaagggttatttatcatcagaaagtttactagtcacttgattgaaagaaatgttaattttataaattaaaaagagtaatagcacaaatatcagcca

SEQ ID NO: 65371 - DNA, 1094 bp, Homo sapiens
caatagttcagtagccatgggaaggggggtgaaaggcagggaaggaatgccaagctgttctttcggcaaattccccagctgctgaggttagaaaaagggttgatgtcctctggtttctggatatcctccttctggcaggtcagagccctaaatctaaggccagagcttgcacattgctaccttgcatcaaaatacagggaccgtgctctttagaaccaaatgttgtgacggggtctgacagatgttgtcaaatattgtgctgtttccagatgaacaacagctcatttgagagacgtattagtttggtggcagtatgttggaattttcattctttagaaaaacaagcagaatatttgaaattgggattacattggaaaatcccagaacatatttttggcagctgtctgagtagcccatcatctgggtgacctggccttgtctctgaggaatcactcagagacctagctctctgcacctgtcccccttggcccctcaggaacattcaggcaagtggggaaagtggcatcaactttcctggaggctcaggtggctcggaagactgtggtttgtggaaaagcacagggtctttggaatgatacatccctggggctggagctggggggcacagttgtgtcctggccttaccacttactatgtgggtgacatcggtattttcttctctgatccccagtttctcattctgttaagtgggaatgaggatccctatttcacgttaccattgtgagtatgaaatgagagaatcggaaaaacacacttaatatgttgtctggcattgaaaaaagcattcagtagatttaaattgttgtttgttctcactccaggatcctgaaatcaaccaaggctgagtcagatggatttcgatcaatggaacccttcctctccagctctggccactcctgggtgccccttggggttcactgtcatggcaacgggtctgtggagtggtgtggaagccgatcggggaagctaggcagccagaacgctgcctggcctgccggcgccacagccaaggagggcggccacctgattaatgcctgcctgatccattggcctcatctcaggccaccctggta

SEQ ID NO: 65372 - DNA, 1067 bp, Homo sapiens
gacattttgccacttgaaacaataaataaagttttttgggaattggtgctgtccaggtggtggtacgtggtcatggctgcccatttcctcttccaaggctgtggttggaaaatgctgattcccactctgccccaccaggggctcactctgacactggatgtgtcacttcccttttactgacatcactgagaagggtatattgtttacaataggctgatcaagaattcagacaccctctaaatcttagtagtttaacacaaaaaggtttatatttcatccatgacacagtccagggtgggctggtgataggggcactctgcaccttgatgtcattgagagcccaggctctttccctgttgtggctcggccatcttcagggcttggagtcttctgccccatctaatggagaaagggggaatcttttgtgggagatactctgagtccattcaggctgctgtaacaaaatactgtagacttggatggcttataaacaacagacgcctatttctcacagttctggaggccaggaagctgaagaacaaagcactgacagattcagtgtctggtgaggacctgttttgtggtttatagagagtgccttcttgctgcatcctcgcatacatggtagaagggacaagggagctctctggggcctctcttataagggcactaatcctatttgtgagacctgcaacctcatgaactaaacatttccctttttttttttttttttgagatggagtcttgctctgtcaccaaggctggagtgtggtggtgcaatctcagctcagtgcaacctccgcctcccaggttcaagtgattttcctgcctcagtctccccagtagctgggattacaggcactcaccaccacacctggctaatttttgtatttttaatagagatgtggtttcaccatcttggccaggttgatcttgaactcctgacctcaagtgatctgcccaccttggcctcccaaagtgctggcattaaggcctgagccaccttgctctggaaagtcctctcttcctagtagcaccttagaggttaggaatttaacaacatttaa

SEQ ID NO: 65373 - DNA, 1019 bp, Homo sapiens
cccctctcccattcctcctctcactctcctctccatcgagggctccagaagatccctttgtgccccgccgggccctatgctgtgtgccaaatgggatggaaagaagaacaagatgtgttcttattctggaacctcaggggcagtgggagacatgatgcccataattagcctggatgagagaagaagtttaggtgtccctgaggagaggcacagataagggctgggcctgttcagagagagaggagttatttcctaacagcagagtggagggggatgggaagggagggtggattggagaaggcctcttgtatgtatttgatcttagccggcggcaggcacaggagttggctcctggagctgggatggtggggtggcattgcaggcagagggaacaggggtgggaagtcaccactggctttgtcccacccagtttgtctgaattcaatcctgccatatgtttttgaggacagaaaggtgtgcaaggcatagctcagttctgcgggaagtgcatctctaagtgacttcccatcctttggggtgaaaggactgcagaggggtctctgcttgattctggggactgcacactcttgagataaggtcttaccccctgagagtcctactgcctgtccctctactatctatctgcttctggacttgcttctcaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtaggtgacctaagctctgggcatccgctgacctcactgtattaccctgatgaaaagggaaactctcacttcacagaagaggcaaactgaggctcaaagaggaacctcagtcggacatgccccagatgaacggtatgaagatggtgtcagaatttgggtccctgcagccaggccccagactgcctcttctggttag

SEQ ID NO: 65374 - DNA, 1034 bp, Homo sapiens
tggctcttaagaagtggaaagtgatcatcttgttcccttagtttaggatggagggaggtggggcggggattgtgatgggactaggttaggggaagaggaggatagtgtcatcattgtgtctttaaaacacccaggcttttgtggttgtgttaccgtaatctggccagtgttgactttaacccgagttcaggggttagccgtgatgccatacaggtgagcctcattgtatgcaacagaaagcgtggctcctaacagaaagcacggctcctcaaaaagccgaacgaaaacagttgctttagagaggagttcgaggggcttgtttgaattttatgctttcgggcagccttttctaaaatgtgtcctaaagaataccagtctgtgaatatgtttggaaaatgctgggtactctgtggccgtacagaagacttagtctgtatattagcatatattagtaccttaaagacaagtaatgcagtattttccaagctaatttggctaatgtccaagaacctagtgttctgagcagggaaattctgatgtagggaaattctacactatgggcactttctctttttttttttgaaacggagtcttggtctatcgcccaggctcccagcctgaagtgcagtggtgcgatcttggctcactgcaacctctgccttctgggttcaagcgattctcctgcctcagcctcctgagtagctgggaatacaggcgcacatcaccacgcccggctaatttttgtatttttagcagagatggggtttcaccatgttggccaggctggtcttgaactccagacagacctcaggtgatccacccacctcggcctcccaaagtgctgggattacaggcatgagccaccatgcctggcccactatgggcactttctctttaaagaaaattttggaggttccctttgtaacgagaagtccttgagaatagctcagaggggtctggctctgggtccatctgccaggcttgcgttctgattctgtcaccacctctgtgaccttgggcaagtttgttctctt

SEQ ID NO: 65375 - DNA, 2405 bp, Homo sapiens
gttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaaggtaatgaacggagccccatcccaagtgtgggagggaacatgtgaaggctgtccaagaaatcggaacctttctgaggagggaagaaacagtttttcctgaggacttttagtgtttgggtaattgagacattttggactaagaatttttagttctacttaaaaataattgaaatatgatacacatacaggtgagttccttttttgaaggatgactaatgtgttacttttgcaacccatgtttgagcttggtgatttggaattgtgactgtgacgggggaaatggtgcatgtcatagcttggatggtttctgatgggttctactcttgtacacagtagccgttccccaggcctctcagccctgaagccacaggtggtttcataggtatagggcagagaattccgtgtcttcttggctggggccaccacagccaggagtggagtggacagtggaacccacgggttctcaaagaggttaggtacttggtgcttcttgcctgtcctgtcttgaagcctggaatagcaagttcaagaacctgaagggtatggggacctggccccatgaccttggcctctgtgcaaatttgctgaaagaactttccaaaggctttgcaaggcaagcacagtctgtttcatggatgttttaaaaccagctgagatggttttgcagctgagaaacgtgctaaaaaggcattgcatccgttttgttaacatttccatccattgagattcgcttttattccctttagtgagcagaaaatgttaccttttccagccccacagtgggagcttctcactgggtatgtggggaaggcaagggaagtgtggggcaggggcttttataagtggaaggggttggtggtgggaggagaggagcaggaaggggctagagcatatcatggtggtcttggggactctggagaggcatttgggatggaggaggagaagggagagaggaagatgggcccagtgagatgcccagggggatttgaggaagtggagcttcctgacgactcaggctgttgacggggtggtgacggagcacag

SEQ ID NO: 65376 - DNA, 1072 bp, Homo sapiens
aggatgggtcgcacagtcactgaggaagaggaggtcaacgaaccagaggctggaagggtcgcatctggctatggagatgactgtaagctatcacaacaatgatggagagggttgcagtgatgcagcggttatggttttcaaggaatgatgggtgcgtaagggtcaataacaagaaagaattgtgggtgctgtagtttaagggcacgagctttgacattagaacgttgcagaggggagtgagcatggagggaacagaagggaccttgagaagcaagcaggaccctttattttgcccaggcctagtaggtgatgatgtgggagaattaacgacatgggagagggcggccagggaagtgtgacctctgcagagggcaaaggtcagatggagccagagtcacttcattgtctggggacaggtggagtgccaggtgcttggtgccttgtttgtccccctcttctctccacgtcctccccactctctgccgccatcatcccatgagtcctatgccgaggggccagtgcacacatttcccttcaccctcacctaactgggagatgagcattgttgccaccagccctaatgtacagatggggaagctgaggctcagagagaccaagtgtctgccatatgtgagggagggcacatgctggtaagaggcagtgctgggacggctcaagccaggcgctgtcacaccccccagtgccttttgcctgggtcccatagccttcctgcttccttggcaccttctgtgccatgaggggcaccccctgcacgctgtagccactcccccgagctgctctgtagctgcactgcacctcgaatcctgcttggacgcgaaaccctctctcccctcacgactcccacatgctgaggtgcttcaagagccagattcacaatgttccttttccctttataaagcaggtgttatggaccccgaactgtggcctctgaggagatcctcacatgagctttgggttgagtgggtgaggggttccaaccacctgagacgaaaggaattatgctttgtgaataaggataggcgcattctggggaagaaggtctaaagggggc

SEQ ID NO: 65377 - DNA, 1402 bp, Homo sapiens
ccagctcctcttccctcttgccaatacagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggtgcggcaggaatgtggggcctgtgggctgggcagggtgaggggcatgtgtgtctgtgtggggttggtctgtaagagtaatgagttggagtggatggtggaattctgaggttctgaaggggggtgctgtagttgggggcggtagggaattgcgggcccttcactgaagagtgggtggggcacccaggactccagcttttcccttaagacacctttggttttcaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccatgtcctcatgctttctttgtagccttggtgtgttgctcccacttttattggtggtgtttactgctctggtcagactgggcagggccttcctggccagccgggaagcaagtctcgaggtacatcctgttctgttcccggctggacgagcattggttttcacccgcctctgcccggatgggccacctgagagtctagaaatgagagctgatctgattaggaagtttctcccagttacactccattagccaaccaagctagggggaggcagctcttggctgcatccttacctatgagtcaagggtcttccaaggctttcgataatgaaatcaggattgactgtccttcccgcagccgggggagtggaaacctgagcctggagagtcggggaggatgagcgtgtgcgtagagtggtggtggttgcagcctggtggtggtgcaacaaagtacggagttatatgtgaagctttt

SEQ ID NO: 65378 - DNA, 2804 bp, Homo sapiens
gcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagaggtgagaacctccacctgtcacttcctgggcatcctggtcccgagccagctttgtctaggaaggctggcgtggcctggggcactctccaaccctagagcagaatttttcttttgctacatcaggatttggtccttttccctggagtgctcagactttagaaacctctccattgctttctttctggtcattaaaaaaacaaaacaaaacaaaacaaaaaaaactttttccgtattctgaaagctatatgtcttcgctactggtcttttttctcctccactccccaccatgatggaaatgctatctctttctttcctggaatgagctttgtgcctgagaacatagcggctaatgcttattgagtgctcactgtggactaaacgttttataagcatcttcacgtgtaatcctcatatcaaccttgtgaagtatgaaaaaagatgaccacgtcccctgccccacacttactcccctctgagcttattttgtaaacagatgcgcacccctccctgcctttcctttcccagagttcttcaaagccatgcagttctttcaggactaatgtctggctctggctctgccttactgctgtcctctgggggtttctaagctgttgggttgggtagcatagtcaagagctccaggctccacagtctaccccagctcatggaatcagaacattgtttagtgtgcccctgtgttggcactacctctctggtaacatggtgcatgtcccctcacagggaggagtacgggaaactgtttgattttgtcaacgcgaaaaagctcaacatcaaaaaccgaggattgaaagaggtacttctgtgtggggaggatgagaccctctcctggtctttctataggggagaaaggggtggagattttttccggcttctttttcactctttcttctcttcttacccttatagaaaaaagaggtgcgtgtgaccctttccccctcctggtgcaggtttcctctgcatgaccttagaccagtctatgcagcccctcaggagcccccagtggggctgggagagggaggggcttggggcttggactaacccagttggcaggaagtacttgggcataggccctgcacgttggctgtgtgtggacaatccagccccaggtcttctgggagctgctgctctgacttgacaggcatgggggtgtgcttttgagtgtgcagggattctggctcgagggtgagttggccccaccgtgaactcttccctggctagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccggtgggttagcctccgtgctgagcacgaggatggtcagacgctcctcgctgtggcccgggctggactcacccttgggccagagctgggtgcctgggtgaggtggggggatttccattggggcagaagctgatgcatcctgtgccctttttcagatgagtcattcaacccaggtgaagaggaggaagatgtggcagaggagtgagttttggtggtaccttgtggggataagatggtgacccataagcttaagggaccagaagatttctggacatttctcaggtcccagcattagctactgacccagaatgggagagtgacctccaatgaggtgatatacgaaaatgttttggaaattgtcaagggctttgtaagtgcaagacatattttgaagtcggaaaagtatagtgggatctatggccataccgccctgaatgtgccagttggggctggttcgtagttggatgaggagagaatgggaatgagctggtgcttgccacttacttgctgggggttgtcgagtaagtcattgaatctcaatttcctcatcagtagaaatgcagtagtacccctgctaaattggttaagactttttgttagcagtgtcagaaatgtgattcactctcactttaaaagggaacatataaaagggaatttcataagttcatattactgcggagtctggggatttaattggcttcagacactactggattcaggcgctcaaatctatttcttccgatttccttaattaaaaataggtttaccccatggggtgcccagtgactctcagaagctcagggcaggcttaatcctactggtttaaaacaacaccagaagtgcctcttttggtgaacagcatagtgaacacagtggttacctgcccctttctagcctgagttattagaatgggctggggtctgatgggccagaaataggccaagtgcccacccttagagcctgtggttggggtaagcccttcctgagtgggggcaaggtggttcccaacagaaaattgggactctgctctcttaatccagaaggattgtaaaagaatgtcgggcagcaaaaaaaacacccaacaggagtcctctagttcagcctgccacatgcttatgaaggtttatgaaggtttaatgagcaaatacttgtgaaagtgccttgaagactgtccagcagcatacaggtgtaaggtagttgcattgttt

SEQ ID NO: 65379 - DNA, 2825 bp, Homo sapiens
ggtaacgttattttggaaaaagaagactcagtataatgtgtacctagtgtctccaccaactcaaggcaatactgagagatagtctcagagttatagggaccgtatatgctgttcagttcccaattcctgttttacaaatgaggaaactgagaatctgttaagggttctagataccagagtctggtttagaatctagactccttggcaccctcagctgttgctcctgcattgataatctggccagtccacttgcagcaggaatgtgtgttaggtagagctgtagaacccaggacatgctgtgtactgtctccatgcatctgggcctgcttttcttacagaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggtgagatgtcccatggctataagcctcctttttactgcatcttcttattttaatcttctagagactcgaggttccttcctcatgtaaccctgtgattgctagtttgggctccttagagcagggctgtgaggccatcaggcaatcagtgtttggctttgagcgttgaagtcttgtgaatttctgtgtgccttgactccagaagattttcttctgtcttgatttagatagtagtttctgcctgtggcttttatcaaggttcagaatcttagcttgatttctttgtgtgtatgtgtgtttttggttttttttggggacagggccttgctctgtcacccaggctggagtgcagtggcgcaatctcggattactgcagcctccgcctcctgggctcaagtaatccttccatctcagcctcctgagtatctggtaccacaggcacatgccaccatgcccagctgatttttaataatttttggtagaaacggcgttttgccacattacccagtctggtcttgagctctcagactcaagggatcgcccaccttggcctcccaaagggttgagattacaggcgtgagccattgcgcctggctagcttgatatcttaaagtgtgggttttgttttcctttttgaactgcttgagttaaaggctttatttgattttaatttccactttcattaaagtaatacctatacaaagtttataaagtcagatggcccgtaaccaggaatgtcagatccagtggctagaagcaatctctttcaacaatcttaccatgagctgggttgctaagtcagcatggatttcttataaagcctatttggggcagtttctcagaaatagataatcccaggacattcaagtcggtgttaaggccaccaaggtttactgggattgtgctttcttccctccacccacaggagtttgagaaactctctgatttcttcaaaactcactatcgccttgagctaatggagaaggacctttgtgtgaagggctggaactgggggacagtgaaatttggtggtgagtcctggggaagactgaggtttggggaggaagatagggtgaagggtttcagccttttacttgttttgctcttttccctctgccactgtctctggtttcctatctatttgcatgttcatcatgtgtttattgagtacctacagtatactgcctggggttggggttatagtctaaacagactaaccgcagtatcctgtctctgtggaactcagtttggtgggaatattgcttatgcagacttaaggggaggagcttgtggctggataagccctttcctcacagggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggtgaggcttcccctggttgccttggcagcagatggtgctgagcaggcattggctggcctgggagcagggcctgctgcttggctaccaatatgtgcttttgcaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtggtaagcagaaacccctatggccggataatcctggtttttgcctaagtgttaagtagatggatctcactggtgtgcagaattctacgttggttaattgcaagttgttgtagagtgtcaattagtactcttccttactagatcagcctggatcccccaatcaagcaaggccaaactcgctaccacttcctgatcctcctcttctccaaggacgaggacatttcgttgactctgaacatgaacgagtgagtgtctccctggactcgtttcctaccactgtccaggcaggagacaggtgtgccattagaaggcagtagtgttgtgacctcaccttgctttctttgtagggaagaagtggagaagcgctttgagggtcggctcaccaagaacatgtcaggatccctctatgagatggtcagccgggtcatgaaagcactggtaaaccgcaagatcacagtgccaggca

SEQ ID NO: 65380 - DNA, 1111 bp, Homo sapiens
ataggtacctccaagaggctggcaaacggccttatccagttcaagtcctggtgtcagattcaccttggagccagaactgatttgaaaccacatcatcctgtggttgcggaagccaggtctcccccgtataatcccagagtgcattttgcaacatcagagaccagacctggaaaagatgttttagtttttctaccccaacctccttttactgatgggaaaactgagacccaaaggggagtgagttgcccagggtctcagtgcgttggcaacaaggctaggtaggacccagacctccttaacaccaccagtccagttatcttctgtcataatcacagtgactgtatgttcagaatgactattgatatgtgtcctacatgaagacattagtacagaatatgtaagctcaagatttccctgacaatcaatacaccagcttgctaaatcaatcctggggtaagagacaacaggaatgcacccttctcccctgaactcatagctttaacctctgagtagtggctattccagcattatctagcaaaataaattcaactgggtttaataaatagatattgagggcctattactactttagcacacttctcagatttgaggaaacttgaacaaggtgaaaacatccccggccaggcacggtggctcacacctgtaatcctagcacttggggaggccaaggcagggagatcacttgaggtcaggagtttgagaccagactggccaacgtggtgaagccccgtctctattaaaaatacaaaaattagccaggcgtggtggcgggtgcctataatcccagctactcaggaggctgaggcatgagaattgcttgaacccaggaggcagaggttgcagtgagctgagattgtgccactgcactccagcccgggtgacagagcgagactctgtcaaaaaaaaaaaaaaaaagaaagaaagaaaaagaaaaaaaaaaggaagggaaggaaagaaagaaaaaaaaaaaaaacagaaaaaaaaacccagccccaacctttcaggaaaacataatctaacaaatgactttaataaataaagtgacagttaaaaaaaaaagaagttggcacatatacaccgtggaatacta

SEQ ID NO: 65381 - DNA, 1063 bp, Homo sapiens
aaacgtgaaatgtcaactgtggcttagaggtgcacagttatagagagccgcttctgtgaaggtgtttggcccagtcagggagtaagggaaggttttctggagatgtgacattttagccaagacccgaaggatgagtaagagcagcccaggtgaaagagggaaggaagagagttcagggcagagaaacccacctctgcaaagggaaggaggctggcaaacaggggaaagaaaagaaggtcattgtggctggagccgagggagcagagatgagtgagggtggtgtacggtggatgggaacacacacagaggccggacctcagacacccttagagagcttttgtttttacaggagatgaataaacagaagccatggaagcattttaacccgtgtgtctgtgtgcacttttgtgtgtgtgtgcacgtgagtttgagagagagagagacagacacgatgagatctgagttgggaagagcacctgggctgattccctggaagtggaaggagtaggagtgggtgcaggaaaacctgctaagaggcagtttatgcagagaggtgacagtggcttggacccaatcgaatttgaagggatttttaaggctatagtgttaatatttcactgatacttcaatctcttccccatcatcccaaccaggtcaacaacctagactctgcctaacatgagtccatcatttctctgagaacttctcagcaacacaccacctggtcatctcacatacgctctcacccccgcccctggcctcagctgcttgtctgtggttgacaccatttcatcactattttcctttacccactccagggcacacagagaggcctggacttacctgatgtttctcacatcttttctgggtccacgtggtaatccccactcacctctgtggagtgggacttcccgagagcccatccccgttctggatcctttggggacctgagaagttgaaggaaatccctaggatctgagtccctggaagcaatagcctgtgcttggcctgaggttgatttccagggccttcctggaggaagctgcctccttgcaaactagga

SEQ ID NO: 65382 - DNA, 1040 bp, Homo sapiens
ccagagaatgacctcatacccgctaatcactatccataatctggtgctaactgtactttagctgaaggtgctggcaggtcctgcccaggtgctgctaagaacacttctattctgtgagaatcagagatgatttctagggaaaatgggcgagagggagtaagcaggagaaacaacccacaggcacagctctcatctttctgccctgagagccttcctcctgccacgtggttttgtttgtttgtttgtttgtttgtttcagatagggtctcactctgtcacccaggctggagtgtagtggcaagatcatggctcactgaagcctcgacctcccaggctcaagcagtcctccccaaattcaaagcttggagtgatggtcccagtggttatgtctaggagccctttttcctgccagcccctcaggggattgatgactctcaaatgcttcaggtgtgacatgggcacagcagtgagtcattcctctgacattctttgggaagaacattttccatccaggcttccaggcataagatccagtcctctggtgataaggagttcacagacaggacaatgtctgagtgtatcttaaacccaggaccatggcttgtgttcacaccagaccctccagggattttgaggtgttttgtttgtttgtttgtttgtttgtttgttttttgagacagagtctctctctgtcgccaggctggagtgcagtggcacgatctcagctcactgcaaccttcgcctcccggttcaagcgattctcctgtctcagcctcctgagtagctgggactacaggtgtgcaccaccacacccggctaatttttgtatttttaatagagactgtgtttcaccatgttggacaggatggtcttgatctcttgacctcgtgatcctcccgcctcggcctcccaaaatactgggattacaggcatgagccaccgtggcccgcccaattttgagtttttatgttctaatcccaaacatctgctcacaggcccctcagcatattctttcctgggtccagtgtcacctcccaggc

SEQ ID NO: 65383 - DNA, 1080 bp, Homo sapiens
ttttttttttatttggaggcaaggtcatgtttcattgtccaggctggggtgcagtggcccagtcatgactcactgcagcctcaaacttctgggctcaagaaatcctcccactcagcctcctgagtagctggcactacaggtgtatgccaccacacccagctaattaaataaaaattttctagagaaggggtgagggtctcactatgttgtcaaggctggtcttgaactgggctcaggtgatcctcgtgcgtcccaaagtgctgggattgtaggtgtgagccagcatggttgcctctttccttttttaaggctgaataatattccattgtgtgtatagatcacattatgtttagctgttcatctgctgatggacccttagtttgcttccatcctttggctattgtgaatagtgctgctatgaacgtgggtgtgacactgactttttccttctccttctgcagcttctttatgaaaaaggcatcagcctcagggcctccttcatcttcatctctgtctgcagtacctggcatgtagcacgcactttcctcctgatgccccgggggcacatcccatacccactgccccccaactacagctatgggtaaggactatctggtgattgtgggccagagcccctcattggccctagggtgggatggacagggtaaagcaaacctatcacaggagaggaggaggactggagcagtgcatctgttagctattgctgcataacaaactatctcaaaactcagcagcctaaaatgttaagcatttattatttttcacaagtctgtgggtagctggctagttccgctgatcagggccagatgtagatgattttgacagggctcattcatacatctgatcatttggaggattacatgggggctggctatgctaggatggcctcactcacataggtttggagtgacagggatgcctgggtcacgtggctgtcatcctccagcaagccagcgtgggctcattcacaccgtgatttcagggttctgaaagagtgcagaaatgcacaagcgttcttgagatttaagcttggaattggcacagccacttctgctgcat

SEQ ID NO: 65384 - DNA, 1044 bp, Homo sapiens
catggccacagagaaagcaagtgggaggtgggcctgatgtgcaggcctcctgatccctcactcttctttctgtcattgccttggttatggtggccacgagatgcctcccaatattccttcctagtgttagacccgtggctcaatttttggtttaggaaagaaagtacattactcttgtgtgtgtaagctatgctaaagctgacagcatcatgagattgtctgcactcatgctgggcaaacacagaggctgagtgtctttgttcacacagatctcatgagatggcccagcacctcaaaccaattatttcaaaccactctccttatcaaaccagcatcatctactctaaaagcctgtaaatgatttttaagcaactgaatgtggaggtggtggctgggtaatgtttgactcgtgcctgcaaatcgtctgagcaacaatcctcctcttcctccataatatagggcttttcagttttgaaaaaagcattgagcccataaggactctattgtgaaaggagtctccaacctttagtagtaggagagatgtacattttataaagacagaaattgaatggtaaactgtgtgaatactctaaaattagctcttggcagtgcttcttaaggtatagcacggtagttaagaggatgttaggggcacacgcatactacgtgaactacactaacaaacatcaaatcacctggtagaacagctattccctttttatttctctttcagtccttctgatttcatgaaagaatgtcttcatgtggggccagtgtgattttaacactgatgggaagagcaggtcttaggctttgaacattctaaggtcaaatgcatccagctacaattgaataacattgttttcctttcattgtatttattttgacagttactttctattcatgacaagtaatgccagtgttttcatctacagtagtgatataaagtgtcctttaaaaatagatactttttggataaaagtgagtcaacttaaaacattttagcaaataataggacaggcataggttgtggccagaataatg

SEQ ID NO: 65385 - DNA, 1711 bp, Homo sapiens
tttatgccaggctggatcctggacaggtcaacctggtgtacctcgaagccaggggaccaaagttttagctcagtgcaagatgggggcctcaatttcctctgtcaaatatcaaaggaccctttgactgagccatgccatgctcctcaacctccacggtgggcagtaccaaactgcataccgttttgcactttacaaagagtactaaagaaggtacttttgctcagtgtctccaaaggagtttgagagagcgcatgggtgggggggccatcagttgttctggtgggcaggcatggagggtgggcagttctcccttcttttcaactgaagtagtgtttgaagagccagatcttacctccacacatttgggggtgtggccctttgaagctctgtcctgcccctagggaggaaaaggcaccaaggtccaagactgcagagaaaaaggtttgagcaggagcctgaggggagagcagacattaattatcctggtcagatggtatggggaggacaagaggacagatggtgcatcagcttcttccataagaagggctgacacatttgcacagaatctcattcaattgagaacttacctgccctggggttgagagcccttgggcagagcacttgcacctccctctccccaacccccccagttgttgcacgtgggaggacctgggaaaggtgagaaaaggctgagcatgagcagtctgggtttgccttttcccctggggaatgtgccaggaaggggcaggataaacacgattaggcccggtaaacctagagcactaagtttcctttgtacgtactatgaaatggacatttttgtgcgaacatgaacatgaatgtttgtggagtcataggcaaaaatgtatgtatttttttaagataatggaaatttcagagatattttgagccagtggccagcaacttcaggctttgtggagactatttcatagctctctagggggcctcaagtgaaaaagaaaaaggaatgatgggtcttctgagtctgactctaaacttctggtcttggtttcctcatctgcaaattgggcacaaggacaaggggagaagagaacttctttaaggcctctgaggcctgggatctaccttggtggggtctggggccaggcagtctcccccacgggcctgccccctcctctcacagctgatctacgatgccggtgtggccttcgtggtcatcatgttcacctggtctggcctggcctgccttatctttctgaactgcaccctcaactggcccatcgaagcctttcctgcccctgaggaagtcaattacacgtgagtggctggagtgggcagagactctccctggggcagagagggctgtggtgatatgatagacggaattaactttggattcagagagacctcggcttggacctctgcttggcaaatcgcttgagccctccaagctctgctttctcatctgtactatgagcctgttcctacctacccacaggtcgcttttgtttgtttgtttgtttagaggcagtgtcttgctctgtcactcaggctggagtgtagtgtcttggtcctggctcactgcaacctaaaactgctgggctcaagcgaacctctccctctgcctcccgaggagctggggttacaggcacacaccaccatgcccagttaatttttttattttttgtagagacagggcttactgtgttacctaggctggttttgaact

SEQ ID NO: 65386 - DNA, 1020 bp, Homo sapiens
aagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggtgagcagcgtgggcggggagggggcgcgcgtagggtctccggctatgcgtcggctgagagacaccgaggccggctcccgccgacactgccaggcttcccaaggaaagaccgttacttgcgcccgcggtcccgcggcacagtgtcccatctcgccaagcgcgtccttcccttttcttttctctgacccctccgactcttctcttcctcccgggtccccgctcgctgcacttcctctgcttagagctgcgcgtttgccagagttccagcggacctcctggagcgcttgaacccaaagccccgtttcacagatgagaataccgagtccccctggaagaagtgactggtacttcctcccctctctctgggtctttcttgcccttctcctctccgctttcctcggtctcatcccagttgtcgctccccgcccccgcgccgcccgcgttccctctcctcccgccgaggctgcagcggccgcggcggggggagctggggctctttccctccctttggtaaacacacccgcccgccagcccatccgccaccgctgcccttataaagtcagcagccgccagacttcctgccgaagtccgagccccctcccggggctggaggggggcaagcgggttccgaggtgcaaagcctggtgccccgagccctgcggagtgagtgaggggcgcgcgggggaggagggaaccgaggagagcccgtcctgggtctccctccacgtggcagctgttggcttggcccgagagactgtagggtcgtgggt

SEQ ID NO: 65387 - DNA, 1433 bp, Homo sapiens
tttttattggcttaagctctcttgattggttggtttatcctgaaggctataaattagaaggatttttaagtgtagactgtgaggtcagatgacctggcttcataacccagctctgtgtgatccttagaaaattactgagcctctgtttgccttaatttcctcatctgtaaaatggggatacatgtctcttagggttattgtaagcattgcataacagaatgcaggtaaagcacttagcaggatgcctggcatgtagccagtcctcaacaaatggtttctacttagttagtcatatacatggacttagacaagtttcctacttgcaaggaccttccagtggttgaggtgtaaactgaggatttacactgctttcttgggggaggtgaaatcaatatagcagggctggaatggtcaaggttcctgggatgtcacaggatgctgctgacatgaccttgcccctccctccctccagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatatatatatataaacaagtttgttgacacctactatgtgcaaagcagtgtgcttggcatttgagagtaaagaaaacagacacagcccctaccagcagagggagattaatgagtgtttaagagtaagacaggccgggcaaggtggctcatgcctgtaatctcagcactttgggaggctgaggtgggtggatcacttgaggtcaggagttcaagaccagcctggccaacatggcaaaaccccgtctctactaaaaatacaaaaattagctgggtgtagtggcgggtgcctgtaatcccagctactcaggaggctgaggcaggagaatcgcttgaacccaggaggcggaggttgcatgagctgagattgtgccactgtcctccagcctgggcaacagagtgagactccatctcaaaaaaaagtaagacagcttaggtttgcctgctgtctgctgctttttgtgtggccctgcacctgtcacttttgtgtgctttagcttccgcatctgtaaaatagggttagccccctgactaatcctgtt

SEQ ID NO: 65388 - DNA, 1037 bp, Homo sapiens
aggcagtggtaagtgacacatgacctctgaattcaatgtggccctgatgatggcgtcgccatttcagaggtgtagcctttgggctgggtcccggtcgcctctgttcagcgtatgatcccattcccagggccctggaggttcaggttcgtgggttagagagttctcctccggtcctcgatctcctgaatagaggtgacctccaggaactggggcatcagagatccggggctcgatttccaggctcgccatagacgtcctgtgcgaccttgggctaggcctcagtttccacatccgtgaaatggggtggttaagctcactgaggttagtggcccgtggtggtctggcgccctgtgagtcctctgtatcctctagccccaggggtaggagagtgaacggcggcggtgggtgctgatggtgatgtctgctcccaggattaggaggccagaaggagatcccttccacggtgctaggctgagatggatcctctcagggcccaacagctggctgcggagctggaggtggagatgatggccgatatgtacaacaggtaaagagaactatgtgctaccctgtcttggaaaataagtcttggtcacccttatcgaaggtgaatgacttatgacaaattccttcctgaatgtaggggagcctgaggcccatgcttaccctccccacacccaccttcaaggttgatcctaatgtagatgcagtaaagggtcactagaatgagttgggcatttagatggggatggaactggcaatgcaggagccaagcaggaagagaaactccaatccaggctctggttaggttccaagaaaagctgagtatttgcctcttgacaaatagcacatagccagcccatttagtagttaacattttaaaaccctttattctgtgtcaggcacttgttaatcttcaaaataatccagtgggttaattttattagtcccgtcttaaaatgaggaaattgatgattctagaggttaagtaacttccttagggtcggcagctggtcagtaacaatgccagaactagc

SEQ ID NO: 65389 - DNA, 1085 bp, Homo sapiens
aacatggtgcaatcccatctctactaataatacaaaaattagctgggtgtggtggcgggcacctgtaatcccagctactcaggaggctgaggcaggagaatcgcttgaacccgggaggtggaggttgcaatgagccaagatcacaccactgcactccagcctgggcaacaagagcaaagctctgtctcaaaaaaaaaaaaaagagaagcaaagccaggttccaaactcaggtcagacctcagaggtgtcctagctctacccacatgtcctcaccagaccacattctcccccaagttagactgagactcacgattccttctcaatgtcctcccagtgctgggcacagctgcacacacccccttagactgcagtgccacccaccctccagccccacagccccctccctgtgtcctgcagtgctggtcccagcctctctcacacgtctttggacttctccatatagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcgggtaggacacaggccaggggctgggctgggctttcccataggaaccctgggttggtgggagggtggcctcaggggcagtgggaacagcccaggccaaggcaggaggactgacacctgggggctggggatcctcccagtggggcccttcatggcctcctgcctctctggcttggccttgcacccctctcccctcacagggcagcttccggccccacggccttgttccgcaacactaaggcagccggggcagccattggtggtgtcaagaacatgctcttggagtggtgccgagccatgacaaaaaaatacgaggtgggcatggggcagagctgcgtgggtggggcaggggtccagggagggtccaagtggtgcaaaccccaaagggtgggagggtgggaagggggccaagtccaggccatctggctgagcctcactgaggcctcctctgtgccctgcctgccatagca

SEQ ID NO: 65390 - DNA, 1014 bp, Homo sapiens
tgagaaccactggtttgtaccaattcattgttccagagaaatgtgacctgcccttgagtgtctttatcttccccaacaagaaaaggcctgtagtcccacaagatggactctaaaagaggggcagcattcctttgtcaaatacatttgagaagtactgcatgctgtgggcccacagcttggtcaatcaccatacacaatagcatattaaaggctgtgggaagttctccagtgaagaaacctctttagccgagatttaccaaatgtacttgaccttggaacccttttcctgtactacctattaaccttctgcaggacatactgtacttatgtttcccatctgggccctctgccctggtgcttctccccttctctgctttatggattcctgttcattctgcatggcccagctcacagagtgcaccctctgtgaaaccttccttctcccctctcatctccttccttaccgtatatccatacacattcacataatcacatccatgtttcgtccattactctattgaaattcttgaggactgggtcctgtctcagttaaatgtcagtagaagatgctcagtaatggctgttgggagaattcagaagggatattcaggtgtttgggccacagttttgggaagatgagtcactccttgcccccttgtttccccacttggtgtgtagagttcttctctgctatggtcttccggagtcatttcccttctccagccctgatctggcagagtttgaagcggtggggtcatgtctttgctgcagatgctcagtcgatgcttacggaaggaagaaaggaagagaggaagggaattagaacctagtgactttctaggaagaaggctagagagcagaggttaagtaccctgctttcaggagaaaagcctcctaagagcacttactcccaagttttaatatctgggagaagtgatctatttttccctgcacctagtacctaggtgtaccagagttgtggtgaggccacagtcagaaaattcacttaaagca

SEQ ID NO: 65391 - DNA, 1021 bp, Homo sapiens
gtgagccactgcgcctaatttcatctttcttatcacctctccttgccatgaaacatggttagtggctgcgaccttattttatatgttcttgtatagtcacagagttttacaagcaatcgtgcctattacatcactgtgaaatgatggaatgttcaagaatgaaaagatacatccctctaccccacccccaatatataatagcccatttttacagcttcttcccagaggcatggctttgtaagtgtctggattggtgactcttatgggagtgtccaacaaatgacctggagagaattcaagcagggtcttaccgagcaggacctgggtaaggaggctggcgatgctgaatggggaaaaggccatgttggtctccaccttcttcattgctgagaaggcgtggtagagcttcagggagaaatctaccaaagcatcccccaacacggcctctgttgaatgactctccaagtcagagcagagagtaacaggtcctgggcagaaggacccagtagtgggctgggtaggagaatctgttgggagctgggtagttggttgggtgggttggatggtgggttgggtggtgggctctgtggtgggttgtgtggtgggttcatcagtggtattagctgttattttggtggctgaattggttgttgagttggttgtcggcaagctggaaacctccaggatgggttcaacgaatagcatcttggagataactgttgttgcgaccttcccttcgcctctgtcttgcaaactctctggatcctgggagctggagctggtagcatttggatttgaggaggctctatcctgtggttcaagaaactgagtttcatttttttcttactacgaggcacagtcctctaaaatactcaaagcaggaagagaaggtgtggatgtggaaaatgtcctgtacaagagagtaatttctgacagtgcggcagatgagcaatctgtcttagaaccaccaccactaattcctcagagaaggggcaatacagggtgagggtgggggtgcaca

SEQ ID NO: 65392 - DNA, 4702 bp, Homo sapiens
tgagtggatcccctgttgcagaagtacttctggtcaaggaggggttggagacgggcaggaaattgcaccccttgtatcttccaaggtctccaaatccagcacgaggggcatctgggaacagggtttctgccagccccaccttggggccgcatttggcgggaactggatctgccttcacctgcagccctgtgcggggcgtgacggaaagagcggggagaggggcgtcctggtgcgggggttgttgaggtgagaagccaggggagggggctccgggagcgccctgacctcgcggactgttgggaggcggaggggatgggggttgggggagaagaggggagcctggcagccaatgggagggaggatctcgtttcaaaagggttaacccacagccaatgggagcctgggggagcggatcctgctcactccattcaagaatcccaagtattcaagatggacggcagggagtgtggaaggagaaagggggcgaggggggaagagcgagatcggcagaggagagggtctccgcggcccaccggcctcgcaacctcggtcccggccggcgggtggcggggcggccgctggggatccaagcccggcccgggagaggggctggcggggtgcgagagggcgtgagcgagggggagcgaggccagggaggggagccaagagggagggaagggcagagaaagagcccgggaagaaggaggtggcaggcagaggatcctaacgaagagcaatgtgtaggtatcgagagcttcccgaagggtaacgacaccgattttcggttttattctctcttggggaagggagggggacggtctgggctctttctctcgtcttcctttttccctcctcattctccactcgtgggcatcttttctattttttcctttggaaacactgtaactgggaagcaccaggcgtgtctttctgaggtggcctcactgtcattttccagtggggggcgtggtggggtagggatggggggctccgctgggcacggccgagctgggccatctgtctccacctgggttgtgtgcgagggcgtggagtgttccgagggggaccgggggccgaagggctggagcagggcagggagttctgcacctccagaagttgtagggtgagccaggggcggtgtgggggtgtgaggctggttttcgagctgatagttgtggggtgttgaggggtgcggggatgtgtgtgtgtggggggcgtgcgctcacactccagttcttgttgtttgggtgtgtaatgagggctgagttgtgcagcaagtatggctgagagtttgtgtgtgtgtgtgtgtgtgtgtgtggtgtgtacgtgcgcctgtgtggtccagcctcgaggtgtgtgtgttcggggggagcacagttgggtgttgaaggagagcgcccctcaccccccacttcccagctgcctctctcatcccattcacagaacatggctttcaggaccctcctggtctcctcctcccgtcgccatggctgcgaggagggggtgggaggagacagttggggccagccccctgcccctgctgctccagctaaccccccacctgccctttctctccctttcacaggctgggccccatcccctgctgctctgggggcaggggccggaagatggtggccaatgaggagggggagaggagagaacttgagccggggcctcccctcccccatttcctcctcggtctctacactcgcttctggaaggagctgggggctggctcctgggcccaaggtgggggaggggtcctgctggctggtgagtcgctgggcctgctcctcaggaatgagttgggtgtgtgagagctgaggggctcttggccctttctccctgcactccctaaggagagacctggaaacttcttggggaagaatcttcccctggcctccctgaagcttgctgtgcagccttatctttgcccctctgccccctgttggtgtgatccagttcccagctgggcctggtttgcccaaccccagagcagagaggtcactgaccctcgaggggtcttggtttccgcccattaaaactgtagggcagggccccatgtttgcagattacgggaacaaactctgccggggagagcgggagggaacgtctcctgcttcctgagggggtgggacgaggctagagggaagcccagaggaagagctcccaactggaattctgtcctctattccttacggtggctgtggattagggaagaaggcatctccccttcgttgatcggggcactggaggaatcaccctccagcctctgtttctctgggctgcccaaagttcactgggtcagaactggagctgggctccggggctgtggccctagctggaatgtgccacaatagagcctgcctgggtctgagcctccagatatccaggtgtccttccagggcagctttctggctttgggtgttaatcttccggggactgtttgtcctgtatttaagcccccttagggttggataggatggggaagtgctaggatgagcttgaagactccccaaccaagggtccctggataagacaggaaataactcagatgtgaatcccactgccagtgaaagcctatccctaactctcagtaactgtgagcgaatcaccctcaccattttaatgctgaatctgcaaagtgctttcaggacctccaaaaggagatgcaggggtggggcttcaccagcagctttcacctccccgcctggaagcttctctctactgcgtggggagctgtgactacaggctcccacctctctggtcctggaaggtcatctgagagtgttgccttgaggcctagagctctgctttatctaaatttaaaaggagatggaaacttagagaagagtagagggttctgtagtcttgggcagcaagctcctctctagaaggtaagctagcggaaatgcaaatccagatgaacacagcctcatacgagtgacctccagactttggggattgctaatagccgttttctttgaggactgagcatcaagcccgaagtatccctgcagctgctttagtgggtcctgtcctcccatgccaaaacctccaagaaaaaggtggtctctgtgctgggggtcagggggttggtgaagaaggcggcaaaaggaagagtggtgaaaaaatagaatgaacactaagaatggaataaaagggaaaaaagctgtattgaagcaaagaaggggcagagggagcccgtgagctgagtgggccagggactgggagaaggagtgaggaggcagggccggcatgcctctgctgctggccagagctcttttcacattgtgctactgtctgcacctgtcactagcagtgcaatgttaaaagggcattggccgtgtagtgctacccagcgctggctgcctcctcagcattgcaattcctctcccatctgggcaccagtcagctaccctggtgggaatctgggtagcctcacttgttagttatactaatagctctcatttatggaactacttctgtatgcagtgcttgtgatagacactgcctccgttactgtgaaacctaataacttctgggaggtaacagccccattttatggatgaaaaactgagggtcagaaaggtttaaacagtttggctaagattgtgtagctcttaggttgcaaagcctagatacaaccctgtgttaagtcttgacagctcactcatctttttgtagacccatctggagagatctgaataggttcttcaaactgggagatttcctgagctgaggggtggaaggttttgatgccatctgctggttgtatgaggatatcttccaaagcctcaaacctttaaggaccagaagtggtggcaactccttaggctaagaaggataagcattcccagactcagcccggaatggagagtgagtggaaaaagattaggagaatcactattaggtacagagtaggcctccttgagaaaaaaaggaatgcaccagaaaggaaagggggttaactcgagaggattgctccccaaagaaaaggacctgtgtgctgctggcatcccatacctacagctccttccctggctcatgaggcatggaaagacctcactccttccctgaatccacttacctttctcagcaccactccctcttggtcacggggtgtttgatggtaatgctgcttgagggcacacctgtctgggcatccaagatttggacagcgttgcccatgacttaatcttaaagattaataggatcccttgaatcaacccacagaatgattctcccaggaccaattacaaggaaattgaggccgggtgcggtggctcacgcctgtaatcccaacactttgggaggccgaggcgggcggatcacctgaggtcaggggttcaagaccagcctggccaacatggtgaaacctcgtctctactaaaaatacaaaaattagccaggcgtggtaatgcacgcctgtagtctcagctacttgggtggctgaggcaggagactcttgaatgaatcttggaggcagaagttgaagtgagccgagattgcgccactgcactccagcctgggcaacagagcgagactccatctcaaaaaaaaaaaaaaagaaagaaaaatttgagagcaatgactcagccatttacttctctgtctcccacagtgcctagtaggcttaattaaaacttgttaaaataaattgaatgagaggaatatttggggagcttctttaagaaggcag

SEQ ID NO: 65393 - DNA, 4843 bp, Homo sapiens
aaatgtcccttgggtcatatggtggcattgatgttgcgattttgagctttttttttttttttttttttttttttttgagacggagtcttgccctgtcgccaggctggagtgcagcagcacgatcttggctcactgcaacctctgcctcctgggttcaagtgattctcctgcctcagcctcccaagtagctgggattacaggcacgtgccatcatgcctggctaatttttgaatttttagtagagacggggttttgccatgttggtcaggctggtctcaaactcctgacatcaggtgatccaccagcctcggcctctcaaagtgctggaactgcaggcgtgagccatcgcgcccggcctaatttttgagctattttgtttcacttcccatcaactgccagagcagcactttggctgactgattttccttttagccttaagtgtgcccatgaactgaccagagcattacagaaccaggctgaaaagccacgggactcaagaaaatccttattctgagatgagcctctttcagagcccgatcctggatctaggcaaaatggacttactgtcaggggtgccagcagacacaagcggttttggatgctctcgccgagtagctaacaaaacccacccctcttactaaggcaaaacttcacctgaacgcttattccccggtaaaagctcaagcagtagtcttgccatagacagggcaactgctgccccctagtggtataaagggacaggcccgggtgggtgggggtgtgtgtgtgtgacggggacagtttatgggtacatgcacagggaaagaaagtcagaggacaggttgcctcaagttgctttttccctttttattaaaaatagactcaagcactttatgtatcatacaaaagtttcattcgctggtggcagccacgggaaagactggccccgtagcactgattttccacctcccctccaggggactgggtcccaggagcagtgactgggcctcagagaaagcccataaagactgcttactctggaagcagccgactaggggctgttccgcgagcagctgtccccaccccacccaatggcaaaagttagatactcgaaagtgcctcttcagtgccaagataaactaacaagtggagtgaaatggaaaaccctttgattattttactatttcccagggcctgggatttgagttttccctgcactcaagtccttttccctacaaataggggtaggaaacttcatcctcagagactctggtctcctggtgtctgagaccagaatttcactccaacccaagtcttttctcatctgctgttctgtggtccatgatctacttgccctgtgacccaaggtttgtcctctgttcactcaaaaagaggtggagcaaaaacggattcctcccacaatcctctctgcctgagtctatgccctgccatcgcttccatgttcaggatcttgggaacagaaagacccacaaccatccctttcccccagttctgtctctccctgactgctgcccactcctgagccttaacacccctggggtacccccagacccctgttctaaagggtgcctggtagtggatatggtggaggcaggggaggggttggttggagccaggtttcccccaggggtggggcagtactcatgctggtatagactgcttggcagggccgtggggagggaggggcatgcggaggaagggcacaccctgcctgagcccctcagtcccagccgttgtccttcaccatgtgtgacatttcaatgatgtatttcccttccttgtacttctggctcgtctcaaaagcttgctcctggtgaaggagaaagcagtgattgtaggacaaagcagtttccttccaggccccactgtcacctgtatggcccccaccccaagggtcatccacctagcccaacccagtgactagttctttctttcctctttggaccatgcaaggaaggacctgacatggtcactggtgcttgaagggccatggggactgccactttagagggtgaccctcttcctcaggtacttacatatttccagcccagtgtggttttgcagctctcacagaaaatgtcagctaccgagtggagccccgtgagcaagaggcgctgttcagctggcccgcaacccacgttgaccctgtctcaggaaacaggaaggacccagcacccagtggggttgcactgtcagtccagtccccagacagcccaagggaacttccatctggagagaactggacagcccctgcctttgataatccacccctttaagactagagcctgggccttctttttccaccgttatgatttcaattctcccccggctccccatgtgagaacttcagattgagaccctctttgcaaaaggggaggcaaagactgaaggcacaagatcacctgatggattcccccctttctccacagaggaaaattactcactcacacacaagcacaagcacacgcacaaggaaagaggtagactcacacggagttaaacaggtaggctcggccatggctcccttggaaggactgtggagacataggacagacaatgactaccaagcagccttcagccccactgcctgaatccccgcaggggtgtgtaggagagaggaagagctttgctgcctcacccctgggtgatgttcaggctagcctggtgcgcgagaggaggggaatggcaggtccccgcttcgcgtaccttggaaataagctcatcgtgtttggccaggtgtgcacggcagtggacacagctgtaagtgcggtgacagcggggcagatagctgcggaaagtcttggtggggaggcaggcagggcccggaccggggtcacagctgggcatgacgggctggaggacaatgccctggtgggctggaggggctggcgccgtgcagcccccgcagagacggtcgcaggtgaagcagcggagcaggttggctagagccgtgtttcagggcaggagaagtgttggggggctgcccggccagggcccccccagacgagaaccagatagaaatagaagtcacctgggaagaggggaaaggacatcaggggagctgcgacctcaggaggacccctcctgagggaatggaggaaaagggaatcagctcacccatacctctactttccccatcaccatcgacccccccacagcatccagttgcattgtcgccctgtcccctggatccccattctgctctggcaaacctggcagccgatccaggcttctggcgccaaagccagggagtcggtgtttctccctcctggggcagaagcagcctccaccattttccacagagagaagcccacgggcacagacgctgccatgggagcaacgtcatctgcaagtgccctctccttggttttcagttcttcgtgaggctctgcatcgcacaggcactgtgtctcaggggatcagagccttttaagagttggggatgcctgaaggtctttcttttacatggtctttgtttgcaatacaattggtcctttatacattttggggaggggggcaggaggtgtaaggtgaggggagggagagcatgcaggcaggtatacaaaccctgattcggttctctcctgaggtcagggtcctgtgctctgggactcttcactagaactttatagatgtttccaacagtaccaaagccctcacgtgtggccgcccattctcgcaccttggttcactcattctggcccagaataagcacctgcctgtcttcccagcctgtgggccccttggtctttctctctcctagtctttactaactgttgccttagcccttggttaaagacttaggcagaaaatacattttcttcaggcaatctgacagctggagccaatgggaaatgggtagcatgtcagaggagcctgattcctgggctgggcagggctgtgtggtagggtgagagcaacggccacaacgaacagcagaagggggactcttatttttaacagctgtgctttggggcacaaggcagaaaatgtttctttctaccttctcccaggggcagggacaaacagcagtgactctgtgggtgactgaagatgaagtaattgctgggttctgattaggaatagaggaagattgccttctgcccacgcgccagcctccgagtggctgaaggtgctggaggcagaggataagaagggaggtggcccctgttggctccgataagcaggtgagctgctgctttctccttcatagggcttcccagcccactgtgggtggttagcctaagtctggttcagagatgccagctgggcactctggcaatgctagagcactaagcagagaagaggcagtgttggctctggttagccagggcatacaggctctcctcgtcctgtcctccgcagtggccacaggcacccagctgttccactctctctgaaggccgccaggcagtctctccgcaaaacctccatagagactatcttcagtttcaggtcctctcctccgggctgggtcccaggaagacaccttgggctgagttcagggtgacattgggctccggctgcaggaaacgggccctccttgccaagagaccacctttcagtctctgcttcacaggtttgccttcaactttgccagcgagttcccctctgacatgcaccaccttgaaacaccttcttcaaggggcatggagaatggggcagcttgggtccccaatcctgagctccttctccagcctccggccgtcacgcctccctccctctcccctaattcccagtcaagccaaggaaaggctgcacagaaggccagagaatcacaaaggggagtaggggtcattttttcacccatctcggatcacagggagaagcaagttgggcaaat

SEQ ID NO: 65394 - DNA, 1036 bp, Homo sapiens
agcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataaggtcagagccagagaaaggtggggtggagggaagggctgctatcagggtaggaaactggagaagtttactagttaacactgcattttctcagctggtatttctgctgcattactttagaaaggcaattccaaatatgtcagtctcagattgttaaacatttctgtggatctattcttagtaatttgttagattttcacttagggcataaaacaggaggcagaagcagcaacataaaaattaaatccatgttatggtatcaaaactacagccattaaaaatgtcattttttcaggctgggtacagtggctcatgcctgtaatcccacaacttgggaggctgagacgggtggatcacctgaggtcaggagttggagagcagcctggccaacatggtgaaaccttgtctctactaaaaatacaaaaagtagctgggcgtggtggctggtgcctgtaatcccagctgttcagagactgaggcaggagaatcacttgaacgcgggaggtggaggttgcagtgagctgagatcgtgccactgcactccatcctgggcaacagagtgagactccatttcaaaaaaaaaatcatttttcttatatctaatagcacttattctaaagaggaacaaagtagccatgggtttgtctgggtgtttttg

SEQ ID NO: 65395 - DNA, 1700 bp, Homo sapiens
caagtcagttttcctctgaattcagagtcccttcttacccacatacatgtaagtgaaatggaaaacagtctttctttcagaaagtactttttaacagcagcctgtggaattttagccttggtgtctaagaaataccctgaaagaattctctgataaagatacttgtttttctccaggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgagttttctcccagcaggggtgtttgggtgggtggatactccatgggaagtgaggagataacgctttctcttgagttttgcaaagccaagtgactgagagggctcagcgtctggtacaggtaaatccaaatcccagagacatgtaagaaaaatgagaaaaagcctgtcctttcagtcgtgttatcagttttacttcgctgaatcttctacctaccctttcctcctttattttggaatcatagatgtcttcatatttttctacccagctccatcattagatgatcctaagctaggaaggaagtgggaggaaaccaccagagaggcttaaagcagtttaagcagtcaatt

SEQ ID NO: 65396 - DNA, 2241 bp, Homo sapiens
aagttcaagcgattctcctgcctcaggctccttagtagctaggattaaaagtgccaaccaccacacctggctaattttttttattttcagtagagatggggtttcaccatattggccaggctggtctcaaactcctgaactcaagtgatccatccaccttggcctcccaaagtgctgggattacaggtgtgagccaccatgctgggccgactaaagcctttttaaatgctaatggcttttttccaggatgtctgaaacttaggtttgagattgtggaaactgagagtattggaaaatttcagaattgatttataagatacaccaatgagagagttttggcttttagtgctacccagatggttttctttgtactcttaagaacagaagcctggagaagtgaaggccactgagaaaggaaagggtaagttgtatttgggaagagagtcctaaaagagtccctttatgttagtttctgccgagggaatgacagtaattttcccattacttggttctgttgggaaaagcagttggtatgaaaaaatttcccatttaggatctaggatctgcatcattctcactttgatcttcagactttcttcatttacttgttattggaagagactgagtgatttaaaccttccctttttcctcagttttttttttttttttattaagctcttgaccatctggaaggcatccttgctgttacctgtttataaattaacatgtaccaggcttctgagccttatactgttgagtcattgatttagtgctctagttgcagctcttggaatcatcagagcatgctggatcttctgggaagttactttgtcatggttcaggctcaaacctagttgtgaagtgttattcagagcaacatgaggttgctggaaagaggaagaagtgaattgaagtggtagggaataaaaacacttgggctcattgaagtagagattattggggtggaggcaattatacacaagttaaatctgaggtaggagggaaggaaaactccccatatttagctttagaagccaaaagatattctgaaaaatgtgggtcacattgtctaaagagtcagcaaagtaatactgatgtatttctctagtttttaaagaaggagagaaagaatcactatctaaggcatgaacaccatcctacttctcacctcctctgaagcagagaagttgtagattttttggcccccagctctgagcttgagcatacctgctggagtctctcaaggatctagagacagtgctgcttttctctgacttaatattttcttcataaccttttcctcttgcttaaactcaacatgttcagtgctctgtccttcttcatacatttactaccagaaagaggggtgagtctttggtgtcagaacttgttttggtttttgctaatatggccaggaagtagaatcaaaattttaactaagggacatttatattatatcttagtatcctgtagcaattttggttctgggtcaagaggggtatgtacaagaccagtttgacacccttaactctgctcaattggggagggtctattttcctttaagaggcaaagcctttggagaaggaaattgaggggactaaatgatttctgtctttcaagctccctcttcttgagatagagcaagctgaatccttgtttttaatttgctaatctggaaccattgaagtgtttgactggttataccagtttgcctacaaagagttgtcctgacataggcattttctcaactgatagttgaagctgtttaacctactttctcattccctggtgccagtaaagtaggagccctccttattccatggtctcttagctctaggaaaaaggattttggaggacaatattgaccttatttggaattattgcctctcatccaaagttagaagaaccctaagtcatagctggagttccttccccctggcgctagtttccacaggaccaatttctgggctccatcttttcctaagcatctcccctagtcaccttgtgggggcacaaacacactgtttatcttactctagcacctagctcgggtaattctgaaattctcatctcctcttctccatctgactagagtatttcctctgtaagcatatatctgggctgaggcaccactgttcttaaaaactatcctctcatgtattttacctctttcgaggttcagttccctggagaatcccctgtttaaaaccatacaacctaaaaaagagttcagggtttcaa

SEQ ID NO: 65397 - DNA, 1045 bp, Homo sapiens
gataagatctctgcttcacgtgatttttttttttttttttttttgagatggagtcttactctgttgcccaggctggagtgtggtggtgtgatctcggctcactgcaacctctgcctcctgggttcaagcgattctcctgcctcaacctcctgagtagctggaattacaggcgcctgccactaagcccagctaatttttgtatttttagtagagttggggtttcaccataatggccaggctggcctcaaactcctgacttcaggtgatccacccacctcggcctctcaaagtcctgggattacagtcgtgagccaccgcacctggccacttcacgtgatctaagggaaggataaagtcagagttgtatggaaatccatgatggtcttttcaggctcccatccattatatagtttgcggcttttcagtttctgcctcagtcctcttccaacccttttacccacaggaagttggccgacctccatggagttctctctggtcccccctcccccgtaactgcagaggtattagcacctgatttgagtgggagcagccttgtgatttagcacattaatggagcagtggttgtgccttttccttctcacattgttttcttatccaggaataagtgcccaggtcctacgtctcacattcagctggttgaaagtctgggtaccacaaatcaggtgttttcagagaaactgggttgcccacctgtaaagggagaaattgttttctcatggaatcttgaggaaaggatttctaaatgaggatccccatgggcaggaagtggaacattcatttcagccttctctcatcaacaaggaacactagtcatatgctcaagcaatatgctaggcatgggcagaatgcatagacctattctttaggagcttagtgtctctgttttaagtgtccttgaattcctagtatttcagataggggaaggtagaggtggaataattgatgatgatgataatgatggtgatagttaataatgttttcttttgtcttctgtccactgaatgctcagtatcaagccagctag

SEQ ID NO: 65398 - DNA, 1221 bp, Homo sapiens
ggatgcattagggagtgctctgaaacagggtttcaggagtgtggatattggaatccattctcccaattttatttatttttattttttattttattttgtatatatattttgagacggagtttggcttttacgcccaggctgtcgtgaagtggcgcgatcttggctcactgcaacctctgccccccgggttcaagtgattctcttgcctcagcctcccgagtagctgggattactggtgcccaccaccacgcccggataatttttgtatttttagtagagacagagtttcaccatgttggccaggctggtctcgaactcctgacctcaggtgatccacttaccttggtgtcccagagtgctagggttacaggcgtgagccaccatacctggccccactctgccaattttatttggtcttgaaaacaggagtgctgaatggatgggcagaagaacccgttctacctgagatggtataggtctggtagtcctgtcaatgagtcagccagccttctgggctgtgaccactccctaggcttttagagctttatgattattgccatagtctaaggacgagccccaacatctcctgttctgagctctggcctcatcttccatcaaaggcaacagattcagacaggccacttggggtggtcacctaggaatctggcaaagtaccatagcaacggaaagcctctccttaaatcaagcagaatttgggatatggcaagaacgggctctgctcacacatgcctctccttggtggggtgttcccttatagtgctgattggaagcaatggttctgtgaatctaggagcaaatattgtccatgaagttgttatttgcatcatttctagattctggcactgtgggggcagactttattttggcaacagatactggaattccattccaggattacacactttatctggaccaagttgatatccagaaggttgtagggtaaagttcatcatccagggataggttggcaggatccccaagaaactgagttgctttgcctaaaaatgaaactggctgggcatggtggctcatgtctgtaatcccagcactttgggaggctgaggcgggcaaatcgctttgagctcaagagttgagtccagcctgggcaacatggtgaaaccctgtctctacaaaaaattagccgggcgtggtggtgtgcatctgtagtcccagctacccaggaggctggggtgggaggat

SEQ ID NO: 65399 - DNA, 1052 bp, Homo sapiens
ccttctaattatcttcccaggctgtaggagtcaagtgagtcaccctttctcttcttccccaggcggaaattgaagtgacaacttagtactagggaggggctctgacctggatgactggttttcagtttctctccctccttcttaaggaacctaggaggtcaggctttggggtgaggcggtgcaggaactcttctttttgcttatattccactccaaaccctgccaatgtatggagacatcttttctgaaccaaagaactcacagaggaagaagcttccatggggggctttctttgaggatagtatagaactatgactgaaggtctgtttagtccctaaaattgatgcccttgctccagcttcgttattttgtctgctaattgtgtactgacatatcaagagaaccaaacagctaatggatatttactatctaaaaagcctggcatataataaatactaaaaacttttcaaaatgaatggctgaatggaatttgaataaatagatggtggtggtaaagatttgtgagatgctttgtgacagttttgtctcttatcttgatttgcttgtatctcgttaaggaactgagttcctccaaactgctctgagtcagtctcagggctgtgctttttgttttggtgggtgcagataccttttcttcacagaatcccagactgctgtggtttaattctctggaatcatatgctgtcttgttctcctgtcctcttcttcctttccttcagtgagttcttcctttgctttgactggttcagataaaggggacaaggacagatgctgtcctcattctggagattaagttctcagccacaaagtagattagagtatttatccactgtcttggtagtgggaacttctccctgagctgagacgagagtgtttgatactactgacaaaaaagtagcacatcaggttcttccaaaacttccagctcccaggaaatcagcagagaaaggaagagctcttgaagcattcctacgtagattcaaatcctgaaagaaactgagtttaattctggactagagaattgttttttt

SEQ ID NO: 65400 - DNA, 1088 bp, Homo sapiens
cttcatctaatgctatacccaaactgattcttgtgccttgtcttccagtatagttgagaaatatatgataggcagtggctcatgtctataatcccaacatttagggtggccaaggtggggtgatattgcttgaggccaggggttcaagaccagcttgggcaacatggcgagacccccatctctacaaaataaagtaaaataaattaactgggtgtggtggcatgtgcctgtaatcccagctacttgggaggctgaggtgggaagagcacttgagcctaggagttgcaggctgcagtgaacatgatcatgcgtaccactgtactccagcctggtcaacagagtgagaccttgtctcaaaaaaaaaaaaaaaatacatgagaattgactcccaaatacctccctcttatatcaatttaatactttgagttgccataatgctcaatttctaaatctgattttccctcccttcatcaatccagtctaagggaagcctggagataacagagagccagtctgcagatgctgaacctccacctcctcctaagccagacctgagccgttacacagggttgcgaacacacctcggcttggctactaatgagggtaagggctgccttgatttgcaagatactagaactaggggcaggattgagaaggttgcttatgagctgtggaagacaggcaagggctgggagatattactcgtgttgtgactttaaacacccaacagttggtacttgtgctactttgcaactgaaagagaagagaggccatttagctattggcagtgaatgggacttttgccgggaaaatggtcagcctctaggcagaccagagaacatcacagaacctttttggtgcatttacccaccctgaattctgggctggtgtgagtctttaaaagtcttgatttcagcgaagggtatatctattcctaccttgtcctctccctgtacttaaggaaccctaggcagataaagtgaacaactcatagactagacgcagtggctcacacctgtgatcccagcactttgggaggccaacgcaggaggattgcttgagcccaggagttcaagaccaccctgggc

SEQ ID NO: 65401 - DNA, 1091 bp, Homo sapiens
ctttattgccctgcttaaaataagcctgattcccaatctctcctatgtactactactctctagtaacagctatcacatgtacttactcccaagcaaatacttttaggaagatagcattatggaaaaagtattaatcttcagtctcttaacaggaattgcccatgaaggcaggtagagtcaaagtgaaaataaagagctaccaggatacccctgggtccacctacattaggatgtacaacagaagccctgatagcttttgcagagcagtatgctaatttgaaattggctaagggtcaggatagtactaatacttacttgggtgtcagtaatggctgcaaggccacttcttctgtctcagagacaccaggttgggctttttggctgctgtaagacatcgatcggcccaggtatggggctgttgggcctggttcaggggaccctactccccggccccttagcccatctggcttgccaaaacgggggacagctgggcgtcccagtggagtcttgcccaaaggtgatctctttgaatcatctgaggaggaactagtacgaggggcatggcccgagcctggtgttgactgaatgcctgagtcccccaagcctggttcttcctcacggcccgggagtgggggtgactggcgcagcaacttctctcgttcctggagagaggccacaatgtggcgcgacagattgtcgtaacggactggtgagggctctcggtgtgttgggccagttggcaccaaacgtgggtgcctctcagcttcccgttgctgggccagcctggctgacaggaagggagaggtatagcctaaaggtgggtctggctcaggccctgcctgcactgactcaaaatcagggctgtctgaaggtgtgagcaagctgtcataagataggcttccattgcgtgtctggttggccaggctcttataggaggtggaggtggtgccctctgaacgaatggattgcaactggcccagctcaaagcctgtgccctgggctgacttgaggctggaggagcgtgagccactggatagtggatcgaagtgaaaacttttgccaaaggtaggagaacggaagctctctggttc

SEQ ID NO: 65402 - DNA, 1773 bp, Homo sapiens
aacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaagtaagtattagtactatcctgacccttagccaatttcaaattagcatactgctctgcaaaagctatcagggcttctgttgtacatcctaatgtaggtggacccaggggtatcctggtagctctttattttcactttgactctacctgccttcatgggcaattcctgttaagagactgaagattaatactttttccataatgctatcttcctaaaagtatttgcttgggagtaagtacatgtgatagctgttactagagagtagtagtacataggagagattgggaatcaggcttattttaagcagggcaataaaggggaatgtttgggtaagaaagtatggatatagaaaagaacatcatttttttctctgaacctttgaaactgtctccctttccaatgttttctgtcccatttcctgacacctacgtcttgtctcttctttccagagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggtgagtctggaattttggtcacaagagggaaggacttggagaggagaattagttttctaggctcattggcatttagtttccctaggaaaggggtcaaaacttcaagacactggtggtggtgg

SEQ ID NO: 65403 - DNA, 1048 bp, Homo sapiens
ctgatcaaagccaaggctagttcctagttgttcttaccctgcttctttctcccccagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaaaattacatttatcaaactggctgaagtgtgactgcctgttaagaggtatgtgcctttctgtgaatcaggatttaagacaaggcattcctaagacttgaggggatttgggtcttgtcattacatgatctcactagcaggcagggaaccaaccaaaatgaaaagtgacccaagcttactaatactccacagcagacacgtaacactctgcccattatgttgagaaccaagcgcctcggtgatctcaggctccatctgaagagctgatccaggtagggctcaacagtgtattctaggtcaattttgtgtcgaaagagaatagccaactgaaaacacatggacagtcacccatgtgtttcaacaagattggttctttaggtcagaagcctgtgatcttttgagatgaacttctggcaagcaaaggtaaagcttcccttctctttacaagaacttttgacctgcttcggtccttagttaagacaataaagttatttagctgatgtgaaaacatttctaaaacagcaacaaaatgtagcctaaaccatcaaaatgtgaaaaacaaaaacaaaaaacacttttagtttttccagctggttaggtaactgaaaacatccatg

SEQ ID NO: 65404 - DNA, 1007 bp, Homo sapiens
ggtgggtcagcctgagccccaaacagtgccgtgaaattctccatcgtaccctccgccccggcgctgtctccgtgtctgccgttggtaattttcattggacaatgctttcaaggagtacccccccgccctttctcaaggagccgcttgtcattggatgcctcaggcaccgcctaccttttttcaacaactacttccgtcgccttatgagaacgttcaggaagtgctatttaaccttattagagtcttctgctagctctgcttgctacagtccaataaaatgacttaggcggataaagcgacaactagactaaccaataaaatattaagttcttttttgggttctgacctaccacagcgttcagagaactacatccgggtttagaggccgtacgtttgcgatatagcccaatagcagtcgttatggtgggggaggcggggcgagacctacgacgccggcgagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactgggtgagcctcccgcgtgttagtaccccgcgaccttgactgtccctgcccttgcaggtgtatctgggaaccctggggtttacctctctgaggacacctgaggttccgagcctgtagcggacttagagactattaagtgcagggtccgaaccatcatcgagtctaaactttgtgtttaagatgggaaaacggaacatgttagtcgtagcccatgcacaacggcccaacagcttttgactgttgagtccaggtttctttctgtttcaccattgagactaattaacagccctatcaaaactgtacatacacgtgtataacgttttacagtgccgctcatt

SEQ ID NO: 65405 - DNA, 1063 bp, Homo sapiens
ggaggaacaacagtgcttcaaaatggatgtcacgggcactgtggttcattatgagagccgggggagagggaacaccaggatgaggaattagatgctaaagtctgaaccttcccaggaggctatgtggatccagctgacttttcttccctgtatttggcaggaggaactagaacgggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgtttttggcttttctttttcttttggccttgattttcacacatggtaaccaaaggcatctccctctcccctcttaaatatctatacttccactttccttgatccattattttttttcagcatattaaataatatattcttttcagatacaactgtacagggctaaattttgggaaggtggatgttggacgctatactgatgttagtacgcggtatgtaaagacctgggcagagggtctgagcagggaaatcactttgagtgatacatacagggacatttagagaactttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcct

SEQ ID NO: 65406 - DNA, 1420 bp, Homo sapiens
gaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtaagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgctt

SEQ ID NO: 65407 - DNA, 1656 bp, Homo sapiens
aagccaaaaccaggcagagctagtcctctgcagagcaccccaaacccatctggtctgggaaagacaggtgggagcaggaagcggagccctgaagtcagggcacctaactcagactctgcagaggaggggcaggttgggagagttaaacttaggaagattgtcaatgggacttgctgggaagtggtacaagagactcctctcaaaaacactcaagatagcccccagatcccagatcccggaggagacttccaagagccttcaggaactcagccattctccagtaatgagcaggaaatgtcacctactagaacagaactgtgtcaggactcccccatgtgcactaagctacaagacattctggtctctgctagccactccccagaccacccagtggtgaagtcagagtttgagtccagtccagaactggtagagaaggaacctatgttggctattgactgcagagaaccctatgcatttgacacagctctgctggagcagccctgtgaggctgaggagtaccgaatcacaagtgctgctgccaccagtgagctggaggagatcctggacttcatgctctgtggctcagacattgaaccacctatagggtctctggagagtccaggggctgagggctgcagaacgcctacctaccatctgacagaaacaggaaagaactggattgaaggggaagaatggtgtctaccagacatggaactctggcccagggagctcacagaattggaaaaggaacctgctggtgagaacagagggccaactgagctccttagcccccttgtcatgccctctgaggtgagtgaagtgctttcagtaggaggccgttggacaccagaccttgaaattaccagctcccagccactggatggtcaggaagacaaacttctccatgtcagctcccttgatactccccagaggtcttatggggacctctcacctccctgctcaaactgggtggagactgggctggaagtctccttgactacagatgagttattatacccttctcccaaggcaggcaaggaggtatctggtcactctgaactactaggctcacttcctgccagctctgaagaggaagagattgatgtggtggactggacagcagaggggaggctggtacccactactgttccctccgtgtggcctgacccttcctcagagtcagaaacagaggtagatatactaacatagtggagaggggagggcaggttaggggccttgggagggtgggaaatgttagctagcaaaaggcttactggcagagaagctggcacgtgccctcagcacaagaggcaggtgtaccctggctctttgtaggtcccttcctcccttccctaagcctcagaagccaggcagaagccaagggtaccatagatagaaaattatgaacttgtaccatcttatttgtaatctattttccggttagtgacaactgaaacaaactgtgtgctccccaattctggtgggtcataggtaacagccaaggccagatctctcaggtcataaggcatccagtcactggtaatttaggaaaagctgagaaagaacaccctcctctgtggtggggtattgtttaagaaaatgttccagaggaaggtgtgaagcagtgttgggtggaatactaagtgggtgggagtg

SEQ ID NO: 65408 - DNA, 2488 bp, Homo sapiens
cattctaaaaagcccttgttccttgtctcccttgcctcttccgcccccctcagctctgcagtaattcctcagagattgtacagtctctccactttaaatataaatatataaatataaatatatatatgtataaacttccccctgtctttctctcctctcttttttttaattttctataataaagtttcctattggataaggtcagctccctgatttatgcctggttcctattggaagctcacaggggctgacatcacttaggaaagcgaagggggtagggctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacggtaaccggagggaattaaaaaacgggagagtctgttatgctgatgagtaacttttaagcaattatttttcttttctactttcagtactttggcgggggagattttggtattttattatatttaaaaaggtaaaatatacaagacctagaaacaaacttctaggtctctttaatacaggaagctgaatagatccagaggggtaagagcaggtttgaaaatttacattttggtgtgttctttgattttatttatttatttttctggattaagctaacatatttctgttttcagagcccaaatcaaaagttggttttttggcatgttgcatgtgggttgggaaagaaatttgtccgtgtcggaacccagttataccgatggttcttcatatgtttaaaactttttttttcttttatcattggatttgtggaagtggaaagttgcagggagctttgcagtgtaaatggtattgtttttcccccagagagtttgaacggcccgtatcggtttcagccctgctgttcctgggtggatccctcttacttttccaggtgcggtgggtgggagcctcattctcctgctagatgtagtctcccttctttggcttataaaagaaaacaaatggaaccatgttaactgaattgccatctccttcttccttctaaactacctttgatagcaaagatttgtggaggtgtttgttaaatctgcaaatacgataacgtttggtttatgtgtttaaagggataaggaaattctaatcatgctttttatttcacctgagtaaagtggcaacatacctgaaaatattttcagctttttgcactctgaaagggccaagggtggaataaaattaggtttagaaaaaccatttatacaaagtttagtgtttaaaatacatttcagaaaacaagggagatttttatttttaaaccaacctgaaagttgttttttggagttgaatttattgtttagttaatttaccatgaaatctgaaatctcttagagctgaaggcccatgactgtgctttcatatcttatatttaatcttaagatttgttttgtttttgcaaatacattcttgcaaaagtacggattctagataattatatagccaactcatcagtagctgaaaaactagggtattctcttctctttttgaaaatgtgaatccgcctgaaaattatagatgctgtcctaattgtaacaagatgggctttagtgtgtaagctgctcattagctttaaactggtatggatctttaataatctgatttcgttctcccctcacccccctgccacaaatttttttaagactagacttccttgaatttcttttctagaatgagggtatttcttgaaagacgatttcatccttgtgaagttgtggcttcaggaggaaacagaactttgttcctccttcaaatacaacctaggcaaaggctgcaggaaatttttgatgtctgaatctcataattataacaagtacagttaaaaagaaagaaaaaatacaatgtgtataggctgttgaactgtagttcttgtttaatattttccaaattttctttcaaatgttctctctgccttgactccagcctggggaggtttcttggatctttagagtgttggtcatgttgcttccagagtgtctgtttcccactcaacctttagggggagggatgagggaatctgaaggaggagtacaaaggcagtttgaaaataggttctggatgactgagtggtggtgatttgggtctagctttaaatagtgggctttgtgtagctgaagtgagcatcctagttaacctagtgtccaggactatttccacgaactaagggttgttttgactggtgtgtagtacagagcctttggggtgataagatggaag

SEQ ID NO: 65409 - DNA, 1050 bp, Homo sapiens
aaattgagactattggtgatattaacaaaaagaaaagcactaagtaattacaatccagccttaggtttatgaagtagctgctctccagggatgaatgagataggatggatgcaaataaattaagcatagatcactatcaattggaataacaaaatgattagctttgtataatttatctccttctattttggtaccctgttagtaactgccaaggccctcattcccccctacctccccacaccttgtttttagtgtattctaagcattttgcataaactattaatttcccaccactggtttttttgtttgttttgttttttaaggaatttgaccctcagagaagctgaggtttggtgaaaatctcactgcctgtaaatggttgaggccaggattaaccctggtctgactaactacaaagtccatggacttaaccactaatatactgccattctccagagagaatggaaacaacagctcgaactaaaacgagcccttgctagaggcaggagtgtttcatcttggcacaggggcagtactcacttaaatttccaactccctccaactccccactacccttgttgggataatgtatgcaaaagatctattttccatagagcccatggggagctggatgtgctagaatggatattattttaatctttagaacgagaatctttccatatccatatgcccaccattgctgtcctaatttcttaaacttcctggaattgtgtcacacgttgtttatcagtaaaatttcttcttccagagaatttgttaggtatgtggtttggaatgataggatatcatcaacttgcagggacaggcttgtaggaggtagttcagatattcttgtctttccctctagactatgagcagcttgggtgtaggtactgtcttatctctgtatctttttagcacctgtcttagtgtttggtacatactgaggtgctcagtaagccttggttaaataaggcatttgatgagaatcagtgagggactgatttgtggggaaggcttgaaaggaagcaaaacaacatagattaatca

SEQ ID NO: 65410 - DNA, 1553 bp, Homo sapiens
agtccaggctggtctcaaacacctgggctcaagccatcctcctacctcggcctcctaaagtgctgggattataggtgtgccccaccacacctggccctcccttatatttttaagcaaagtttctagagataatggaggatttaaaattttagcttttctttaatcctgttcctttcttggcaagtggtacaaagaatagtataaaaagtaaggatctggcctggtgcggtggctcacgcctgtgatcccggcagtttgggaggtccaggtgggtggatcgctgggcaacatggtgaagactcctctttacaaaaaatacaaaaattagctgggcgtggtggcatgtacccgtagtcctagctactggttgcagcaagccgagatcatgccactgccctccagactgggcttgcagagccagatcctatctcaaaaaataataataataaataaataaataataagtatcctagtccgttcatttcataatgaacttcaacactgaaaaccttaaatgttgccattttctaggggagagtatattaagacatcagcagaaaagtactgctttcagccctggttggaggtgaatggtttctgtgcttgttaataaaaacgttaagagcttgggatgatagttttgaacatcagtgtttcaaagaaagtatgtttggatatcagtgtattttttaaatcactgttttagccacaaaactttagattttgttcatgtattgggaagcttatgagtttaagaaccgaaattagttttcttgggtaatttaaaaggtattaacaaggaacttgcctacaggagtgaactgtaggtaataaggatgtgaataagtacaaatattctttcatgttctcttccctcaaagaagggttaaatgacacacaaagctgaagtagggattgctctgcctaaattatgcagctgcctccaaggtttccaatagagcattgatgtagcctggcagggagattgtaagaaggcaagaacaactgttctggttagaactaatgagggggaaattagggtatggattgatttgtatttaattgtttaatgtatttttcggaagtaatttttttccctaattctacttggaattgcatgttattattaaatattaagcattgagaatggggcctgaatttaccactttattcagggatcgtgttccctgtttttagggccacttcttctccagtgagcccttcagtttgattggtgtggtgtggacaatttagatcaggcatatagtgggggaattataaagaggcaaagaattttcttatctttttttttttttttgagatggagtcttgctctgttgtccaggctggagtgcagtggcacgatctcagctcactgcaacctccgcctcccggtttcaagcgattctcctgcctcagcctcccaagtagctgggactacaggtgcgcgccaccacgccctgctaattttttgtatatttagtagggatgggttttaccatttttgccaggttggtctcaaactcctgacttcatgatccgcctgccttggc

SEQ ID NO: 65411 - DNA, 1073 bp, Homo sapiens
tttatttcctgctttgttggaatgggggaagttctgtaacctcattgctgttctgctctctattgactactttgttaactggggcacagttggcctcttggatgtctaccgtgctgaaggtcagccaaataggcaggtaagactacctaggcctcttcataggcctaactaagatcacagttggaaaaaaaaaagtatagaaaaagaaaagaaagttgttttttttttctaaaatttaactttttgtattcattgaagaaggaagtaaaacatctccattcaaaagaaatttgagagtctgtttatgccatacactgaagtacaacaataaacaaaatagacctactgtttgttctcaaagagcttacattctagttgtgagagacaaataataagcgagtaaatatgtagtatgtcagagtgtggtaatattattgagaaaaaagtaaagtagaatgagtagtatggaggaaagaacgtctcagggtgggggtgaggttattttatatagagtggtcagggagggtctcatgtgtaaggtatgtttgagagagaccaagagaaatggaggatggagtcatgtagatatgaggagtaggaagtgcaaaggccctgaggctggttattgccaatgaacaaaagagattgaggggagggaaggagaagtaagagacctgtccagagaggaccaatgggaatgtattttgggggaaggggaataatgtagggtcttgttgtatactatattgtacaaagaaaaattatctccacttcaaaccccagagacaacggctgttaccgaatttttgtgtctttcttgtaacttgaggtagcacctgacccaacctccatatttctcccattgtggaatctccatgaaagtatagttagcagataatttgcatagtagcagattttgcataggttgattacctttgtcttagagaatgataataaggcagctacttagaataagctgatatgtttttgggaagtgggatcaaaatttttctttttcttttttttttttcttttttgatacaaggtctgtctcggcagtgttaacaatctca

SEQ ID NO: 65412 - DNA, 1027 bp, Homo sapiens
ttgccccacttgtctgctgcttctccttttgctcatttgaccaaaaagctcctgtttccccatgccctgattgttgagaattcatggctttgaggacccctttataggtcaccatatccgtatttctgtcttgcacattgggagagatgattatccctgaaactaactttccttatgtttgtttaggcattagaggttattaaagcacatcctgagccactttacctagttgactttggagttgaggaagaagcaccaactatttagtgatttgatgttccatgcatatacgaaagtaaaaggatatttgattgaatacctatgtcttgaatcacacactgttactttccctcttaagatttctggtttagctggtctgtccctcagtgagagtctctgtctcgttctctctctctctctctgtctcgctctgtctcctctctctctctccctctccctctttctctctctttctctcacccgtctcctcctctctctttggagtttttagccctggctcttaacctggttaccctctgttctttcctttaattatgcttatctggttgtcatctggttacttaatattagggatgccctcaaccaagaaactttttttcttcccatctcctcctttgttcaggtaactgtatcgtcttgcatgggaaataatccaggcaatcagagattacccaaaattttgaaattgttttaaacaactggtttatatgtattacttcatcatatatagatggtgtgagatgtttgtggttgtcttgagagttttttgagatagagctttgctctgtcatccaggctggagtgcagtgacatgatcataatttattgcagccttgacttcccaggctcaaatgatcctcccatctcagcctccatcacatctggctactttttgtgttttttgtagagacatggtctctatatgttgcccaggctggtctcgaactcctgggctcaagtgatcctcctcctttggcctcccaaagtgcagtaattacaggcatga

SEQ ID NO: 65413 - DNA, 1093 bp, Homo sapiens
aaaaatataaaaattagccgggcgtggtggtgggtacttgtagttccatatactcaggaggccgaggcaggagaatggcttgaaccctggaggcggaggttgcattgagattgcactattgcattccagcctgggcaacagagtgagactccgtctcaaaaaacaaaacaattttatttttggttttgttttaaatgtacctttattgtttgactttgggatctgggagagagtatgtcttttaatgccattcttctttcttgagtcttcggtgacacatgtttacttgtgggaatatttcactttttagttcttttaaagaccttttgctattcgcttgctcttactcaaaccagaagttaaagtggcttgcataagtgtcagaggtaaccacttggatccagagtttctggttctctctctgttgtcaagtggtttagaattatctagggtctttaatggtagatttaagactttggagttcttttgggatagaatatgcaaccaggttttgaaaatttggcatagctctttgttccttgaaggccatctaagatgttttaaacataattgtgttctccaatctgcagtgtacagagggatatcctacaatgtagcaactcgggattccagagaagatggtgctggcaagtgagacagttcttccttctaggttctaagtctgcagtacaggagttaggactgtgccattccagccatccttatatttagattcatgctttcaaagagcctctaatctagactgaataatgatctgagctgtctggtgagcagtaaaactggcccaaataatgtattttataaccagtgcccttttagcaagaaagtcagtgggttgttagggataggccactacagtggttcacaacaggccataagagtctatgagggtttatttatttatttatttatttatttatttatttattttgagatggagtcttactctgttgcctaggctggagtgcagtggcgtgatcttggctcgctgcaacctccgcctcccaggttcaagtgattctcgtgccttagcctcctgagtagctgggattaaggcatgcgccaccatacc

SEQ ID NO: 65414 - DNA, 1865 bp, Homo sapiens
caccatgcccagcctatgagggtttttttttttttttaagacatgaattcccagacttccctgtagaaactgatgtagaggggggatttaattttttcaaaaagctccctaggtgattctgatcattcacgtttgaggatcacaaaacctgaatatttgaattaagcttacatgtatatgttatttctcaggtggatggttatttagttaaggtgagaagtagagccaggcacggtggcctgtgcctttggtctcagctacttaggaagctaaggagagacttgagcccaggagtttgacaccagctttggcaatatagggagaccccgtctcgaaaaaaaaaaaaaacaacacacacacacacacacacaaaacaagagaagtacagaagatggtttattgtagtagacatgacgagaaggtcgttaatttgaagtgaagtgatttacctctgtgtcctgtattgttttggaattaaagatgttacctcttgatttgggggttatgccaacacttagcatggtatggaggactcgcctattgggaggaagggaaaactttagactgtatctgtggttttaaattgtggaacaaattcaggagaggatgttagcattgaaatttagctggacaatttgtttaaaactggacaggaagggccaatgttacttcctgtctgaaaaggaagcgctggcttccttcccttcctccttggttaactctggccaacttggaatatgggtgggggaggggctggttatgttagtaatcgtgttaccactaatgttcgtgtatagccgcttaaggtttactcttttccttacttgaaacatgtagatgggtgctgtgtgtgctcctgtttccttgttcttatatgggagccctgtactaggtttgagtttagtctgggaagcctaatctctcagacgttacttttacattcaaccttatatacacctcccttgtattttctgacatttgaaaatacaccaaagagttggagggaagaaactgaaactcatttgacacggagcggggtaagttgtggaaaggagaacataattgggcagaggggagtggatgacagaggtttcttatttttgaattgagccaagaaagcattccttctaagtggggccagttggcactgttactgctattttagttcaggcttctccttcctactgaccagtcaattgtattaagtgtttgatgtgagtttgaactgaggtctcaggaggggagggagcgagggagggtggtggtggaaacagctggtgccttcatcaagctatctcaattactcttcagagtgtttgggggtgggggttggtggcacaggaattagatgtgtgttagcagagtctcagcaactcttatgtagtgggtttgaattctcaggcactcttaatgctatgtgggatgttggctagttggaatgtagctaaacctttcccagtcacattcttctgcctcgcctccctgtaattctttcagcattgggcctgctttggagaaagaggggtgtgggaagttagacagcaaaacagattcatccttcctacccattgagtattcagcttaggtcttgggccctccagaggctttcttcatatccattcattattcctttagttgggctttctaaatatgtctgcaaagagtctgagatacaattagaactgggacctctggtgaagttaagttgaattgtaatcagttggctatacttgtcgtcttccctccctcacaccccaggattactgtatttctgagtcagcactccttttctatctcacctgctcaatttgatgcagagaacttgccaagcatccttttggattagcagcattgatgtgggtgtg

SEQ ID NO: 65415 - DNA, 1865 bp, Homo sapiens; identical to SEQ ID NO: 65414

SEQ ID NO: 65416 - DNA, 1865 bp, Homo sapiens; identical to SEQ ID NO: 65414

SEQ ID NO: 65417 - DNA, 1745 bp, Homo sapiens
catcagtagctttaaaatccctaatgcagtgcctccaaagtgaagaaacttgccaagtaggaatcttaaaaattccctcacccccttcaaacttttagatccacacacagtctttctgctgattcttaaaggcctgagctttgtcctacgtagtgttggcttggggcagagaggagggttgttttccctgaacatgataaggagctgagcagggcaaagtgggggctctggcccgtgattggtagacaggatgccctggaatgcagttggcctgcagcccagaatccagcactttgtatttgtttgtttctgggagactgtggtctggtgctactgtgacaggaagtgagaaagctgggagtgggggaacagagagggtcgatgtctttgtggttctcctgtgaaatctctttgtccctggagagcagctctgctacagagctctgctgagaagagagcagcctttgtgtgtctaatgggtctcggagcatctagctactccgagggattagagagtgtgaattctgactgtggccttttgcgttttagcacttaagttatataaatggtcctgatctcttagcactgggaagcttactgagttttgtgtgtgctgctattctttgtggatctctaggatttaattaagaaaggaattctagaaggaaataaatgttaagtaatgttcatttgctgtatatgttgcaggtaccttgttgggtttaaaagggacagaaggaaacaggtaatgctgaggtcctttacattttatatctcatccttccaattggcaccctactgcatacagatcaggagaaacctacccgcttagtattaagagttactagcaattctctaatgtttgatcataactagagaatggttggtagtttcctgggatttttcttccctatgtctagactgaaatagcacctgtaataccctctctcttttctgccctcttttctctcttgttttgtgttttccctgccttccattccagctgtgaaacaggcatcttttctcactttgtggattggatggctgagtccttaactttgagccaagctggctggttcctgagcacacacacaaacccgcctttgattgtccaggaggacagctgccctagaggcagattgctaacataccactagaacaatccttcttctctgttcttatgctggctagcacaatctttactgcctctagttccttctgtttcccaccccatctctgatctttgcttttggcttagtgagatgtcacattaaaaatgagagtagggattggattttttttcttgtggtagggttgagggggtgatcagagaatgtgacatgtagccagctttctagagcaggcttgccagtggtaaggtaggtaatttttacagagtagtgcctcttttgttcttagcacctttcctcctgagtactaggttcttataaaagggaaggtaaatctgaagtaggctgcaagctactcttcccaaattgagtaaggttttgttctttaaagtgaagataagacccaaaagtctagctggctccattccaccttctcttgcctccttcccctctccgtaaaaaaaatgtcaactttgggttaacttcttaattggaactagaatgactttttttttttttttgagacagggtcttactctgtcactgaggctggagtacagtggcacaatcttggctgactgcagcctggaaccaccaggctcaagtgatcctccc

SEQ ID NO: 65418 - DNA, 1745 bp, Homo sapiens; identical to SEQ ID NO: 65417

SEQ ID NO: 65419 - DNA, 1745 bp, Homo sapiens; identical to SEQ ID NO: 65417

SEQ ID NO: 65420 - DNA, 1506 bp, Homo sapiens
agtgagccgagatgacggcattgcatctgggcgacagagcaagactccatctcaaaaacaaacaaacaaacaaaaaaaaacgtggaacatcaagtggaggtagggcggggtacttagactttggactctggtataagcactgataagaagccatagaaaggccgggctcacgcctgtaatcccagcactttggaaggccgcggcgggtggatcacgaggtcaggagatcgagaccatcctggctaacacggtgaaaccccgtctctactaaaaatacaaaaaattagccgggcgtgttggcgggcgcctgtggtcccagctactggggaggctgaggcaggagaatgctgtgaacccgggaggcggagcttgcagtgagccgagatcgcgccactgcactccatcctgggtgacagagcgagactccatctcaaaataaaaaaaaagccatagaaaatcttgacaaaatatatttctttgatttagaaacaaaatggcaagtttgtttgtggttgaaccggaatatttcttcaaatttggggtcaggtgccagttaaggcaaataaatgccttttaggtatctgaagggcccctttctggcttgaatgttatgtaatacagttctgtagtgttacaggtgctatattttgttgattagtattctgcagtaggaggcttggtatgctatttatttatttatttacgtatttatttttgagacagggtcttactctgtcgcccaggtggcaatgtagtgattgtggctcactgtggtctggacctcctagactcaagcaattctcccacctcagcctcctgagtagctgggactacagtgtgcaccaccatgcccagttaatttttgtaatttttttgtagaggtggggttttgccatgttgcccaggctgatctttaaactcctgggctcaagtgatctgcccaccttggcctcccaaagtgctgggattacaggtgtgagccactttgcccagcccagtgtgcttttgaaaaaagccctttgcattccctagaatggctgggcacagtggctcatgccagtaatccctgcactttgggaggccaaggcaagaggattgcttgagcccacgaggtccatgctgtagtgagctgtgatcacaccactgcactctagccagggcgacaagagctagatcctgtctcaaaaaaaaaaaaaaaaaattccctagaacgacatggaaatggagttttgcctgtcattgtttttagatggagagcataaatttgtgacactcgttttgttgttgttgtttttgagacagagtcttactctgtcatccaggctggagtgcagtggcacaatctcggcacactgaaacttttgtctcttgagttcaagtgattctcctgcctcagcctcctgaatagctgggattacaggtgtgtgccaacatgcccggctaatttttttgtattttaagtagagatggggtttcaccatgttgaccaggctggtttcgaactcc

SEQ ID NO: 65421 - DNA, 1506 bp, Homo sapiens; identical to SEQ ID NO: 65420

SEQ ID NO: 65422 - DNA, 1506 bp, Homo sapiens; identical to SEQ ID NO: 65420

SEQ ID NO: 65423 - DNA, 1130 bp, Homo sapiens
cttatacttaaacccaggcagataacaaagcctatacacttaacctcttaagaatcataattccaaattgtatttctttagtcagtttacagtagaagaaatcattccagggactgtgctattggtaggtgatttttttgtgtgtgtgtgtgtgtggggtactgagtctagctctgtcacccatgctggagtgcagcggcatgatctcggctcactgcaacctccgcctcccgggttcaagtgattctcctgcctcagcctcctgagtagctgggattacaggtgtgcaccaccaagcctggctaattttttatttttagtagagacggggtttcaccatgttggtcaggccggtctcaaacccctgaccttgtgatccgctcacctcggcctcccaaagtgctgggattacaggcttgagccaccacgcccggccggtaagtgatttttttgttttttggacctcctatctggttagcactgtctagttgtttggtccttctgggtatttgatttaatttaacttcttttggttgggagttcttacagacgagactgagtttttatcattatcattgcttggatgaaggatctttactatggactatggactctgggtaatagcaggaatatctttctagtgtgggtgggatccagtaatgtaggacttaatggcttattgagagtaaaactaggtattctcagaaaatctagtcttaagggggaataacaagtttcactttatgtttcctcaaccccctgacttcaggaattctttgattttttttttttttttttggtgagaggaaatgtagtctatttaaaaatctaagtaagtggaggccggctgccgtggctcacgcctgtaatcccagcactatgggaggctgaggcaggcggatcatgaggtcaggagatcgagaccatcctggctgacacggtgaaaccccgtctccactaaaaatacaaaaaattagcccggtgtggtgtcatgcacctgtaatcccagctattcgggaggctgaggcaggagaatcgcctgaacccaggaggtggaggttgcagtgagctgagattgcaccacagcactccagcctgggccactaagcgagactccatctcaaaaaaat

SEQ ID NO: 65424 - DNA, 1130 bp, Homo sapiens; identical to SEQ ID NO: 65423

SEQ ID NO: 65425 - DNA, 1130 bp, Homo sapiens; identical to SEQ ID NO: 65423

SEQ ID NO: 65426 - DNA, 2747 bp, Homo sapiens
gaagaatcttttttccttaagtctccaagcgatgagaccatttactgtagcctgcctaacagcttcattctttccccactcatacattccttttcctcccattttttttctgttttctcacttctatgtagatattatgggtaactcttgagcctaaaaaaacaaagtagaacccttttctttccctgttttcctgtgatagttgagaagaaagctctcaaaggttgtagaggagaggctctggaccatccatctggtactgactgcacttctatttggacttgacaccatggcatagaaagagaacacaggctttggaatggcatagacctgggtttaaattcaaaatttgctattaactgtgagaccttgggtagtttcttcacccatgagtcttatttgcaataaaacttccttagggttgttgtaaggattgccaagatagtaaatgtaaaacattcagtaatcattagtttcacattccctttctccaaggtaataaattgttaaggcctcaaatacagaatcaagaacttattatgacagatgtgtaatgatgtgatgacttccaggcactagagaagtgtcctttgtcccagaaacactggtataggtgggacgttctagtaaatagattaggagtagggaaaccagcccattcactccttagaacctagttatgtttttgatccagttgatttcatctactagttcacaaaatagtttgaggctgagacattacggtgaagtaatgtaattggaagtgttaaaccaacttttgaaacaacttaatacctgacatttgtatataacatacattgtctcacctaatcctcacaacaactctgagttagaccgggctaatttcctaactcctgggaagcagcaattttttttctttttccccaatttggttcctggaaacggggcaaatggatttggcatcttacaagtgagaatatgacagggtttactgccattgttgggtagtagtagagccagaactgggaccagtcttcttgagttgtgttctatcccatatggcctctgcttctgtcctttttcaggcagaatatctccccatgcttttagacctaggaatctgatctttttgtgtaattgtgctgtcttcttttccaaattagagccaggtggtcagctttaaagctgtgaagatggtggaagctaatgtttctccagatactgctttctgacctagagccctgagtatttttcctatctcccttcctaaccttcttcactgaatttaagttgcagggccatttatggccatctatacactttctctttgcagcagggaatgtcactgtatcccccgtggtagcagtaatttgggcttttattagcaaagaagattatagggtggatgctgctggagtggtaattgcacttcagaccctgttgaaattcagtaactggaagaatctctttttgagctcagagtcctcttggtgtggaaggttcataggtcattgtacatagtggataagggcaagtacttaagaaatggagatgaaaggggagcacctttttttttaaaataagggtgcttattcaagaaagacctttgagtggcctgttggaatgtagggtgggaatatgagaaagtggcaatgggttttggactgaaaggaagaagagttgataggcgattatgggaacttcgagctggggtaggaggaatttagggaagggcaaccacgttctttaaacttagggactggattgattcaggagtttattggacacttacttatcagttcctttgggtactcttgcttgctgacttctgcatacactctaagccaaacaggcccgggcatttgtgcttggtggggctctggggagcgtgggaaagggaactgaagcaaaaggctcagcctaggctagtccccacatgtcttccccacacaacttttgcattggtttctcaatgtctttgtgggcatgctgggactgggctttgaggtttctgccttaggggtgggaagggagggggaagggcattccaacagcagtttttttctttttccccaatttggttgctggaaacagggtaaatggatttttatacatattataacctgttcctggttatatatggaaatacaaatagaggagctctcacttgacagtagaatccaggttttaatgaaaatgacatccaaggcctaggtatctgaacacaacaaggtctaaagggcacttgtcacattaagcaattccaagtcatattttaaattacttcctttcattcctaatattgccccttgctcttcttgtttttatgtattgggtatattttattttcctctcattcccatttttccttcaaatatttctgcagctctctccttcctgcttcctccttgctgtggtggctgggatgcttcttccatgattttttgaatctagactgggctgttctctgtgttaaaccaatcagttgcgaccttctcttaacaggtgtgtatggaaatatgtttattaagaaggaaaaatcttactttttaagaaatatgtatttttattcctttcatgtcatagcagaaaaaaatctttttaaataccttttttctttatgggttggtgagagggtgggaattggggagaatatttatttcaaaacctgtctttcaacattgtatattttggactggcataaagtctttcatagctataagagagaaaaaaacccattgagtccaacagagtatcactaatgc

SEQ ID NO: 65427 - DNA, 1354 bp, Homo sapiens
cggcctcccaaagtgctgggattacaggtgtaagccacagtgcccggccttttcatttcttaattggcatttagtttagcatagtaattttttttttttaatttgctgccacttcagcagttttagtgtttagatgtgggagaggttaagtaagatctgtattgccctattatctctaaaagtggcttgtccctgcaggatagtgaatgcttgtctgtaccattggagttacacatttcattgagttgataccagcagatttttttcagggaaaaataatccaatctcataactacagcacctcaccacattctccctctcctaacagtgtagagacttagatttaattgcacctttcctttcaatagttatttctggtgggatgttgaagaaagctagtgggcaaaggattccgcttgaacagacactggtgatgggctcccaggcttggcggtggcttgctttctgcactgcagtaaaaccacgagagggcatctttggctctgggattaataattcatctgtcttctctgacctgtgaccttttctctcctttctcttaccctttcccggtagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcaggtaacccctctctccatcagacgtgcaggtaggactttggcatggtcacagagaggctatgatcctttttgggaagctactctccttttggtgatgggctgtccagtgcccgttcttccagggatttttttccaggggtgttaaatgctgataagagacaaggaatattgctgctggactgagctgggtgcagttactatctctagaagcatccatctgacttcctgttttgctggagtaggttttttggggtgggctacaattctagtaatggtagatagtttagtttgcagctgtactcaagttacttttcttttctgatttttttttcttggtatcaaaaaatcaggaaagtaaatgcccacttaatggttgggcatcttgtgctctcagccctagttcagtctccctgagggaacagtctgtacccaggtgtggcagtatccataaattgtgtactcctgctccatattgtccttgtgtgctctt

SEQ ID NO: 65428 - DNA, 1021 bp, Homo sapiens
gctgcctggaatgggagtttccagtggtagtactgcatgaagattcatgagactataaagctctttggaaaccccccaacttagcccttccaactttccttacatttttatggctttccaaaaaggttgcatgtaagggaaattatctaggtctgtgctgtttattcagcaaatagtttttgagcacctgttatgtgccaggcactgttcaaggcactagactaaactaaacttatcccaaaaaaccctctgccctcgtggagtttacgttcttatgttccagagaccctgtctgccagagttccaggcctgattttcaattttgaggaaagtgctaagactaaagagtgaatggttcttttatgagtactgacacaaggactccaggccacacatatcttcttgaaagcccttttcctgtttgaaaaaaagatcgtttgtatttgatagagcaaaagaaggccacaaaatgaattgtcttcttgtgggctgtgtttcagaacggccggtttgtgggcgatgctgaccttgaaagacagaaattttcagatttgaaactcaacggaccccaggtaattctttggctcaagacctgggttgcttcattcatattttcttatttccccagcctataagagcatatttgtgtcttgtaaggtgcctggcacattgtacatactcgtcaattagtttcttttatttacgaaaacaaagaagtggagctccaaagtatatatgcagttttgttttggaatgaattttaatgaccattgatctttatgactattcctcctccccactgccaccccatttgatccctaagtactgcgtttcttttctagagacagtaggcttctactttgcagcaaaaaaccctacctaaaatctggctggtcttgagccttttagacggtatctgaagagtaacataaagccagtcaaaagatggctcttactgggattttcaggtttgtcttaaaagttctttatttttggccaggcatggtggctcatgcctgta

SEQ ID NO: 65429 - DNA, 1048 bp, Homo sapiens
gactccatctcaaaaaaaaaaaaagaatttaattgctcacttccttaattagtttttctttttcttgtttcctacttgcaggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggtaggcaagaataggggaagagaaaagggtctttccaagaccagggacaaggggtagcttttccttcaacttctaggggctttttgggatcagagatactcgtggcctcctcccctctgcttttttttggggtgaaaagctaccctgtttttcccttttctgacttggcttagtattgacttgctatatatatataatataaatatatatataattttttaaatgaaaataatataattttattttttatttttttgagacagagtcttgctctttcacccatgctggagtacaggggtgccatcttggctcactgccacctccgcctcctgggttcaagtgattctcatgcctcagcctccctagtagttgggactacaggcaagcaccatcacgcctggctaatttttatatttttagtagagatgggg

SEQ ID NO: 65430 - DNA, 1171 bp, Homo sapiens
tagttttaattaaattgcaggtgtttttaaaattattaccttttatttttactaacccattgaggaaaattgatcagtatattattcatgcaaaggagagataagatgagcacactgaaactccagttaatcctcctttgcagatgagggtaatgggaatgtccaggaagctagccataatgacttgatgtattctcttggttcttccaaaacttctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggtgagttctaggcctaaggaaaattgctaagtcagtgttactctctagtgatgttgagaactagagggatttccagaccttttacttttgatgaaaggttgtgaactggtggctgtgggtcaaatccatctcacagatttgtttggatcacacagcattattgaaattttaaagaactggttgctgatgtttaaaattcagaagatttcacttaaaattccagattcttggcttctattaaaaacgtggaagagttgttaacaatggatctcttttcttccttagcagtatttggtctgaactgattggagcatgtgctctctaatttacactaatctccaacacattctattatctgaccaactacagctgtttaggaagttgtttcccaaacatggagctgtcaactgctattttttcacatgcttgtaatttcttttaattatcttcctctcttgactcaccggcttgacccatatagacattt

SEQ ID NO: 65431 - DNA, 2004 bp, Homo sapiens
caagtagctgggactacaggtgcccgccaccacgcccggctaattttttgtatttttagtgttagccaggatggtcttgatctcccaaccttgtgatccgcccgccttggcctcccaaattgctgggattacaggcgtgagccaccacacccagcctgagcgttgcttatagttaaacattgtttgtttcatgatctgtatgtttattttgagctataatgtagaatatgtttcttggtgagggtcgcaaacaaagcttgaatattactataaggtatttggtcactggggaagactgagaagtgatacgatagggggattctctttgacgttcttcagacatattgtcttgaatgctcaagagccatctgatgaattgtctcttccaggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggtaacagtagggactttgagaatatgaagatgaatttttgaggactgacttaaatttcctaaaaaaaaaaaaaaattaaaattctttagcctattctttagcctccattcctatctgtattgcatactgtaactccaacctttctatctttgttgctattctctcatgtataccacatgtacctatatcagttttcttgctgttccccacacatcctcttcacttttatgcctctttgactttgttcatctactttggtaagcttttgttcagcatctaccacatgtaaggtggtctagtcctggacttgtgtgtgtctatgtccttgccctagttatttgtatttcaagtcaggctgtgataaattcagcaaaaggggtacagagtactaggaggttagggcatgggtgaggaaggtctgttctttctgtgatgcctttctcttcttatttatctttttgtggttaaactcaagtgcctttattttattaaagttttcctgaattctttttatatcctataaatgctgctatataatctttctctctttggaatacacctctgtgtgctgtgttccattctacatatgtattatatacttccatacgagaagtatatattccatcttgaattactgcatctggtacatatcattaatccctaccccacagtgatataaacattcagaaggcagggactgttaatcaactttctctcaactgcagtaccttgcttataataggtatttactattacagtgagtagaaaaacatattcaggaatcttgtaggtgttgagggatatttaagggaggatttctggatttgagtcatcttgaagcttctggtttcccctcaggaatgtaagctcagagaggagtgaagctcgccggaaacttcgggaatgtgatggtttagttgatgccctcattttcattgttcaggctgagattgggcagaaggattcagacagcaaggtaagtgctgtcttacctttaatggctgagtgaatttcattcaccacaactatgaagtatctgtaggtcagagacctatcatctcaggctttcaagtaacattaaatatttatactgtcccctaccccttatttttgagacagagtcttgctctgttgcccagcctggggtgcagtgatgtgatctcagctcactgcaacttctgcttcctgggttcaagcgattctcatgcctcagcctcccaagtagatgggattacaggcgtgtgccaccacacccagctaatttttgtatttttagtagagacggggtttcaccatgttggcctggctggtctcaaactcttgacctcacgtgatccccctgcctcagcctcccaaagcattgggattacaggcgtgagccactgtgcccagccaagcccttactccttaaagtgggtattcaacttaaaa

SEQ ID NO: 65432 - DNA, 1061 bp, Homo sapiens
gagcacttaagaggcatcctgagaagttatggattgggttatgcatttgaagatcaacattttaatacctgagtcatggaaacctgtacttgtggagaaatcacaatagacattcttttttctcattggcccttttatgtccctaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaaggtgagtcttggttcctgtttcttagtctttaatgtgggatagggaaaggaaggaacactttagcttaaggtacaaaatacttggcaacagtatgggagtctgcctggttatggatgtctttttggtttgctgctttccctgtgttgtgtgcttcattcaaggtgtggtgatgggatggtggttgtgatgtgttggtggtggtggtggtggtggtggtggtggtatcaatgagtggggcagtggaaaatgagaactcaactaatctgggaccttcttccccatacgtcctttgcattttctgtgtttttcttttcttctctgtgcttccctgcttatttgcccatgattctgctgacatctttctcctgcatttttcttatttcatttctcttctctgctttctaccttgggtgatgcactggaagatgagtggttctccagaggtgagtggagtcttttaaggtgcttatctacttctaatttgcatgttttgattttagcttccctagtatgtccttgcctaacctttccctgtctatgcatgtaggaaagttcagttgaggaagacactgaaacaagtttagctctttggagctaatagctcacggcatgctgtttctgggcagcagtccccattatcagaactcaggacaatagcatcaacagtggtcatcctcatcttacctatctgctgcctgttttctatccttgtttctgaatagtcccctgctggaacaagttgccctcacctgcccctttt

SEQ ID NO: 65433 - DNA, 2720 bp, Homo sapiens
tttagggaacctgatggtatagaagcataaatccatcaactgagagtactaaggctggactccagccagctagagcctggtttattggtactgattagcaccctctgcttctatttctcttttgtgcaggctatgagctcttatttcagccagaggtggttcggatatacatctcacttcttaaggagagcaagactcctgccatcctagaagcctcagctggagctatccagaacttgtgtgctgggcgctggacggtaccttttagaaaagggatttggagatgggaaaacttagataactagtttgctgccatttgtaatttgttccacccctttctatttgctattctagtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtgaggagttgaatgctaactgttacctcaaaatttagtacagtgtttgtagtccagcaggtgcctaataatttattgaatttattgaaatgactgaagggaaggaccctcccccgcttcatagtttatgaatgcgagagttggtaagggttttagtttaatggttcttggaaagaaaacaagtgacaactcttcaaaaataaaataataattgctattatttattgagcacttactttgttactaagcgttgttaaacacttctgtgtttccatttaatcctcaccactttacaaaggtccatttttttaaataggataaggaaataactcatggaagttaagtaaattgcccagagttaatgtagctagttagtagcagaacccagttatttatttatattttaaattcataataactcttctattaaattattataatattcaagatattttcattagagtatctgaaaggactgtgtagcttatttaatatacagtatttacactttcaatgtggttgaagtagaaaagaaataaaggaataggtaggacagtaaatccatggctatttcaggtccttagcccttttgatatgataatcctataggataatgaagttgattcatgtggacagcacctacacttgatatgattaatgcagttaagtataatgtaaggctcttcatgacctgacttgatcttttctccctgcatacattctttcttactaggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggtgagcttaccacctaaaattacagtcaaaagaatttgagtgagtggagagttgttttcctcttttggttactaagaaaggaaatttccccttatttacgtgtaatgtgtgaagagctattgctctattatctgtcttaatgttgatccataaattgataatagattcatgtcaaacttttcttgtgtcgctatttgggatagaatacaggatttggtaaaaatttgatttaacccattttggcatttatattcttttttgtttgtttgaggcagagtctcgctctgtcacccaggctggagtgcagtggcgcagtctctgcaacctccacctcccgggttcaagtgattctcctggctcagcctcctgagtagctgggactacaggtgcgtgccaccatgcccagctaattttttgtacttttagtggagatggggtttcaccgtgttagccaagatggtctccatctcctgacctcaggtgatccacctgcctcagcctcccaaagtgctgggattacaggcaggagccactgtgccctgcccctggcatttatattcttatgttattagaggatatagggtctaagcttttttcctgattttatatccaaattccgtatggtgttactttcctccaaaggaaccgctcagaaaaagaagttcgagcagcagcacttgtattacagacaatctggggatataaggaactgcggaagccactggaaaaagaaggatggaagaaatcagactttcaggtatagtaacttttgagaccaagacttttactttttttttcttggtcccaggataatgcttctgttttctttcgtttcttccatttcaccatcatgctaaacctattttttttttctttttcggagacagagtctcactctgttgcccaggctagagtgaagtggcgcaatctcggctcactgcaacctctgcctcccgggttcaagtgattcttgtgcctcagcctccccagtagctgggactacaggcacatgccaccatgcccagctaattttttatatttttagcagagatgaggtttcaccatgttggccaggttaatcttgaactctgagcttaggcaacctgcctcggcctcccaaagtgctaggattacaggcatgagccatcacacctggcctcatgttaaatctatttttgacccatatttcttaattaggaattatttggccaggtgtggtggctcacacctgtaattccaacactttgggaggctgaggcaggtggattgcctgagcctaggagtgtgag

SEQ ID NO: 65434 - DNA, 3711 bp, Homo sapiens
cttttcagacaaacctcttgtttagctttattatgtcatattctgggtattttatacatattgtcttccatcttagattcaagttctttttttgagacagagtctcactcgttcacctgggctggagtgcagtggcgtgattctcatacctcagcctcccgagtagctgggactacaagtgtacaccatcacacctggcttattcttatatttttagtagagatggggtttcaccatgttggctaggctgatcttgaactcctggccttaagtgatctgcccgtctcagcttcccaaagtgctgggattacaggcatgagccaccacggtcagccagattcaagttctttaagtcggggaccatcagactttaatgcctttgtggagcatttgacaagctcagttcccaacagtgatgcctaattacacctatctgtttgatatacgttttacactagaggggaatgtcatatttctgtgtacttttttttttttaaccagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatggtatgtccttcagtcacccccaagattgttcttgaggaaggaggctcctgagtgccagcaacttgtcaatcacgctaatctgatcaggccagagactaagtagtctcagccacatggggctcgaggggttctgcttttgtgattattacctcttacgagtctgggacatgcagctggtgatctgattctccgttatgtgctgctttcctttctccagatttgctcaacttttttggggggggtctccttaatcccaaccccattaacattctctctttctcttttttctccacagcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagc

SEQ ID NO: 65435 - DNA, 1053 bp, Homo sapiens
tttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcctatatgctaagcgttgtgtcaaggttaggtttagattagagagtgaaacagatggatcttttctcatagattgcaatccatgagaatcctctatagctaagatctatgatcagacgagatcgtgtgcgttcagggtgatatggccatagacaagatctatgatcttaaaaacacttctctctgtgccatatctaaatacaatgagatgttacacagaatgatgtgtaaaggccctatctcacaagtttcttgacactgatgtactttgtgacag

SEQ ID NO: 65436 - DNA, 1095 bp, Homo sapiens
ttgactagacctagccctgtatatctgagcaagttacataagaattccctgtatgcttgttgaaaatgcagagtcccatgttccatttccaaaaatcgattcagtaggtgggactgaggaatctaaaatcatggtaagtcatccaggttatcctctttttttttgtttttgtttttgtttttttttttgagacggaatttcactcttgtcacccgggctggagtgcaatgccacgatctcagctcagtgcaacctctgcctcccggattaaagcgattctcctgcctcagcctcttgatgagctgggactacaggcacccgccaccacatccagctaatacttgtatttttagtagagacggggtttcaccatgttggccaggctggtcttgaactcctgacctcaggtgatccatccacctaggcctcccaaagtgctgggattacaggcataagccaccatgcctggcccatccaggttattctgatgtatgtggtcagttaactgtgacttaagggactgatctagtgacttgcttaaggttatagcctcaaagtggaacccaggattactggcttcaactccactggcagtaatactagcatggtgaatgtagacaatatgatgtggtgatcaccattttaagagagcattcatagaggaaactttatctcaaaggaatgcattgctttcaatagagtttgagataatggtaagtgataggttggtgtgtggtatctgggtaggagaagcttctcatcctgaaaatcatatgtaggtaatgctcaggttgctgaggcaggaagctagcccttaatttggggtcctgtaggtcacagagaatcccctggaattgccgactttgacttaagtgtcacttctagctacaaagggtatctcaactggcgagcaagtggccccattggctaaagccaaggagaccacatctggaaacttaaatcactctggtagcttccagaaagagctacctcaggaaagctcaaaaaagaaacaagataattgttaggaacaattttttttcacacagctttaagactgttctgttgcctgtgtcacttaaagcattagttctt

SEQ ID NO: 65437 - DNA, 1095 bp, Homo sapiens; identical to SEQ ID NO: 65436

SEQ ID NO: 65438 - DNA, 1095 bp, Homo sapiens; identical to SEQ ID NO: 65436

SEQ ID NO: 65439 - DNA, 1083 bp, Homo sapiens
ttttttgaggtgaagtttcgctcttgttgcccaggctggagtgcaatggcataatcttggctcactgcaacctccgcctcttaggttcaagcaattctcctgcctcagcctctggagtagctgggattacaggcatgcgccaccacgcctggctaattttgtatttgtagtagagacggggtttcttcaggttggtcaggttggtcttgaactcccaacctcaggtgatctgcctgcctcggcctcccaaagtgtagtgattacaggcgtgagccaccatgcctggctcacctcaattcttcttttccttccaccttaaaggcaggcttagctttggtcttacagttcacgcgttggcagaatcggggcagggggagtgcgttggtgtgcgtatttgaaactaattcagggctctgtttttggcagtatgctggattagataattctgaaaagtcctttcagcagaagcaaccaagatactgggtaaatatatttataaaaaatacttttaaacatattgctgagcaggcacgaaagtaaggaacctacggctcttcaaaatgaagcaaaagctggaatcctaggaagtaactgccaaagccagcttttcctcagaatttttgccaaattcagcagaccataaccttctattttagtgattacacaaagtatgggcaacaggaaatgagaaatctagtaggttccctcataaagctggacaccctcagtgtaaaggtgaacaagaaataaacactccatagaagggcgcagcaaggaactcatttgtctcaaccttagtggcacatggaaactatagaatattttccctgatgatttataaccacaaatggccttctatgggctttcagtccaaacttaggctacctgtgtggtccaaaaagcttaactggggaatttaaagtggtactcatttgtttatgcttccaggtgattttcagaagcaaatgcaattcctctaaggcctcagaacaattcccatagatatactttcaaggcaaatgagtgctcttgcccaaaaattataaactgaacaaagaaataaggcacaatgagtgaaaagac

SEQ ID NO: 65440 - DNA, 1083 bp, Homo sapiens; identical to SEQ ID NO: 65439

SEQ ID NO: 65441 - DNA, 1083 bp, Homo sapiens; identical to SEQ ID NO: 65439

SEQ ID NO: 65442 - DNA, 1032 bp, Homo sapiens
ttttttagggttggatgaaaggcaccaaacctcagacttagggagcccagtgaatctcaagcaagataaaccaacttacctagtacatcagggtgagatgcagaaaaccaaagaaaagattgtgggcatctggagagaaaatacagactacctgtagaaaaccagccagatggtgacttctgtgtcaacaatgaaagccaggaaacagtgaaatttatcttcatcatgttaagagaaaaaggaacttattatgaaagcttacctgaggtgacactttttaaaaagctactaaaaacattttccgacaaaagcagagtttccacttacaaaaggatgtccttgaggtggaaggaaaatgatctcagatggagaatcagatgcaagaaggaacactgaacgaaattgctaaagccttcactgtaagaggagtgtgtaatttatgggagagaaatacagactagaattaaaatgctggacaacaatagcatgtaaagttgagggagcaattacaacactaattttcgggttcttcaggaggaaagtaaagatactgataagacttgaaaaactaaatagattggtacagaagtaattgcattgaaatggcaaaaactgcaatgacttttgcaccaacctaatacatattagctggaataaccactaaagaatgaatataggacatataacttccaaacaagtagagagggaagaaagcaaaaggagtatgggcaaggttagtactggtgctgcatctgatggaacaagctgagcctgcagggcagtggtggtaggtagtggtgaagcccccacctttatatcacagcactgggtatagcgtgtggcaagttaagtagatgtgtgcagcaaagagcagagtgaagaacaagaatagggacaaagggaatagctccaagacaatttctataaaagcaaagttaaaaattggctggtaagtgagttggtcagcctggcttaaagacacagtcagtacaaatgctttcatattttgctgatgaaattgcaaagtcttct

SEQ ID NO: 65443 - DNA, 1032 bp, Homo sapiens; identical to SEQ ID NO: 65442

SEQ ID NO: 65444 - DNA, 1032 bp, Homo sapiens; identical to SEQ ID NO: 65442

SEQ ID NO: 65445 - DNA, 1053 bp, Homo sapiens
tctctgtcccttatggtgcacttaaagcatatctatactagtgaaacaagcttagatttatatatgggatcaagatgtactatctactgtcttattcaaatgccttttgctttaatcttttatttattatttatcatttttattttttgagacggagtcttgctctgtcacccaggctggagtgcagtggtgcaatctctgctcactgccacctctacctcctgggttcaagcgattctcctgccttagcctcccgagtagctgggattacagttgcccgccaccatgcctctctaatttttgtattttagtggagatgaggtttcaccatgttggccaggctggtctcgaactcctgacctcaggtgatctgcccgccttggcctcccaaagtgctaggattacaggtgtgagccactgtgcccggctttttatttctttttatcgaggttagtgactctgaaatctagctcagatttttgagatgatttagaatgatcatttatattaaactactcagcacaaaattcaggctctggaaccaaattgtctgagttcaagtccttgctgtgctactttagctgtgtgaccttgagcaaatttctaaagcatttggtacccttcatcatgggaagaataatatctacatattatgaagatgtaatgagataatgaatgtaattggacttaaaacagtacctggcacatagtgtattattactattgtatttgtcaccaggtgcttttacatatatatgcatataattagctatgcgattgctcagttattatgtccaactacttcagggatgatttcaaggggaactcaaagtgacaagcaagtggtatacatgtccacaccctagattaggaaaagatagccttagtcttttggtgggtacttagacctcttttgtccaggctctgttgtaggtgcttaagtgttaggacctttaggaatgattcttgcaaaagtgaatgttaaaggcttagagattactatggcacgcccacatggaagcatctgtttattctggtagtgcttgtgacaac

SEQ ID NO: 65446 - DNA, 1053 bp, Homo sapiens; identical to SEQ ID NO: 65445

SEQ ID NO: 65447 - DNA, 1053 bp, Homo sapiens; identical to SEQ ID NO: 65445

SEQ ID NO: 65448 - DNA, 1150 bp, Homo sapiens
tttgtattttttttggagagacggggtctcaccatgttgcccaggctcaggctggtcttgaactcctgggctcaagcaatcctcctgccttggcctcccaaaatgctggcatttcaagcgtgagccaccctgcctggcatagttaactttttttaataagtaggaggaatatactcaaaataataaaatatagtaaatacataaaccaataacataatcattcattattatcaagtattatgtactgtacataattgtatgtgctatacttttatatggctgacagtgccgtaggtttgtttacaccagtatcaccacaaatacatgagtaatgcattgtgttatgatactacaaccgttatgatgccactagtgatgggaaactacttcatacagatgctagggcctaaggctattcctgtctttgaggagctctgatcccagggatgaaggcagtaaattcattaatgaggtaagcattactataatgatttctttttaacatttagaagatggttgacttctgccaggaaggagggcaaggcttcactgaggtgacattttggttcgtttgaaaggataattaggattccatcagttggagaaggtgtgaagtcattcaagtcagatagaataatgtgcaaaagtacagaggtataaaaagaatgctgttcattaggtgtccacataggcaagaggaagtttctctttatagaaacatttcatctcataattgaaggtgtgattgaaatataatattatcattttgcaatccctaataaagggatcttaggcattgagcatcaacagctgctaacatcacaaaaagagatctgtatcacctatgaagtagtttaaaaaaatatcaagcctgagtctgatcaaacttgtagatccaaatactattttataggaaacacagaagatgggggcaatgtttaactataccataaggatgtaactagcaacatgggaggaattacaaatgacccaatttctttaataaattaattgcaagaagaaaaaaagtggagacagacctatagattaaaaaatatcagtctcaatgcatgcgtcttatttggattctaacataaagaggacattttatgagacaattggaaattcgaatactggatatttgatgtta

SEQ ID NO: 65449 - DNA, 1150 bp, Homo sapiens; identical to SEQ ID NO: 65448

SEQ ID NO: 65450 - DNA, 1150 bp, Homo sapiens; identical to SEQ ID NO: 65448

SEQ ID NO: 65451 - DNA, 1062 bp, Homo sapiens
ctcatagacatcttaaaaatctgttcttaatagctgaaaacatgcaaaaattcaaggcccttctctagggacacccacacttttctgcctaatttatcagggcccttaattgggtgcttcactggccactaaaagaaactgcaagatctgtgatgcacattcgtactgatgtgttggtgtcactcagtaactaaaaaaccaaaggaacagttttcaaaaggttgaagcaaagctttaggtgttttctcttcatctcacaatctttttttttttcttatgggctgatgttttcatctcccaccatcacccatgtctttgcattatttgtggggagggagaataggggaagatcgaaaaagtcacttttgttctcctctagaaactccgtgcccttaatcaagtcacagacctcctactgtattacatagtgtatctagtgatacttacttccagtggtggatcaggtgacatcttactctgttgccatgtttatagtactgagaggccctttcaattcaagggaccttctgaatctgcagtcttgagtcacagttgtttcttttggtttaataatctttcatattcaaggcaggtaatgatatagcccttattgagactagccaaggtgaaaatcattctccaactgtctcgtatgcttttctgctcttatgtgacaatgaatttgaaggttcttttaaaattataaaagatactaacaattttaattaggcaatctgagccattactttttatagctcattgcatctcttcttggttactgcagtataagcagccaatattgagtttccaaactttaatgtttctaaagtaaataacctaatatttgatatccccaaatagatgttgaaagtgttacaactcctgaaattcagaaagggaggtaagatctttgcactgctatgtgtatagcacattctaattaaaagcaaattaggaagtatggtctcccttttgagtataaccgtcaccccaaccatttatacaagtcatcagagggtaatgagtgtggaaatctgggtgctgtagagcagcttagtagag

SEQ ID NO: 65452 - DNA, 1048 bp, Homo sapiens
gtgagctgtgtggtcatgtggcttagcttcaatcctagtcctgtcaccttttgcaatgtgaccttggccaaattatttaatctctccaaacttcagtatgtcacctatataaaggagataataagataattatcctatgtatctcataggagaatcataaagatgaaatgatatatatacaaagcaggtcatgatatctggaacatatcaagagatcaatgcatttaagtaccactatttcatcataaattaaaaattactatctcatgtggaacaaaaattgtggtgctcaaacattacacctgctcctcatatttccctgtccctttgcaactaggtagaaccatgaactagctctataaaatggactggagaagaagcagtatgagttattttggggttgaagtatagaaaagcccaagcaaaaccatccatttgcctctccctctgctatggtaactggggagtctgcatcttccagagaatgtggctacagagggcaaaacttccattggcctgggtatttgagtaaacatgtggagagagactgcccctttcctagacaaactgtgatgcacatatattagcagaagtaataaataaatattagtagttttaaattattggacttttgagtttatttgttatggtggtgtaacttagtctccccagtctattacatataataaactaagtacattttgttgtctatgtattttatttttttgaacaaatgacatgctcttgggaaccactctccttatcattcatttcttgtttctttatataataggcttattgtgatataattaactgaccataaaatttatccatttaaaatataaacttcaatgatttttttgtatactttgggttatgcatctatcaccacaatcaattttagaacatttttaaaacctgaaaaaaaaatcttgtactgattagcagtcactcccattttcttccatgcccccacccaccacaagctttagaaaaccacttatctaatttctgtctctatatatttgtttaacatgaacattgcagc

SEQ ID NO: 65453 - DNA, 1031 bp, Homo sapiens
cttctaacgccattaagaaatattcattcctccaaaatctaaaataaatgaaaaatctgttttttttttaatgacctgtgaagtttattttccttatctgagaactttagatgtaggcaggtccttagaaataatgtaattatgtgtttaaagtttgaaagctaaaatctgtggtaagaagtccgctagagatccactaatgcattattgagccataatttgaaaaatactgttctaatcaaattgccttgttatgtagatgaggaaactgcatcagagaaggatgtgacatgctcaaggtaacccagagaatatatataagacaggagactggaacttctaacttttagttaatgcaggggctagggatcagatagcccagattcaagtcctggttctgcattcatgcgcttaagcaaattatttttgtctctttcttgtgatctacaaaataaggacaataatatcatctgcctcaaagtgttaggatgattaaatgaaatgtgtaaactcctgagcacagtgcctggcatgtgttaatttttattaattattatttatttcattgtaacagatagatactagtatataatacttttccaaaaaaaaaaaaagaaaaaaaactgaaagagtaacaaatcccaactatttaaattgcaacatcttacttgattttgcaatatctcagttttatccccaaccattttttctctccacaccctaaaagacaggatacttataccttgctttgaaaattttgttacgtgctcaggataattgttaagatttaagaaaaaatatcattaggattaagaataagtgttatttccctcgtatgttttgaaaaatggtaatataattgcttctatttttctgatagaaaaaagcatttaggatttatttatttatttatttatttatttatttatttattttttgagacagggtatcactcctttggcccaggctgctggagtgtggtggcgtgatctcgactcatcgcaggctcacctaggctcaggtgatcctcc

SEQ ID NO: 65454 - DNA, 1036 bp, Homo sapiens
ttttcctactttttcttactttttatctgggcgttggcgtacctttctcggggtgtctgcgtaactgcccagacttgccttggtttggtcagatgacacctcctctgggactggctagccagcgttcatgtctacattattgatctcgtcttccggtgtgtgagtcactcacctgtgagctcctagaggtcagcgactaaatctggttccatggggtccttgggccctcggagccctagcacaaggcccactactcagttggctcttaatcaaatctgtgaaacgaattataaagttgcttttctactagaccttgttgggacaccaaggagccggcgtcggttgcttaacttggatgcggtgcctgacctagagggaggcgaaagggttgtgagcgtgacatgactggtgacctacaccgagaagctgaagggtctcttaagctctgcggccggaagccatctgcttctgcggtttatacaatagcaactttatcagaggttacttttctgcacgctagcgtatgacattaatttgtcttcctgattcatcaaagggaatttccgttgcagttggtgatgcagtgggcctctcccatttcttttttcttttcatccattacaatcaaggaacgatttgcaagaacatcctttacccctggaaaataaggcatccagggctaaaagtcccaaaagaaagaagctggaaacaagatctggggatccaattttaaatttcacattaatcattcagttaaactgtagacaagtgctgaagtacatttttccttccagtactttgactcagataccacttcatattagacaaatgttttatattctctactgagtattttccattttcatagggctaatgtcattttcagttgtaataatcgattggcatagtgtcaatggaaattttttaagattgagtttgtagtgagcagacttttggaaggaacagtgctgacatccaatggatgctcaaagtaatacagaggaggaatctcctttcaaaaaaaaatgtacagaca

SEQ ID NO: 65455 - DNA, 1555 bp, Homo sapiens
cccgtagcgcctactccacgtgacatcctgcctggtctgccccctgccggctccgcacgccagatgtcacaccgtttccccgggagccttcgtgcctcctctctgcgccaccctcatctcgctcctgtaccttcgcttgtcgggccgtttccccactccccgaaatcatcttttgatacacccctgcactcgctagtgatccacctcctccctgacacccgcaggctcatccctctttctggcatccgcaccccctttgtcaccctatccctttcctttaggcggctctccagtattacatcacatgccctttagggaatacacagcccgatcatagccttcaaaaatgattcccccccgccttcgcgttagctcaagagccagatgtactagtgtgtttatgtagctttttttttttttcacttttctaaatttttcgcaacccttctcattcttttgagaaatttgccacttattatggtcaggttaaaagcccactgctacgattttaagtatggagtctttcatataaaattatatgagcattctttaatgtttgtttttactaagtagcatatgttttatctttgtgtttcgtgtttttaaatgtaggaacttcatccttgaaattagaatcatctgagaggaattcctttattacctagacgtaatagaggaaacatgaacaggtggccaggagcattgtcttaaattgttcgttaaaataatactcatgttaagaatactgaagcacacaagtttgtaaattctagaaattaatcacattgactattcaattcatgactgaaaacatcattagtgacctttgatttttgagtgaaaacagattagtaaaaacagagaaaattgaagtgagggggagtcagttttaagtgttccctttcttccagtagagatagtggcaaggtttgacttacaccagacctaatagatttaaaacttgaaacagacttggtccaaaattaagagttaagcctgtgtcttggcatgcttgccttagaagcctctcagaaagagaaataaaattcagaggtaatcatattgtggtattagatatgctttcaaatttttgaatgtcagctaagttaacataatttagagaatttgttgtaagaactgcagttctgtcgacagcaaaaatctgtacttacagattcagctgcaattagacttctaattgctgtagatgcatttcatcttacaaaaattttatagttctatattgtttaatctcatgaatttgaaaagatacatgtatatcattgacctcatttggatatgaattccgtgagcaaattccttaacctacccatgccttagtttccttacctatagaggataatctctgcaacgtgagtttgtgagaattaaatacagtgtgtaaagtgctagacacaatgcctgttgtaaatactaagtacaagttgcgtttttcagtaatggtgggatggtagatccttgagtggtttgtagtgaggtttttcatataaattatgcaaaatatgattttttcactctttaatattactattcg

SEQ ID NO: 65456 - DNA, 1555 bp, Homo sapiens; identical to SEQ ID NO: 65455

SEQ ID NO: 65457 - DNA, 1555 bp, Homo sapiens; identical to SEQ ID NO: 65455

SEQ ID NO: 65458 - DNA, 1250 bp, Homo sapiens
tccacccgcctcagcctcccaaagtgctgggattacaggcgtgagccactgcgcccagcctgctgtttaatttttgaaggaaaataaataatttttatctaaaacagtaattttacctgctgtcatgatttatttttgccctaactcttggcaacaaagtactagtgacgctttaattccatataactgttactgttgtatatggatgaagatgacttaattaaattccttccttttttctgcacaatgttccttgtggggaggaagaaataaggctgaattcttagcgccacccgcctcccatccaatatcattagaaaacagtagtgacaatggcattcttctttcagccccaaaattatctcttgactgtgtttttgatcaggttgttaaacaaattttcgtcataatagagtttttgttacacatttttaccttattccataatctggaaatcagaggaatgctaaagcattttagcttggcaaacttgtttcatcagtatctgggcctggtactatgctgaactaggtggtagaaagaaaaatgagacatggccctcatcttcaaggaccttggggtgtaaggcaaagatgcattaattagtggagatatgtcaaatgtgtgtatggtatacagattttcagtcataaaatacattttaagacttaattttttctacataatttaatcctttaagatatttcaagaggttttgagtccaaaccctggtctggtatctttgactttgagtcatttctgttttccaaatgacattttgaaaattttaaaaaggaaggtttattctgtattacttacttgttcgcgctagtcctttttccatatcccagcatttccctgtatacaatcttagtaatcagctgtttaacctacatttgattttcttaattaaagtgatagtaaagtataccatagtttaaaaggtcaagaaatagatagatttggattggttgaaacctctgttcccattggaaggcaaaataatagagtggataaagcattggactttagtcagaaagttttatgttccagctttgtactgtgcagtaagtggccttgagcaagtcacttaacctcttcatttataattgcttcatttataattgatattttatgaatttgcgagatgacatatttagcttacagtttttataatctgatgtttataacaacttcttttcacaatgaactatttaggggttattgggaagaggaaatatttgtggatg

SEQ ID NO: 65459 - DNA, 1250 bp, Homo sapiens; identical to SEQ ID NO: 65458

SEQ ID NO: 65460 - DNA, 1250 bp, Homo sapiens; identical to SEQ ID NO: 65458

SEQ ID NO: 65461 - DNA, 2044 bp, Homo sapiens
cattagtatactagtttttgcctatgatttttttctgattcatccatgcgttctgctagtagggaatgaaattgtcaaattaagactaggttaaaatgtataaggctttttttcattcttacatgtaatagcccttcatttatcctgtgcatttcaaaacttaaaactttagggacaaatactttttaaaaattctaacttcgctgttgagtaaccatattagctaatactgagtatttttagatgtcttccttcaggttcagattaaggaaagtagttttattttctagtatgtgaaattccatttttggtatattttcttgctaaaattaaaacagtaataaacctttaggtgacctttcttgctgtttcccttttgaaggtcatggatagtgaggatgaagaggtggtaatattctgaattgaaaaaacttacagttctttggagaagccttcagttgtacaagactgaaatcctgtgatcaggatcttaatcagtatgatgatagaaacattgaaccaactttcaaggtttttggaaaagtttgttatataatttttcaaaaatttagcaattatttctgcagtttttatttaaagatgggatgattagcagttatggtgtgttaattgggacattggtaatgtgatttaaaataaaattataataccagtcttttttaaaaaagtatggaacaaacagtgataactattgtttctaagtagaatagatttttgtattacactgtggcttctgtatttgtctgggtatttatttataacatattgtaacataatagagtctttactatattaggtttacttttgggaggagcaacaacaaaaaaactttgtactgttcagagatactctgtggtatctatatgataaatgttcagggcctgttgacttttgaattttagtagtaagtataggaagttcattatactgtcctcaccagttacgtatgagagaaatttttctgaatgaaaaacctggggatatgtctgatttttgttgttttgggggtttttaaaaaaatcttcaggctataacaatttttaagctctttactgttgctttttaatttgtaaagggcaagttacatttacttgtgaggtccacctattgtctttttacaagtagattttgatttggtcttaacaaacaattttagggtctttttaacacttcattgagtttttattatgaaaattgttaaatatacacaaaatagggaaaatagtataatgaaaccccagtattgatcacctagctgagattttgccatgcttgctatgtccatcctccctgttttggcagaagtattttggagcacatcccaaacatcatttcatctctagttagtacatttatataaaataagaacattttcttatataatcacttaatgtaacaaaattagtaatattttctttgtatcaatatcttagttaaaaataggtgttttgaatgatattctagctctgtgctgtcagttatgtagccacatgtggctatttaaatttacattaatcaaaattaaaaattcagtttcacaattacatgaactgtttcaagtgctcagtagccacatgtgactgccatattggacagtgcagatatgtttccatcactgctgaaaattctgtaggacaacactagtctagatgctttctttatcactctggaggtgaacctgaaagagatatttatattttcagaaaatgtgctagattgttcattaatgtttgattcttatttctttcagatgcatagaaaaagtaacaactgataaaggtaagacttggtcatccttacctctagcgtacattacactgattatcttttaatctgttagaaagcctcatcattcaaattggttcccatttaaaaggaatttttatttggtaaaaaattactggagttagaaaatatttagacgacagcacgtttggataatagagtatattggcattatttagaaacctaataaaggcaaatcagattgtttgatggtaatttatagtaacttttttaagcc

SEQ ID NO: 65462 - DNA, 1063 bp, Homo sapiens
aaaactgaacaaatatacttttaggcacatttcttttattacgtgtgaccttgacccaggcttgacacagccagtttccaaactcctagaatccacctagtatccatagcttttaaggtctgcttatagcctgctactatttctataaaagaatatatgtatatgcattttatatatcagtgtatgtattacatgtacatgagaatcttaaggtttttctgttcttgataaataattcttcgagaacgtataaggcaagtttaaagcctggattttgtgccatatggaagaatgatagtgtaatttaagaaccaataacttgcattggtggtggctgctttgtaaataattaggtttcaatgctaaggtttcttatttctctgaattttggaatgtgagtctaatatttcatagtatagcaggcagaggtttttcatacctggcatttttttttttttatttagaaaccttggcatgattattttgtctagcaagttttttgttcctgttgttgttacttagaaaataggttatgtctgccaaaaatggaaggtctcacatttcttattcagagatcaatttggagattttatgatgtggagaaaatatagagacaggtaacaagtctagagcattctgattaaaacaaaaagcaacctgcttttgtcagagctgaaattaccttacgtgtccaaagaaatcactatgggttgccttgaggcgaacttgaagaaaggtggaaatttggagccccttttggagagaaaagtagatgacctttgggtagacgtcttttttttgtttgttgagtaaagacagggtttagccaggctggattcgagctcctggcctcaagtgatccgcctgcctcgtgtgtaaatgttttaaactagaagttgacttattggcatgttttgtggttgtgcagctgtggagagattaaaactacattctggataatttgatccgaagatcaatcccactttactgtttaaaggccctggatctagatattctcaaatgccaatcttcatctctgttagtttacccattaaggtagctg

SEQ ID NO: 65463 - DNA, 1063 bp, Homo sapiens; identical to SEQ ID NO: 65462

SEQ ID NO: 65464 - DNA, 1063 bp, Homo sapiens; identical to SEQ ID NO: 65462

SEQ ID NO: 65465 - DNA, 1070 bp, Homo sapiens
attttaatatctgcagaaattctgtgaaagcctaatattttttatcctttctgtcagtgcaccagtggctgatgtctgctttgaaatcagtaagccaggaaaaaacatatgtagatggagtaaacagagatgactagaataagaaagaaaaatctaggcattaatacacagtgttgatttaaaaatgagtaaactgttttggaatgtaaacattctaaatttcttaaatacaattttaaaatctcatttattttccggtttttaatcacaataaaatttctctagttctgttttgaaacataaggaaatacagcatgtggctttaggttaaaaattcactcatggaataattcttacaggtgtttcaggttagtatattatataaatggggccctcttggcacttgaatccaaggctgggtggaaatgagccaaatctggattgagcccttgccgtggtgctttccatttctcgtttatatggttaggtgtggtatagtagaaagaatatagactggacttagatatacccgtgttcagttccctcagcagcttttaatatgtgcacttgggaaagtcagttacttggtttcttcatctatgaagataagaataataaatacttgatagggttataactgatttttgagaaatgaaaaaaatatatattacctagcagttaatacttaagatttgttaattgcccagaagaaatttaaatacttaaagagagatttgaagacctttacctttagtatcttcccagcttatcaactaaccacaccctgtttcaccctacaataaaataatagcattgattatgttagaatggcccttctaacttaaagtattttatcatgaccaagtggctctcatcttttggaatttgatggtttgacttgttataataattatctctggctgtaggattgagataaatcatatttcattgtctgctatctagaagaattagaagaaaacattcctgccagtagtatcaatctttttttttttttttttggttttgagacggggtcgtactttgttgcccaggctggaatgcagtggtgc

SEQ ID NO: 65466 - DNA, 1070 bp, Homo sapiens; identical to SEQ ID NO: 65465

SEQ ID NO: 65467 - DNA, 1070 bp, Homo sapiens; identical to SEQ ID NO: 65465

SEQ ID NO: 65468 - DNA, 2342 bp, Homo sapiens
ttttaacttagatctaaaaggtagaatttcatgaatccagttacttaagtgtattttgcatagttagcattgcattttttagaagataaggcagtataaaattactactttgcaacatgaagtaatttctttagcatgatgacattaaggataagttttatctcattttcctttttttattatttcaattaaagtcttcagttttttttcctttgaaaatatttaatttatcttcaactgtatttacaattagtagatatacagggatggttattggttaactgtaaacttaaagagaatggtatgtctttttatttagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatggtacagtgcaactagaatatggctgtttactaactagttgctgttacattttaaatgtaatgttgaacatttgtgttaacagcttaactgtcaggggcaggtttgatggtgtaggtggtatttctttgaacagtttgcagatattctgcttttgtataattaccccatgcagtaatttgatttgcatttcttgactgcagagagaaaatatcttatatctacactaataaaattttgtttttggctttgtttttctagatgttggagaagagcatcagtctccaggtggcattaggtaaaaaaaacattaatatttcatttttaaacctttggggacatagcatagtcacagtaaatgattcagaagttgcttccatttgaaattattttgagctgtaagagaaattaacttcagttttgatactgcatttagattccatgttgagcttgattagaacttaaaccatgtaatctacttacatagcttagaaatcatgtcttgagtatcttctgtgtttggacttattccatggtaggcactaatgtgaaatatgggtgttttggccaaggttttgagattttattggaatcttttgtgttgtgatttatctgttagtaggtcttttaatatagcagatcaccagacagtattacaaagtcagttgtttcttaacttttaatgccattgagttgtcatcaccctgtctttatctaggatttatgtctttttagtttcaattattattctttgtgataaaacagctagatttcagtccaattaggtcattaggatgaaaatgctagatgactttatcagtgtttggctacctcttaaaaaattaccaaataaaatcccctcagacatgttcgctacaaccagaatgtctcatttctatttacttatttttagtagtgaagaggaagaggaggaggaagaagagatgttaatcagtgaagaggagataccattcaaagatgatccaagagatgagacctacaaaccccacttagaaaggcatgtctcagattttactgcagacatgttaatgaaatataagtaggaaagcactgttgcatgcttttattttatctgttgccaagctaatgggtatagaattaattttaaatgagtaattaattatgcacttcttttgtaagtctaacaccttaatataccctgataataatcctctttcccatttgtagaactttattttgattatatacaagtttttatgagtctgcatgttttatttcaacaaggtatcatgaattgcctgaatacttagaattttttaactaattgtctcgtttctctttacaattatagtgaaatttgatttacaggcatctttagtctggggagggttcattccatgagcaacatatacatatatttggatcattactatgcatgtgaggatgattggtaggaaatcacatttcatgaactgaggaaggtagttttataacaaatcagtgataactctaagctttaatttgttgtcatagtcttccttgaaaagatcttttgtctagtattgaaatgcatttgtgttttcagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagtgagtaggcaattattaaaaatgaaaatctaacagattttgaacgactagtggaaaaaagagtgggagtgtgaggaaggatgttgacgtatacatgcttcaaaatatgtattt

SEQ ID NO: 65469 - DNA, 1091 bp, Homo sapiens
gtatttccacctatgttcttagccactttattatactccctcactatccatgtgtgaaatctaagtatttggttttccttcagtacttttgacttagcaaagacaagtactttcaggaagccttaattttttttttttcgcccctttcactttctctgttttagcaccacattaaataccagcatttgctgaagaagaaatatgtatgtccccatccctcctgtggacgactcttcaggcttcagaagcaacttctgcgacatgccaaacatcatacaggtacttttaaaatgtgtttatcaagtaggtaattgcactgtgctttagttttgcatgttggtaatgataacgtttttctaacataagtcttaaaagattctatagtcaagtgcggggaaaaggtgtgaaaataaaatgtagtaagacaaattttacaagggatgggcagactaggacttttgaatttttatcctttgacttcttgaacttctatgaccgggataatgatcttctattgagcatttattctgtatcaactgtggactaaatacgttatgtatattattgctaattagtctattcaacaccactaaatttgtttatattgatcttattttacagctaagaaactagaagcttggcaggattaagtaacctgcccatggtcacatagctagtttttaggagaagcataatactctgctgctattgaaactgtgaagtctagctgttgaatttgcatgtaaactcccataggaactgtcaaaaagagttgctgagtgtctgcaatatgtattatagaatagactcaaattcaatttatttgtaaccactgaccatctcagtgcagtgtacctaataggaacaaattgggtgcataccactgagtatgtcccagacacttgataattacacattaccttctcaacagtcttagagagtaagtctaggaattctagttgtagaaatatgtctcctgcccaaggtcatactgataaatgaaataactccttcatttactgtaggaaagttacttaacttctcttttcacttttccttctctgtgtattaaggataccaatatcagttat

SEQ ID NO: 65470 - DNA, 3254 bp, Homo sapiens
atctgggtgagaaggatatatgccctacttgaaggtttgccgctttacaaacatattagttgccactgctgtttactttcatcaaataaatgagtggatattgattgggggcattagttagtagcctttttcttagtttccctctgtttttcaggcaaacagaagaagatcagattagttttccatctagtaacatttcccaatccttcaaaagaagtatgttactgattattgtgtgtgtgtgtgtgtgtgtgtgtgtgtatgtatatatatgctctaaactctaaccctgatcctgaataagagcactctttatttctctgttggatcagccatttccttttctcctctccttagatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagtt

SEQ ID NO: 65471 - DNA, 1530 bp, Homo sapiens
ttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaagcaacttgtcttccttggttgtactgagttacagttatcctaggggtgaaacatgtgatgctgctaagcaaaccaaatgccctcagaacaggtgttatgtggggcatactattgtttgcttttgttgagaatcaggtggttaatttttgactgttcttgatttctaatgctgaaatgacatgattctgttattcagcaaacttggaaatcttgatgttttgacaactgcctcctaggaaaactggccatatgttaattaacctagtagatggaaaattaaggattatgtgaggttaattttaccctgataatgacaaaaccttgatagcatttaatattaatacttcttctcaaaattgaatgtttatatcaagtactgatttttattttaaaaaagaaaaaactataatccttctgccttccaaaagccatgctgtgatagctgcccaggctgctctgttacatctcccatttattgtttacttttataaatttgcttctaagatggtatgtgtttcagcttattggcaatatctatgatataaataatgaaagctaattatttcatttagcccttacccaataagcatcattttctaagttaaatgcaatagaatgacaaccctccaagtaccttttaacttttatactgtcatttcaaagcccagctcattctcttattttaagaagcatgtggtatgactgggtaggggagaaaaaaggaaagcatgttgtcacttgagtgagactgctttagaaatgttaccaagttagcgttgggtgtttcctgttctttggaagagaacaggcctaaacagtaccttcctcctcctatgtagctaccaggaaggcaccgtgattgaaattagagatgcttccttgcttgatttttaagtataaattaaattacctttaaaaagtacgtaaggttaggagtgaaaaaaatcctgtttttaaaggacttcacacaccctttgtttcttgaacaagatgtgaactacctaaacagaaaatgaaattggaaagtcagtgggagagacaactatagaatcagacttctatttaaattcaagcctcgttacttgattttgtgcatgttatttcttgaagtttcagtttcttatatggagaaataacatttacctcagaaatattctgaagatcaaatggaattgctttaaagtatttagcttactgactgacccatggtagatacttaataaatggcagctgtgtcaataacaattttattgaa

SEQ ID NO: 65472 - DNA, 1057 bp, Homo sapiens
ttaaaatcagactctttagttgatttaaactcttagagaataagaataataatggctaacttttattatcttctatattaaggcagtatgccaagggtctttatgtatattatgtacagcgtttacaaccttgtgagcaaggtggtgttactcccattaggtagatgagaaaacaggctcacagagatttggttaagctcacacagctaacaagtagcacactgagtttgaacacagatcattctccttgtaaaagcctatgtgcctttcactttagaggcttgatcatgaatcactgcacctctttgtcacagggtgttggaagatgcatccatgtaatctattcccatcgctggaaaacagctgctgttagatgtcctcagaagtcagttgcaaattttagcgttaaagtcaggatttattgttcatacttggcggtgaggagggcagctggagatcttaagattccattttggaaaatgattaggcccgccaaacttctgaactttggaagctggggatgtttagtaatacagcctggtttttaagtactcactaaaagttctcaaatattgggttgggcacggcttataccaggttacctcacttttaattagtgatgcaggcagtgtaacccaagcatttgtggacaatgagtggaatactaaagttaaaaagtcaaactttcacctcagattttctggacttagtcatgaggagagggtgaggcccactctgttcctactggagataccagagactctgaaactatagaataaagcctctgtgctgcacaacaaaggggcaggctctgcttttatttcttgtaagaaccaacatagtatgaaaggttggtcaatgcggacattaatggaaaaggccatgtactggtggtgtgatgtgaatccagaaattttcaagtgtgtcatttattttatacttatcaattaaaactcaagatcatggattgggagaccaagttaatttaattaactggggcttctgtattcgtaaatgaaccatgagtcagggctaactcccataggtttcatgaggt

SEQ ID NO: 65473 - DNA, 1006 bp, Homo sapiens
tcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagc

SEQ ID NO: 65474 - DNA, 1089 bp, Homo sapiens
agggttccatccctcagggggtcagggatcctcagaaattatagacaaacctttgtatggggaggaggggatttggtcattgttaccgggagaaaatttgccgcttttcatgagcttctcaaagaggcctgtggactcattctgggcactgattaggaaacctgttctcactcaattgtgcttcagtttttttctcaccaagtggcctgagactgcctacttaatagggtattgggtggcaatagttgaaatgctgttagaagatttttagtcctgactatcccaattcctattgttaaagaagaaaacaaacaaaaacccatgaggacaaaggagaaaatccacaagaatcattcagaaaattctgttggcatggctcatagcttggaggcactttctttattctgagtagttaaaaatccagagtgtgcctcaggaaacctgggcttcaattttagcagagccactaatattacagaagccacatatcttctctgcactgcagatttcttcttttgtaagacaatagatgatgaagatgatggacaatgatgttaaacatttactgagctcttactactcatcaggcaccactcacttaacatttataacagccccataagggaaggactctgcgtcattcctgttagagagatggggaacaaaagccccaagagagggttccagctaatgcagtgggaggtagcagctctgcatccaaacccaggtctaaggacacagaaacacgtgctaaatgaccactcacagtgctttttgggtctgttctctgttgaagctttatgggaattattattgtcattattattgaaattagtcacagcctaaccccgctcttatcagaaatattttgaaaaatgccatttgcttgcttgctttctgctttcagggaccggaacacccgaatcctgggaagagtttcagcgcccgaggcttcccacgacactgttaccttccggacagcgagaaagggagaaaagtaagaccggaagtttccacatagaactaggttttagaatagatcgggcagtttacttctatgtcaaggcctaaagttttgcttcttacaat

SEQ ID NO: 65475 - DNA, 1036 bp, Homo sapiens
ccttgacctcccaaagtgctgggattacaggcatgagccaccgcgcctggctggcaattttttaaaaaactgttacacatacacttaccttataactgtgttgcttttgaattcctttctttctttctttctttttttttttggtaaatctttgtaatgggccttattttctttcttcctagtttatctcctttttctttccataattagaaacaaatgaagggcaaaagtcccttttttcccgttctttgggtgtgttctccaatttaaatgaagatatttcttctcacttagctcgctttgtcttcaagttttctttcctctctaggcaattttgtccaaaatctatttaatgggtaaatccgaaaacaagctgccaagaagtattctaccttcgaggtagatgcctactagactctggcaccacgcagcctgttcaaatcccagctgagtacttactggttgtgctaacatgagcaaattgcttcatcccttgacctcattctctatatcagtaatttggagacaatagcatctccttcattagacttttgtgagggttaaataagttaatctatgtagagcatcagtacttagagcgttgcctaatctgtaataagtgtaattatatgtgtgctaccttaaagacaactccaggttaataattcccacacacagcttcttcaataaatatatctccaatatatttatggacattcttttagaggagctgcatgtttcccacacgtgtgtcctcaaccacttcatcagaacatttgctgttttgaaggaattaggagatatttgccttccagtgacccagagagtcgtgacagtgtatgacagtaaaaagagcacttgcttggtttggcttcttctctgacatcttattagcagaccagagaaattgttcagtgcaagggctctgggatcaagactcatctgggttcaagtcctggctttgccactgtgtgatttgggcaagtgcataacctcattgagcctctattttttcatctgtaggatggggataata

SEQ ID NO: 65476 - DNA, 1644 bp, Homo sapiens
gatccaatttgtctcctttagttagggcaatgtgacatggtcctagatccttttcacagatcctgtttttgtagaacagccttggtgatgtggccttggcagtgtacttagttgttgctctttaaatagggtctgggctctgggattaccatttctttttcttgtcttctacttttaggaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggtaatgaacttcccttctactcttctttcttgatgcatggagaatgccagcactaatttttttctttcctctcttttccttttaggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctct

SEQ ID NO: 65477 - DNA, 1007 bp, Homo sapiens
tggaggccacagtgagctacgattgcatcagtgtactccagcctgggcaacagagcaagatcccatctctaataataatttggatgactctctggtgtttgttataacaggacctaaccattatttatcctaggacttccagtatagtcaggtaagctaattcacagtgaattctatatagccaagccctgttctccacccttgcaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgtgagtatcagcatgcatgctgcccagataccactttgaccttgactgtggagcaatattgaaggcatttctgcctgccctctcacttaattatgtggggaattgagcaagggaaattgagacttttggagagattaacagaaggttgtcattgtatgatttgacttgtagcatgcttatttcaaggaagttcaaaccaaactacatctgacaaaaaatactttgtgctttctaaaggtcctttggattgtgattcagaagggtatttttctactatttagagcaaaactgttcaaaagtggctagaggaggaaggtgcctaccacctgttaacaatttagcctaaaggcccatcagcagccaggtgcggtggctcacgcctgcaatcccagcactttgggaggccagggcaggtggatcacttgtgattaggagttcaagaccagcctggccaacatggcgaaaccgtctctactaaaaatacaaaaattagccacatatggtggtgtgcacccataatcccagctacttgggaggctgaggcatgaggatgacttgagcccagaagtttgaggttgcagtgagctgaggtcatgccactgcactccagcctaggcg

SEQ ID NO: 65478 - DNA, 1736 bp, Homo sapiens
tttattcttcattatacaacagagggtcatacatctaatgaggactagagtcaggatttaatccagttctgtctgaattcaaagccccagctctatccactattccatttttacaattaagggccttagataagtggtttgtttaaggtcacacagctagtaacttaacaatagagcctggtcccggtacagactaccaatgtgtgctccttccataatgcagttacttccatgatgcatgttggggtgcatttgacttgtttctgtaaattttgcaattgtattatagaacacagcgtcctagctaaggtatatcagttgccagggtttgtcatcatttagttatgttttattcatagatttttgaaagtcaagtgagaaaaattcagtcaatacttccaacatttaagaaagtgtaagtcctttttgatttattgttttatttctaaaagtaataaatatcaatagaaggaaattaatccattactgttttgaggctgcatggtgctatttttctgacatttggcttaatttggatacctctttctgcttccaggtaccattcattgtattttccatgcaactgggcaccactacacttggaagaaagttaccacaactgtacacaacattattgtgggcaagttgtggatagatcaggtgaggaaaggtacccaaagtgtgtgtgaagtttaaaagaatacttctttaggtatatttctgcagtatttaggacatgtgaactggtctcagaatgttgctactgattcatcagtttctcctaaggaatttctctcaggcagtagccctacctctaactctctaagttttctgtaccacaaattattgtttataaatgaccaaattataacattcatcaatgactattctgctaggactgtgttgggtgctacgacaggtagaaaaaacaaacgtggccccaactcttaatcctttcattattcatcaaatatttattgccaggcagtatgctaggtcctggggatacaaagtctgatgagatgtccctcaataatttattatatcattggagatacatgaccaatgtgtaggttggaaaatgtgcagcaacatacactaatataaaagatgccctatgatagtatctaattaattgtcagttttctcttaagacaatggttgcagcaaatttagaaaagagggtatactgtcttctgagcagtcaggaaaggcctcacagtagatgtgggagttaagctgaatcttaaagtgtggtttgggatttagaagatagaaaggaagggaaaatgggctgggcatgttggctcatgcctataatcccaacaccttgggaggccaaggcgggaggatcacttgagcacaggagtttgagactagcctgggcaatatagtgagaccttgtctctacaaaaaatttaaaaaaaaaagaaaggagggaaaatgaaatgaatcaagtatagaaaggccgaccatatgtaatttgcaattgtgagtagagtattttgatttaagcagaagagttcatgaagggtactagtgagggattggtttggaaaggtaaattatcatgtgtacttcagtatatgtgctgaaggtcaaatcatgccatctaacatgtgagatacaattcaaaacaagtggacacttggtcttgatctcaacctggaaaaccaaggttacatagggattctatagcattcccaaggctagctaagatctgaatcttaaacaag

SEQ ID NO: 65479 - DNA, 1062 bp, Homo sapiens
gaaagttggattggggaacatcaaagggaaaagcagagacaacataggaaactgatgaggctgggtgtggtgcctcacacctgtagtcccaggtgtggatcacttgagcctgggagttgaaagattagcctgagcaacatggcagaatcccacctctatattaactacaaaaattagctgggcattgtggctcatgcctgtagtcccagctacttgggaggctcaggtaggaggatcacttgaacttgtgaggttgaggctgcagtgagccatgattgtgccactgcactccaacctgggtgacagagcaagaacatgtctcaaaaaaaaaaaaaaaaaaaaaaaaactgaaggtgatgagttcactttgggatgcattaattttgaagttactttgagccgttgaatagggagttggatattctattctgaatctcagtaagtgctgggctagaattagtgatttagtagccattagcctataggcagtggttgaaaccatgggagtaaatatcctgtttaccttttagcttctctgtaacagggaatagatttttaagcttacgttgcttgcctccttcctttatttatttattaagcaaactttatcagatccctattatgtacagagcaactaaattaggagctggagatctatatatgaataaactcaaaaatgtgtttttaaattgcatgtgatccatctggagagatagaaaatcagtcacgatactgctgtgcatgtgtaaaatagaagtttgtgcaaaatgcagtggaaatgtagagaagagactggctgcttatgagactggtggggagatgtcacaaagtagcatttgccatagatcttaaagaaagatttgccctttcttagaaacaggggatagggatggacattctaggtagagtgaatagcatatgctgaggtatgtaggcctgaaagaaatctgtgtccacgactgggcacagtggctcatgcctgtaatcccaacactttgggaggctgagatgggtagatcacttgagtccgtgagttcgatactagtctgggtaacaaggcaa

SEQ ID NO: 65480 - DNA, 1321 bp, Homo sapiens
ctgagggcagatatggtccgtgtcctcaggaagatcactatttagtgagggatggagaattaaagggatcattatggactatgttgagtgacttgatagaaatgagcacaggctgctatggtatagcactttggaagtatttggctcagactaggaaatttctctaatttcctcaactaaattctgaaggagcagtgagagtcttcctatgaagaaaggcaagctagagcttggggcctggagtccaactgccttcatgacctatctctgtaacttgaggcaacctgcatcccgtccaactgcctctatgacctatgtgtataacttggggcaacctgcatcctctgtgacatcaattccttatctgtaaatggtaatgatactagcagatacttcaaaggcttgttgaaaggcttttgtcagataattgatgtgaagtgctcggcaaagtgcctgacatatgattgtctctggcaaattttaattacagtcagtattactaaaagggaatgaggccaggcatggtgcctcacacctgtaatcccagcactttgtgaggccgagtcgagtggatcacctgaggtcaggagttcgagaccagcctggccaacatggtgaaacccccatctctactaaaagaaataaaaaaattagccagacatggtgactgaggcatgagaatcacttgaacccaggaggcggaggttgcagtgagctgagatcgtagcactgcactctgtagcctgggtgacagagcgagactctgtctcaaaaataaataaataaataaatgaaataaaagggaatgagggagaagctttgatccaggtagtggtatgggatattcagatctatccctttccccaaagtctgggaactgctggtaattgactgttagtcgagcaaggaagcagctagcatgaggcttgggaggagttaattgtgggggagagaaagggctgcagatcataccaactaagcttggtagtagtggattagaagatgagaccaatttggatgcagtcataatttttttctttttttttgagacagagtctcgctttgtcacccaggctggagtgcaatagtgtgatctcagctcactgtaacctccgcctcccgggttcaagcagttcttctgcctcagcctcccaagtagctgggactacaggcgcacactaccacacccgactaattttttgtgtttttagtggagatggggtttcaccatcttggccaggctggtcttgaactcctgaccttgtgatccacctgcctaggcctcccaaagtgctgggattacagacatgagccactgtgc

SEQ ID NO: 65481 - DNA, 1339 bp, Homo sapiens
gaaggacctggggtgtttgtggtgcaggtgatctgtggaccacactatagagaaaccatctggtaatggcaagttttcagtgagtcagaatgcacacagcatgaggaatgttggtttgtttctggacagagtaggtagggttccaactgtcactcctggttctggaatcatataacctttcttttcattcctacagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgtgagtgcagatggtgtctgtgttgctttttgattcattccctctttgaaacataattctccccaaatgcctaaaaattgtaattgataaagcacagaacattagggcctgcttcactggtcaagggctttaagttacattgtttactgcatgaaatagaacaggctgtacagattgaatgactttcatgctctgcttaagtgatcaggaggtctttgctgcagctgggaatcaggagtccagggttccttcactgactgctctgcaaccactaggacatctgatcagtattagctgagtcccttaatttctctaggtcgtgattttatgtatgtatgtatgtatgtatgtatgtatttatttatttttgtctcatttcatctgttggaactaaaagatctccctgagtcccttccattgtcatgttctttgagctttgagttggagtcatctccttactttactaacgcattcaggcataaagggtggtaagtggaggctagatcaggtactagtgagaaccttatagtactagttattcccatctttagtccttgaattcgaggataatttcgatgataagacaaaatattcaactttgggcacttttctttaaaaagagtggtaaaacttcagcctccttatgactcctaacttgggtggctgttgttggtttgcagaacattttagctgcttgggtgcaagactctgagtaaacagagcacccatggcattaccgatgtattgatacgtatgaagtgaatacatggtttaaacagtgctgcttttcctctactgattcttgcctggcaggttgttttagttaccttctgcataaaaacattcaaaggcatttcataagtgagaagagtactctgtgagaaattatgta

SEQ ID NO: 65482 - DNA, 1829 bp, Homo sapiens
acaagagctagtggtacctgtctgactacatataaaactccttccaaaacataccaaaccacatattgggaaatatgccataggcctgccctagtcaacttaggtggtcccacccataaacaaaccagcgggatccagagttatcaatctgtgcactaccctcaaaattgcactgaaatacctcctatcaagtatactggcagtttattttttcctgcaggattcttctggtcctcatcttcctccaagaattatttagacaagttgtcattcctcctgcttttcatacctccaaaacctgcagtttcttatatatgctgtttccaaaatactgttttccttttaagtgggattgtgtacttcctagacccatcctcggatgagctgtcctaataggccttggcaaaccacttcctttacctatcctgggcttccttacgtacccagttacttagatgtcccattacttaaaaccttatatggaatcccaactctcccagaaacattgtgacaggccatagtattagttctcctggctagcttctagagattgaattactatttcagctagccttttcagggaagaactttctggccagaaaataccacctaatattgtagtgcctgaagaacctatcttgtaccctgagattcatgtctttccagcttctgcactaatcatttataatcataagtgtatctgcccagactcaagagctccgagatcaagtctgccttactcccagagttccttggtattttttaaactgctacagactttttgtaatttgagaaacttctttagtttacaatgatgacccaggcagaagagattcctacaatgatgacccaggcagaagagattcctaagaagtggtttccaaaaagctccaataaggaggaatgtggaggaaggtccaagtagtatacttggagtagaaaacatgagcgagctggcctgtcagctgtgcatctgtaattcagcctgcattattcataatgtaactgaagcttgggggtggggaggtaagaatagaaaaaacggattcatgttacagtgtggcaggtgcaggagatggaaaatggcccagttcattgagacccttctggccttcccatactatttgaggaaggaagagcagttcatgtgaaaaattgaacaacaaacctgtcttccagactttctcaaacataccaaatcttatggggtgtgtgccatttctggcatgcaggaattctggatatgccaggtgtgtttggctgcttgactccactgaaagggaaatggctctgctttgtactgtggcagttggcaaaggactttgacctctgtgttccaatttggacagggaaaagtgcagtctcaacatgcaggttcctgggcataaccagcgggtggtagggaaatgacacagtttgtgttagacactcgattgtgctagaagcttgatattttatgtgaagcttggtattctatgtgaagtgtcttatagcttgttgtcaccaagtaatgctgtaaagttcaaaagttagtctattaatagaactgtcagtcactagagatcgggaaaatttttacacccagttctctgagagcagatctgctgaatctttcctagctattaatagacggcttaggagttcccaccagtagagtatggtggaccttaggaatgaacatattccagaaagattaaaacacttggtgattcctttttacttccccagaaagctagttattcttatttcatatcatttgaaccatagccaatatttaatactctaaacatttaagggtgctttttttacacttctgcgatataactcta

SEQ ID NO: 65483 - DNA, 1029 bp, Homo sapiens
cgctctgtcgcccaggctggactgcggactgcagtggcgcaatctcggctcactgcaagctctgcttcccgggttcaacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgcccgccaccgcgcccggctaattttttgcatttttaatagagacagggtttcaccatgttggacaggctggcttcgaactcctgacctcaagtgatctgcctgccttggcctcccaaaatgctgggattacaggcatgagccactgcgcctggccagctttctgaatttgacagccatctacttttggggggctgtgaagttcattgtgtgagaagcagaactgggaagactgaaggggtcttatatttttcctcccctcccagctgtgcttaaatacatttaatattgtggtccctgagaacttagtatttgggtttttaggaaataagtcttagtctgggaaatcagtatcctaaaatcacctaatagcatttttaccttcttccttcttgcatcagaagcacagttgtgaatagattgcaggtctcatgacagcctctgctttgcttcttattttgcaaatgttgcatgtaaggctgttctgaggagcttgtttattattcagcatgactctccaagctcccagttcagccaagttcgttccccaaagcaatattaaccaaaatcagacttgagatctgtgaaatatctagcagggagctaggtaatcagtgacacgagtactttgccagttgtgaatataaaatttcttaaattgcttagattgcactaatctagcaaatgagaaacaaatctgcatataactaacaaaaggaagttttctcagatttgaacccccagaaaaaacactgctaacagtttagtgtatt

SEQ ID NO: 65484 - DNA, 1005 bp, Homo sapiens
ggagacaaaagaaaaacaagttcgagacaagaggagaaaaacccttgttataattgagaaagtaagtttagaatttgttgctgtagttagtttcaaatacggaactgtcaaatgtatgtatatactagaactgaaacagtgagcaatcagtcaatgttctttggttttaattcatgaatatattgctggtaagtgactattgtgtaccacataactttggaaaggattatggtatgtttcacctattggcatcatggaaagaacactgcagttaaagttggaagtgtattgggtttttgtccaagcttattcagttaacagctgagtgtctgggcaagtcacctttctaagcctgataaaatgggaatgaaaattacattgtcctacctgtggattaatttagttcacagatatttactgggcactattctgggtgctgaggaaaataatggatattaatagttgatttgtaaaatgtaaataccacattgtaaggccatacaccatagtggttgaaagtatggactctagaaccaagctgcaaatcatgtctttttccatttctgagtctgtaacttaaggcaagttatttaacctttctatgctgtcctcagtttctttatctgtaaaaatggagatgatagtagtagttttctctttggattgcttttttttttttttttttttccttttgagatggagtttcactcttgttccccaggctggagtgcaatggcgagatcttggctcactgcaacctccgcctaccgggttcaagtaattctcctgcctcagccacctgcgtagctgggattataggcatgtgccactatgcctggctaattttgtatttttagtagagatgggatttctccatgttgttcaggctggtcttggactcccaacctcacgtgatccgcccatctcagcctcccaaagtgctgggattacaggcgtgagccaccgcgtctagactattttactgtctttgcctgctagaataga

SEQ ID NO: 65485 - DNA, 1049 bp, Homo sapiens
gcatggcggccatatcacaggggcttcagaataggacttagttaatcctccagctttcttatcattccttctccctcagtgctaccaaaatatatcctcttggagagaatttgcaagtcagaatatctgctggtatctccctcagacagcatggaagggtggggataactggagaattagctaaatcttcctcagttaatgctgacactttacttgatttgtgagagaaagtggcccaaggttctgtatttgaacctgtagccatagcaatttgcttagaagtagggctttgcattgagttcgtgtctctaccagtacttgaggggagggagtgtaggtggaagaaaaactgatttcattgagtgtagttgtatatatgtttgtcctgatagattctgtgtccgaagcctgtccatgttcggcccccaatgccacctcgttatcctgctccctatggtgagaggatgtctccaaaccagctctgcagtgtcccggtatgtcactttaagcctaacaaaaatgtgcagtatgtattttctgatcactatttgtaagatcactgccagtatttagatttgctgacatctcctaaattatacctattttttataatctccttacttaaattgctggatctaattgtccccaggtcagaggacagttgtttcttacatcagctcttttcttacctttaaaaatctaaactcattgtgatcatctggttcctaccatttcagtcccatgttctactgcttctttttcatgtcacatggtcatggtgtttttataatttctagcattactctttttttctattccagagcttgactctgtaatttgagagtttttatatccaagtttatactgcatttctgctgagtttccttattatgatgtaccccctgttttatagcatattcttttttttttttttttttttaccttagaactcttccctcctgggtcacccttttcctcctagtgttcctcctgttctcagccccctccagagagcacagcttcttggaggagcacaggtaagcctgtga

SEQ ID NO: 65486 - DNA, 1223 bp, Homo sapiens
catttgcttagcagaagaattgtgtaggccgggcgtggtggctcatgcttgtaatcccagcactttgggaggccgagatgggtggatcatttgaggtcgggagtttgagaccagcctggccagcatggtgaaaccccacctctactaaaaatacaaaaattagccaggtgtggtggtgggcgcctgtagtcccagctactccagctacttgggaggctgacgcagagaattgcttgaacccgggaggtggaggttgcggtgagccgagatcacgccactgcactgcagcctgggcgacagagtgagactctgtctaaaaaaaaaaaaacaataattgtgtaaaacttttttgtaccactatgaactatttcttacatgaactgtgtcatcttatagatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaagtaagtaagttactgtgatttgagaactatagcagactaaaaattaaagtgaagtattgaactttgccattttattttatctattataatgagagatttacatataccatagaaaattgataatatatttcctgatgatagaagttctagagataaacttggggaataatgtatattctggagccctataatttcgtattctaaagcagcttgaggctcttttggaaccttgttccccagcagcagataagtcacccagagagtatacaacatttcagactctgtatgttttccttttttgttagccccaaccaggaagtctgaattccagtatctgggatggatctgaagttctgaggcgaatccgaggaccactgcttgctcaggtattaaatattttctctttacataaaatttataatatccaaaaattttaagttcctgtcgtcatcctttccttactgaaggggtttataggtctttcatttgctagaattatgtcgactactgcatccagcacttagctatgcctttctttagcctccagggtaaaggttgcaagggagccattggaatttaaatttgttagtgtatgattgtgatttgaat

SEQ ID NO: 65487 - DNA, 1047 bp, Homo sapiens
ggcatctggaataatacctgctattacagtagacattttaggtcactggctacaaatggtcacctttccttaagaaactagtcttctgcatgaaaaaatgtttgcatcatcttagagcaataaatagtgttgcagtaatcccaactccttctctaaaaataaaagcttacacttaacatggtgcttattatgtgctaggcaccattctaaatattttacatatattgttaatcctcatagcagccttgtgagataggtactattattatcctcattttaacaaatgaggaagagtgacgggttaagtaactatagacacaattactgtaaactactagttatgtttaatagttttgggggagtctttggaaatctcctgcctccacttggaaggaatcaccctccttcctacctcccttttattgatagctactatagtctttagagattgagattgccttaaaattaaatcacttcttcctttttattttgttttcattcaaaactccctgagacaggcttcaggggttattacaagtataagtttatagaagcagccaggaattcagtaacccgtatcagagtataggttagttcgttattacggataatctctttcccttcatttgtctgttattcttttgcctaccttttatcattttgaccaataatggactcaggtcaagcactggcatatctaagtaactatatttttaggtcatttgaaaaagatacagggtgaaatattgttttatagtaagggcacaatatctctaaaatactacttcagataattttttacaagagtaagaaaaatctaaaatgatgatgatggtattttatggcatagattcctctggttacatgtttgaaaatgtaacaatcaattcaccagagatctattctcacagaatatggcgacttaaccaatatttttaaaatattattattaaggggaaatagattatccatatttgataggatttggtaaagttagcaagcatgaatactggaagtagtgatagaaaagcatgcaaattagaactc

SEQ ID NO: 65488 - DNA, 1009 bp, Homo sapiens
ttcatgaataactaatgtcttttctttttttttagtctttggaggattgtcctctggatgaagatgaagatgcatttcagggactgggagaagaagatgaagagattgatcaattcaatgatgatacatttgggtcaggtgcagttggtaagtgacatctttcgcttataatatcatcttagcctcctgctcttttcaagtgctgtcttttagaagtgctttatcttattaggggtaaccttattcactaacttggcaagatattcttctattcctcatcttagaatagttcattcttcactggaaacagcacctatcctgctcctctgggtctctttttgccttacctataaaatcaggtattctgtaagccttgccccttccagctatatgatcgatgactacaggttgcccctatgagggattcaaatgtttagagaagtaaacatttaagagagatttaaattaatcctagatgagaggaatttttatttgtataacatataacttatggaaaactagtgtactagtagaaaattcagattctaggatgtgggtatatgtgtttcaaaatttagtctatcactagtatataactttgcaacttatagtatcttcaaaatataaagctttttatagcaagaattttgggggtcaagaaaggactcataagttagaaaagtatgcacagatgaaattttgtccatccctgggtatagatacatattatttatttatttatttattctttttcgagatgaagtcttgctctgtcacccaggctggagtgcagtggcacgatcttggctcactgcaacctccgcctcctgagttcaaacagttctcctgcctcaggctcccgagtagccgggattacaggtgcccgccaccacaccgagctaaccaggctggtctcaaactcctgacctcgtgatccgcccatctcggcctcccaaagtgctgggattacaggcctgagccaccgcgcccagcctatagatacatattt

SEQ ID NO: 65489 - DNA, 1083 bp, Homo sapiens
cggggcagggggcgggctgggggagtcgcaggacttagctggacgcgactggtctggggtcgcgggtctaatcctagggctgggagctggcttcatgggtcgagacagtcccattagttgccgctggggaaagttggcctccgttttggggtggggagggcccgttaagtgctgtaaccagaccacacccccgcccccacccctagaggagccacggagggtagagcactgcatctccccgggtgcttttcttaagtaggtgtcacccgggaattcccagagccgcgtttcccgccctggacccggaaccaccccccacccacctccactcgaattacactgacacacatcccattcacacaggctaccttcaggtgaagggggcctgggcttgccgttggattagggccccagcccgtttactaaagagggctccgagttgggaggggggcgtgtcctgcagaagttccttctgggctagtgctgggagacgcgggtttggagaaggtgccgggaatgtagcaatagcagcagacagtactgaccctgtcaccaactcactgtgtgaccttgagtgactcctaatctctggacgtaaactttctgaatttgtagcatgaaagaactgatgtaaatgatccttaagaatttttaatttaaaaaagcagcgatttggtaaagtagatatttgtgatttggaagggagtactgctggaagttgcctctgataaggaggcagtggcatgcctattggcatgagtttggaagggctctggggtaagaagaacgccctttgacctaatctttccattgtaaacagggtagctaagaggtagccaggcaaggtgtatcacaaacgtacctactgatagaatatggaattctgattctgaatttttgaaaattgaggacaggtatacttgataggaatgatctaagaccaaaccaaaaggaaaacttggagaataaatcagttgagtaagattgaagtaaagggggaaaatagaacacacctaggatgtggtggcctctagcctttgttcgataatctgtaatctttgcccactttgatcatcacaactc

SEQ ID NO: 65490 - DNA, 1006 bp, Homo sapiens
agttcttagccgactccttgctaggcggggacaagctcccgaaaacaaataagacaatgtgatgtgggctacattgggtggcagtcgagtgttctaaaaatatcccgccaggaggaaggcattccgagtagcgggatcccgcgcagcctcagggctgctggcagtgaaagtggggggatggaggaggtgtccagaggaaagacctggagatctggagatacaggacggtcagggtggtcagagaatttggatcttttgcttgttggaaatcgggaccgctccgagaaacgtaagcagctcgatgttgttagtgccagtggagacacttggcactcacaatttgcagacgtttgggaaagcatcgtttctcaagaggaccccgttcccgtgtctgtaaatcagagatggtacccacttcgtagttcgctgtgaagcctgtgagcgaggaggggctttaaaatacagaactttgcactggagcgctccccgtcctcgcagcctgcttggtgtgcaggtggttcccaggcggcttctgcttccgaaaagcagatcgtccctttatctcgagtcttctccccgcctctccctcttctccctaccctatttgtcttcttgggaacaaatggcacattcatcagagtggagatccataaacgggactggcgagccgaagatttaattctgaagaataggatctgctctgtgctttcaggttaaaaagctgtaaatatctttgtaattctagcagtactttgccctcttctgccatctgaacgcgtgctccctgctgacctcatcggctcccataaagatacggtgcgtatggcagaggtcgggctttgagccggccccgcgggtctcggccgtagttctctctcgcgtccggcacacttccttctgcccgctgtgctcgctgggcaggttgtccccgccttagtaccaggagggcttccgcgccccctggtggtcatactaggaaaggcgagtagatcagaaatacacactg

SEQ ID NO: 65491 - DNA, 1062 bp, Homo sapiens
tacagaggttgtccgagctgagttttaagggctaaggaaatgtttgtcagttggaccaatgcctttcagcagaactccctgtgtgatagagtgatctaaaagaatggtgtgtccagggaatggtgtgtccaactgcttgcttggtctagagtgtgcatcatagaaggagaagtatgggtggagctggatcttaaagggccccacgtgctctgttaggcactgggcctttaaattataggagctaagctatcattggatgatgttacgtggcagaaggacatgatcagttctgagtttagggaagttgatcggggaggtggtagcagtgccctcaaattcgactcccttgaatgtggctattaacctggggatgctgattgttgcagaccagccagagaatgagatgctgggggagccaatcaagagactgtccacatggctggagaatcccaaatagccataggatttcccagtaacaacttctgccgtggattcagggggatggtcgtgggtgaaggaaagaggcttctggtggcattcattgcccatggaattctaagtgttcgagagtgctatatcttggacttagagggtcagaggctgatgaagcttgtgaagaagcaggtgtggggggtttatcccctgcctcacctccacctttcacaacagtcagttctctgtgcttagaaatcagcaatgtgctgtgcagcagctgtctgggaagaacattgaacaggaatgtagaaacagctcaggcccttatgctgggtgggaatggaatcacttcctttagatggccattttgtgaatttttacagaggaagttgaatgagattgagaaagcttgggtccccagaggtggctgggggccgggggagagcttcctctttcttataaacaggagcttctgacagggagtgacatagcattgtttcctttgtgataggtggtttctgaaaacaggaaaatctttactcctaatgtgaaaattgaaagcttgtcctttgtaggaattgtgtctggaacctgtttgaacagcatggagaagggtttagcgaccct

SEQ ID NO: 65492 - DNA, 1068 bp, Homo sapiens
cgcttgtaatcccagcactttggggggccgaggtgggcggatcacaaggtcaagagtttgagaccagcctggccaacacagtgaaaccctgtctgtactaaacatacaaatattagctgggtgtggtggtgggcacctgtaatcccagctacccgagaggctgaggcaggagaatcgcttgaacccaggaggcgtaggttgcagtgagccgagattgcgccactgcactccagcctgggtgacagcggtagactccgtctcaaaaacaaacaacaacaacaaaaaccaagaggaataatgtttgtaacacagcatagcatctggcatatatgtgcttaatgaatgataattcaaaaaacaaaaacaaaaagctcactattgttgaagtttctgccaccatactatggtttcttaggtttttaatttcccctggaaagaaaacaagaagtatcgtgctctttttgcagagagaatgtgatgcttcccatcctctagactgtggatgtggaaaagtaaccctccagttttttttctgaaaggaatggagtggggcatgacggttcgtgcccatttatctgttagagtaataaacaggaattaagaataaacttgaatgtgtgctggcctgattgggaagttggctgtaaactctccacagatccccaccctcctcacaggcgggtccatcagagtcatagtgagatcaaacaacacttaggctttgtgagtccagtgttactccaattgtggatcgtggaaggacaatatcctttcactccgtgatgggggtggacttaaggagatgtttgaagtctttctagctcatctcagtctgccttggagaaccagatacattaaagaacttcttccctaagataaggaatcttttccaataactgtgttctcctttttcttctgagccagtcagagggtccctgagaggaccctctttgttaggtgtgaagatggtgggctttggcctctaaaacatggtttgagtccacttttcaagcatttcgtagcagtgtaaccttggtcaggttgcttaacatctcttagttttaatgt

SEQ ID NO: 65493 - DNA, 1131 bp, Homo sapiens
caggattccagcatgatcgggttctggtgaggaccctcttctgggttgtggactgccaccttgctgtatctgtatccttacagggtggaaagagcaagctagctctttggcctctgcttataagtgcacaaaacacagtcatgagggctccacccttacaacctaaatgccttccaaaggtcccatctccctctaagtaccatcccattggggattaggcatcaacatattaattttgggagagcacattcagtccataagaagtatgcatttgtagtggtataacagaccatttgtagtgatataagaagcatacttgtctcctgcagttacttatattcatttatttattcagcaaatgtctactgagtaacccacatgcttgacagtgatgaatatcaagtagtctaagttgagcaacacgtggtcctagtgcttgaggggatctgaatcagttctgggagaagttagggtggataaattgtgggcatagtgcagcagagcctggctggggtgaggggtgggtggagcaatacctggctggaggagctgtgaggtgaccagtcttgaagcatatggatttgctaggtatgcttgatttttgttagaactaagaacctcaaagtgaatccaacttggaaatccacacattaaatctagcaggttaaatactttttaattctttaagtagaatattggatgacaatgacctaccaggcaaactggtagattctgcatttctgggctcttccaatggggcaggcaggaagccttgccagtcatttgcctatttgcattcaggaccattccctactgtccttcctctgctcttctctgtatcacagggaactacatttcccagcttcccctgccaattgcttttggtatatttgactaaggagagtgttatggactgaatgtttgtgtcccctcaaaattcatatgctggagtctaatcgccaatgtgatggtatttggaggtagggcttttgggaggtaattaggtcatgagggcgaattagtacccttataaaaagagacgtgagaaagatgatctctctctcagccatgtgaagatactggaagaaggcagctgtctacaagccaggaagagggtcctcctcagacatc

SEQ ID NO: 65494 - DNA, 1227 bp, Homo sapiens
tgaactgtggccatggtgggtgcgggcgggctggcgtgcagagagcaacatttgttttctaaagcaaagaagcaaacaaattaaagaggacttgactgagcagctctaatatgaagactgcttgggattctgtcattttttggggaaagtgaaggtgtataaattgtgaaaaggagggatcatttgacagttaaaatcacattgctcttgtcacctcgcaataagttttcaatacgtaaatatgcagcaattaatgctcaactagaggtacaaggtacctgggagtttaggagaggccgagactaattcttagggagaataaacagagcttttttgcttagccttccatcttaccccatgcaacctgccagttccacaaactagtactttctctgcttttccttgtttaattagattccactggctaattaggtccagaaggaagaggccatccagatctcgaaaataactccttccttttagttatagttattagtataatatagtaattatatttggccacgcccaacatgtagagtgattgacttgggtgttgaccttagatttccttgggtggctactgatgaggtcagactgttttattaagacttttttacaggattgctatgaggattaaatgagacatgcctgtaaatgcactgcatagtacctggcatatgacaaatgtgcagtaattgctggcatttttgtatttatcattgtcatcacctaacatttattgaacatgtactttatgttaaacatttggcatgtattgtctaatttaatcttcacaaaaactctaaagtgggagttgtgataattctcatttcacagatgagagaactggtgcttagggacacttacagggtgcgttcaaggtcataaaactgctaagagagatggagcagaaactggaacctggtctgtttgatcttaattccttaaatcctatattatctggattcccgtattactaacaaagcattgaaaagtacattttaggctgggcctggtggctcatacctgtaatcctagcactttgggaggccgaggtgggcggatcacttgagctcaggagttagagaccagcctggccaacatggtgaaaccttgtctctactaaaaatacaaaaaaaaaaaaaaggttggtgtggtggcgggtgcctgtaatcccagctacttgggaggctgaggcaggagaatcacttgaacccgggaggtgga

SEQ ID NO: 65495 - DNA, 1960 bp, Homo sapiens
cctgatatctgccactacagataagcaaaaaaatccgtgcgttccacggtttggacacgggtggtttagggctatatttttggttccttaagaacagggaacaagcctgacactgtcattccactctttcatttttcccatgggccctcttacctaaagactgaagtgggaacactttagcagagcatatgggcattgtcttgatcacattcctgccttcccagccagcctgtctcctgccatcctcctcctgcttcccacgcttcagccagagcaactctgtctggttccccaggcatttcctgttcactcataccctttacttactgtttcttctcgtggaattcctgcttttagtctctttctctacctggccaactcacagtccttgagactcagtcctgctcatctccatctttagaggcttttccagatccctccaggctgtgcacaccttgaccagaactcataccttactccacgctgcatattagagctgctgatttatttctcctttgtctcccactagactctaacaccttgcaggaaaaatctagatcttctttctgattccatagtttctagctctgttccaaagttgtagtaggggctgaaggatggcttttgaatgaatggttatagctaacacttagtttgctccatacaacctaggatgtgtgtagtaggtatgtcataaatatttgcctcattttaagttgattagccttggttgaaatctattttccccataagctccctagaaccttctcaaccgaagctcccgtggtaggctctttcctctaaaagcagagtttccacaattttatgtgctgcaggattactcaggagggttgaaagagctgattttgtggttccaaccctgggtatttttattctgtagactgagatggggtgcctggaaaatgcctttaaaaaaataagcactctgtgattctaatgacagatgctggggagtgcgtagggataaataccattctgggcagtggatgcccgataaagctcccctcctctgatgatgattgctgtagttcacaaaggaatcagtcctctcctttctaacggattctgcctgcctttatttacccagaaaccaaggatgacctagagcagctcacgactgagattaagaaaagggccaacaacgtccggaacaaactgaagagtaagaagggaacaaagaaaacaaggccgtccccaccaccatctatctcagctcccctagggtccagctttccgaactgaaactcctcttgatggaagtgacaccacttggtccatctttgcttgtggtttgggctctgtccccgcaatgatccattgtagccccagaaatttaccttttcttaaatcctgactgtactggaaagagtccagaattgaagctaggagatgagaattaaaatgtgctttcagctgctgagtagttttgtgacttggtcctttaacttagtctttcaacttgtctctctttttttttttttgagacggagtctcactctgtcccccaggctggagtgcagtggtgtgatctcggcttattgcaacctctacctcctgggttcaggtgattctcctgcctcagcctcctgagtaactgggacgcacctggcccatcaacttttctcttattggtcttatttccctggcaactacatacttttttttttttttttaagacagaatcttgctctgttgcccaggccagaaggcagtggctcaattttggctcactgcaatctctgcttcttgggttcaagtgattctcatccctcagcctcccaagttgttgggattacaggcatgcaccaccacgctcagtcaatttttgtatttttagtagagacgaggtttcgccatgttggccaggctggtctcgaacttttctggcctcaagtgatccacctgcctgggcctcccaaatcgctgggattccaagttt

SEQ ID NO: 65496 - DNA, 1080 bp, Homo sapiens
agatatttcttggtgggctaggcataccaccttcccataccctcactccccccatttgggagagtatagttcaatgaagctactgtcatagattcagttcttccagagcctagaaggtttacttagttctgttgctagagcctgcattcttgcccagtgtatttggtgcatgcatgctattgatcagaagagaaagcattattgctcagctcaatttaccatttcttccccccaagtatattgcaataactattttaactggaggagtcattagtagcagattccagtaataacagtgatagtgcacctgccattgtgctaggcactttatgtgtcttctcatttaatcttcacattagtattgtgagggagggactgttattctgttttacagatgagagaacaggtacattaagaggggttaagtggctttttcaaagtcacacccagtaagtgccagggcaaggattcaagcctaagtctcatggtgaccagaacccatgctgttaactgttatgccaaaacctggtcatcgtaaaggctgtggaatgcacgtcctgtggctcatctgggagctgaccttttgaggtgacacctacctgttacatctccgtgggctggatgtgtgggaatgagtgaggaagtttcactgaatagcatgtttcttggaggcggagataggttgcaagtataaccttcctctcctctttaggcatggagaagcatattgaagaagatgaggtcaggtcatcggcagaccttcggattcggaaatcccaggtaagacttttcctggtctcatgattagctagtccaatctcttattgttttcccttaactgtggagggattttttttttttaatacaatccttattttgaaactcaatttgaagacctggtaaaggagaactctccaggttgaaataggggtcagggccagagtccagcccttttggctcctctcctgtactctccttctctaaggaggcccctgaagagcttttcaggcttcctagagcacagcttaggatttagcgtgccttcttgttttacaggagaggaaattaatgtcttctaac

SEQ ID NO: 65497 - DNA, 2860 bp, Homo sapiens
gggaggataaaagtatggtgtaagttgctgggaggattagagaaataaataaagccataccctttaggaatgtagtaatgtggaaggcagggccccgtggagtggaaggtgctttggatgagaggaatggtatgaacataatcaagaaagagcaagtgtgtttaggagtggcaggttgtctagggtctggagaaagggtgtgtctggagtagcataaggttaggatggattgagggagggcttgcccatgaactagcatgttatgagggccttggacaccatagtgtagtgaatggggcaaggaaatgttctgagctgggaagcaatgtaatgagataagtgctttaggaaggtaactgctgatagtgttaaggatggcttggattagggcagaaataagatgagtcaggaggcaattgggggagtgttgtaaaggccacggtctttatagggaagtcacgttcctaattttcagggtccttatcagatggtgtttcaccgtgatcttatatttgacgctctacttcttttgttacaaagctggcaaaaagacaaccgatgaggagctggaggagatgttggagagtggcaacccggccatcttcacttctggggtgagtgccctgtgtgctcggatagcacatccctctcgtgagcagggaggccactgcggagctcatgcagtccagcaggtggagggggagctgcaggtgcagggagttcagggaggcaaggagctccccaggagcgtgcatgagggctgtggcaggggcagcctttcttgcaggggtagctaacagtctgtgtgtggcctgttgtagatcattgactcacagatttccaagcaagccctcagtgagattgagggacgacacaaggacattgtgaggctggagagcagcatcaaggagcttcacgacatgtttatggacatcgccatgctggtggagaatcaggtaagtggcagtgagtcccagcgtggggagggaggagaggaaagctcagggtctactgagaacagggagaaagggaatactggaagccagtgaggtagggtgggagaaccattgggaatttgcataaaggagaaacagaatcccatgggaaagtgtgcattcaaattgaatgttgacactttgggtgatcttaaccttgtcattcttgcctgtccctttggccttgcagtcgttgctagttgatacagggtttgatgtgttctgtcaagtacccagttttcctggatttttgattttttttttttttttaagatggagtattgctctgttgcacaggctggagtgcagtggcgtgatcacagctcactgcagcttgacctcccaggatcaagcaatcctcccaggatttgtctttttttctttcttaaaaatcagagatccgggctcctaatggtgacgttttaaaacagcctcctgatatggactagttcactgatgacattgaaaatgtgatcttttctctagttcacagggaagactcaggtttaacataaatttttatttttttccattttttttctgtttgtatttttttttaattttggcaccttttgctaaggcacagagcagacaacaacatgaatgaaggagtagcaaaatagcattgacagaaagactcgaaacactcgtggtgctagtttgacagcttactttgtcccaggcatgcttgctcgggatagaattctggattgcctgcatagggcgctagtttcgcatagttagatggttcctagttcttatgggacagttaagtgtgccacagggtcatggtgctgtgcactgttgccatgaacttccagctgctctgacacttgggataggagagaaaattgcttccatagtaggcagactgcacaacctagttgaagctcgagcacagcttgactagtttttgacattggttccctgccgagggcctggatgctttccccccattccctactggcctctgagaccatttctcaagtccctccatcccacctcttcttttcccccacactgccttgccgaggaactggcttgagattcaagtggtggtaagtgccttgttctgtttacagactgccataaagtgatagagttgggttgggtagttgaggagaattcctaaaatgcctaagattaattggaatgatcaaacttccctgtcaggaagtgattgctaggaaatggttgggaagcttatcaagagaccactgtctggaagggaaaatataaccaaatagcttgggtaaacccaatgtctgtcagttaaagggcctggaaataacttagagaaagcaaatgttccccacctcagatagttattgagcacctactgtgtgccaggcactcttctgcagttagtgaatatactcaattcaggctgaatgatgttgattcaggtctgaatgaccaggaagaggccagcatcctagtgatgtcctaataacaatgagatatccttattttggttcctctccatgtgcttaagtgtaaaaaaaataacaaaggttgtctggggatatctcagagtatatttataggtagttactaggtatctagatagtatgttctggatgcctggtggagtgctggtcacagagaagtagtaaaattcactgaatgtttcttgaacaagtgactgccaccccaccaccaaggactgtgaatgggtgtcctatggaaggccatgcatcaaggtttgtggatgctcttcttgccactgaagattgtaagaaagagaatcccttccccgcattggctaggactgacctgagacgtttacttggtgtgatcagagtctgttctttgcagggtgagatgttagataacatagagttgaatgtcatgcacacagtgga

SEQ ID NO: 65498 - DNA, 2005 bp, Homo sapiens
gcttttcctagagacaagctgcctgcccttccttcccaggtgtgccttgcatggatctggctcacaagctatctccccaaaaacccacacttgaaaggcagttctgtaggatggatgcatggcccaggtggtgctgctaatcttctcctggacttagctcatgaggctttcagatgttacacttgactcctctgttcagaaaccttctcttcattgtcttccactccaggcgcccaagctccgcctcccttctctttttctctaccttgtacctagctcatgctaactgctatctatacattatgtcatatctgatggagcacctgttatttctactttataaatgagacagttgagggtcaggggctcagtaactggcttcaggccacctagtaagtagaggcactgggattcaagttcagatcccaatcattctgtttctaccacaccactgtatttgcccaccctctggtgcccctgccgcttaaggacttctaggcttctgtgctcacgactgtggttatccagctctggtggcgtctgctttttagacttctctcctttgactggttctcttgggctctgatattgttgttgtttagttctttgtttttcatccaactttacctattgcttatgcagggatttaggggactgggaagttattttacatggtgaatccaggctgggtggcattttctgatatccaggcagtgtactgggtctgacaggtaggagtatgggcaaaagtaggaaattagaactctatcaaaaatgcctttacattccctcttaaaatggaaaaaatcagtcagtgactttttatcttggccaactgctccttagagaccccacgatagtggctctgattctatctgtccacatatacagaactgcagtgtgagctgagagctgagagaggccccatatttccctctgctggcattcctagcctagaagtaatttaagaaatttaaactgtcctaggctgggtgtggtggttcacacctataatcccagaactttgggaggccgaggtgagaggattgcttgagcccaggaatttgagaccagactggggaacatgggaagatcctgtctctacaaaaataaagaaaatgagctgagcatggtggtgcatgcctgtagtcctatgtactcaggaggctgaggcaggaggatcacttgagcccaggaggtcgaggctgcagtgagccatgatcatgccactgcactctagcctgagtgatagagaaaaaccctgtcttaaaaataaatgaagtatcctagaaggatgtctgtatgtagagatgtaggcctcttactcagactggtaagatattttctatgtagaggtgacaggggttaggttttggatgagttgttatttttttggttgtttgtaataatgatttgtttttgtcttattcctctctccagaaattgataattatcattgtgctagtagttgtgttgctgggcattttagcattgattattggactttccgttgggctgaattaagagtggcctaagaggctgctgcactgaaatgtaagtaaacgagtggttcttggggactctggatttggctcctcaagaggaaattagcttgggatttcaaattcctcttctttccccctatgattgtccttggacacactgagctttctaaaactttcagtagcctgtggattctttatctccttatagttctattggtttctggctgcagtacgtggatgagctctccgtttgttcttatcctgtagattctgtccccaatctctgtcttgtcgtattaccacttctcccagcatacctgagcaccccaggtgactccccttactcaggaagcatgcttctaagttgggtacatctctgtcttggatctggagtctgtcttctgaattcttactgattttcatggatgttgggctttactttctgtatccttttcaatgtaaatgaaactctgaattgggatttggatctgcagagtttt

SEQ ID NO: 65499 - DNA, 1012 bp, Homo sapiens
agttctgggattataggtgtgaaccaccacacccagcctaggacagtttaaatttcttaaattacttctaggctaggaatgccagcagagggaaatatggggcctctctcagctctcagctcacactgcagttctgtatatgtggacagatagaatcagagccactatcgtggggtctctaaggagcagttggccaagataaaaagtcactgactgattttttccattttaagagggaatgtaaaggcatttttgatagagttctaatttcctacttttgcccatactcctacctgtcagacccagtacactgcctggatatcagaaaatgccacccagcctggattcaccatgtaaaataacttcccagtcccctaaatccctgcataagcaataggtaaagttggatgaaaaacaaagaactaaacaacaacaatatcagagcccaagagaaccagtcaaaggagagaagtctaaaaagcagacgccaccagagctggataaccacagtcgtgagcacagaagcctagaagtccttaagcggcaggggcaccagagggtgggcaaatacagtggtgtggtagaaacagaatgattgggatctgaacttgaatcccagtgcctctacttactaggtggcctgaagccagttactgagcccctgaccctcaactgtctcatttataaagtagaaataacaggtgctccatcagatatgacataatgtatagatagcagttagcatgagctaggtacaaggtagagaaaaagagaagggaggcggagcttgggcgcctggagtggaagacaatgaagagaaggtttctgaacagaggagtcaagtgtaacatctgaaagcctcatgagctaagtccaggagaagattagcagcaccacctgggccatgcatccatcctacagaactgcctttcaagtgtgggtttttggggagatagcttgtgagccagatccatgcaaggcacacctgggaaggaagggcaggcagcttgtc

SEQ ID NO: 65500 - DNA, 1038 bp, Homo sapiens
tgaggcaggagaattgcttgaatccaggaggcggaggttgcagtgagccgagatcatgccactgcaccccaggctgggagatagagcaagactccgtctcaaaaaaaaaaaaaaaccagtgattcagtggtaagtctatcacttttaacaaattttcaagaaaatgaatagtctaaattttagcatcgctatcctctaaggttctccaggctttatagttaatgataagtggctaccttcttttacaaagagaagctaggtccactattagctgtgtgaacttggccctgttattcaacattctctttgactgagtttctttgtctgtaaaatgtgcataacactgtatctgtctcaaaggatgttgtaaggattcaatgatatgtgtataaggtgtttagtacattgtctggtacaacacaacactcaaaagtgtgttaactatcatcatttaagacccaaccactcagcaacagagaaaactctgcagatccaaatcccaattcagagtttcatttacattgaaaaggatacagaaagtaaagcccaacatccatgaaaatcagtaagaattcagaagacagactccagatccaagacagagatgtacccaacttagaagcatgcttcctgagtaaggggagtcacctggggtgctcaggtatgctgggagaagtggtaatacgacaagacagagattggggacagaatctacaggataagaacaaacggagagctcatccacgtactgcagccagaaaccaatagaactataaggagataaagaatccacaggctactgaaagttttagaaagctcagtgtgtccaaggacaatcatagggggaaagaagaggaatttgaaatcccaagctaatttcctcttgaggagccaaatccagagtccccaagaaccactcgtttacttacatttcagtgcagcagcctcttaggccactcttaattcagcccaacggaaagtccaataatcaatgctaaaatgcccagcaacacaactactagcacaatgataattatc

SEQ ID NO: 65501 - DNA, 1111 bp, Homo sapiens
ttttgtgactttaaaacaaacaatttttttttgttgttgagattgtgtgttgctctgtcgcccaggctggagcgcagtggtgcgatcttagctcactgcaacctctgcctcccaggctcaagtgatccttccgcctcagccttctgagtagctgggactataggtgtacaccaacacgccaagataacttttatattttttgtagagatggagttttgccatgtcacccaggctggtcttgaactcctggactcaagcgatccacttgccttggcctcccaaagtgctgggattacaggcatgagccactgcgcccagccagtgacttttaaaatatttttctgaataaaatatagcatgcattgttaaaaaaaaacctataaaatacagaaaacataaaactaatgaacttttaatattattgctgataaccttgtggcacgttcacatactcagacatagttttacatagttcagactatattatccagttttgtacccagttagaaaattataagcatcattccacagcattaaaatctctttgtaaatctaattttcaatatgagattgtggccatactctcaaatatttaacattttcacaatgttggaggtttatgttattttgctgtagctaacagtgtgactaaccttatttaatatttttctcatttaaattttctctttattaccaactcatataagttggagtactgaaataacaggtataaacatttttaagacttggcacataataccatgccagtacccagagctgtgccttccttttatatttgtttcagtgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagatataagagttgttatttttccatatccttggatgaaagat

SEQ ID NO: 65502 - DNA, 2302 bp, Homo sapiens
gcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaacggttctggctctgtctcgatgcagaaacacaatgatctggtgccaccatgtggtgatttttattcaggttttagaatgcagttcacacctttttaagccatgtgctggatcagatggttcaaaagtgcaatttttgaacatggtttaactcccacagaatgcagtgtaactatgtttgtgtttcagatttgaggtgttccccccaaaagaatttggttcagtccttgggagtatctggctttaggaggaaatgggggagatctgtcacgatgttatctagaaggtggaatgaccataccaaacatccttttaatctaacttgaatgtctcaccaaaaataacatttctgttggcattctgggtcctagaagccagatccatctcctttttccttctgttgctctcttccttcacaccctcttccatgtccacatgcacttatctccctgcagaatactttttgcgatgatgtttctcatgtattctttctttccttgtctggatgagcagaagaagatcatgatcatgatc

SEQ ID NO: 65503 - DNA, 1031 bp, Homo sapiens
aagaccagcctggccaacatgctgaaaccccatctctactgaaaatacaaaaattagcagggcatcgtggcgggtgcctataatcccagctactcaggaggctgaggtaggagaatcacttgaacccgggaggtgggggttgcagtgagccgagatcgcgccattgcattccagcctgggtgacaagagcaaaactctgtctcaaaaaaaaaaaaaaaattaaatagttttgaagtgcaatttttatcctgacctgtctatggaagttagggaagttatggagtcgtgcagtaagcagcagacacaatgtgctcaacagaaccgggtggaatagatacccacgtggtatcactcagttgtcaattccttagcctttgtcagtattccttcttgatatcttcctgaagaatttggatcatcttttctttgaaaaagaaaagatgcttttttcctttccatgacttggcatttttcctcctctcctcctatagcttagacttctccatgtttctttactgcttcctctttttgcaaactataaacatgccctaaaagttaattttctcctctgtgatttatttctgtattttcccctaccttgagaggggcatggaaagaacatgagcatcagattcagtccaacctgggttccactctcaactctattagttacatgttatgtgatcttaggaatgttactaacttctttgggcctaagggttctatctgtaaaatgagaataactaaatatgtcttatggttttattgggtgcaagtatctgctatctactgcatgggttcttgacttaggtcatcacctctaagagatgactgtccaatttattttttgcatgtcctgacctcttttcctagtacttcctctatgcctccaaaagcctgcctttctgtttctttctttctttctttttctttctttctttctttctttctttctttctttctttctttctttctttctttctttctttctttctttcttccttccttccttccttccttcctttttcttt

SEQ ID NO: 65504 - DNA, 1046 bp, Homo sapiens
ccaaacttcgagaaatctgagaggccaaagaaagagactgacatatccagtttatcagaaagaatcatttaatagagacttaagaacagaagccatgactatgtcacatacagcaaagtgacaagatgatggattgctgtgccattgcccccagactcagggtttatatactatagggaatgaatgtgtacaaagacacaataggaatgggactcggcactcccaatcccactaatgcattttttttcagacctgctggtcctgcatgctgcccctggggtgctgggacacagcccagggagagggcagaatgcagtgctcatggcagagcaggtggcccccaaggctccacactgctgctgctggctggcctagcactgtcgggcaacaaagggcagaggcttcaacctgcaacttccctatttcaatttggccaagagtgcctgcatcacctcctccataaccttcaataaagaagccccagcatgccccaccccaccaaggcctgtactacgaactggtaaaggccctatagctgctggagatcacaactagaccatccagactgtaaaccaaaaataaaatcctaagttccccaactgacttacagatctcacttcttggccaagggtattccaaaataaacctgaaagtctagttcaggctgtgatgggaagggaggtaggacaggcctcattataatctcctccctttgaaattcaagcacaactgactagcattaacatttaatacagagaccttgagaatgacaaaacagactctctgtagcaataagacaccaaattccaaccctctctagtatagaatcacatgacagcataaaccaaaaataaaattctaagcttccctctcaccccacaaataactgaatagaccactctttttggccaaggacattcaaaagttagcctaaaacacaaattcaggccatgattggaaagactggttggatatgcctcattataccctcctccctttggaattcaggcacaactgaccaacattcacattaaaacagtgacctt

SEQ ID NO: 65505 - DNA, 1050 bp, Homo sapiens
gggcatccaacccctggaaaagaacccaaaagaatcccaaattaaaatataattcaaatgaagaatatttctgcctgtgatgagtaggaagaatatttctgcctgtgatgagtacaacaaaggttgtactttaagagttaaacccattaaggttggaacgtttgtgattaagaaagaccagtggagggatagactccctactgtccttcatgatttcctcttttgactttctatagtacatcccccacaccatgcagtcagcagacaggcctcttccaaccacaagtttttgtttatttctgtctgtctccaggcattcggaccgaccaaccagagactgccagaaaagcagagagtatgcaaaggggagacacagagatttcacatgacaggatattcagtctgaaactactcactgttaaactgacactggtcaggagacaatctttgatttcatatattggataatagtactccgaataaggcaatgaggatagataatccatttctgagccacaatgttgagaggcagtcctcagggctaccatgctgtcagcaaggaggaagaggcctgctcctgcagtaacagaactcactgcatttgaggtcaagctgctcaggtcctggaagagaaactctgcattgggttctcatcacagaatcagcacgtgacactattagtcctctgtccattgtactgcaatggtgcttccttgggtctgtttccttcctgtttccttgtgtgggcacaaactgtgttttattcatctttgtatctcttgtcgctatttagttaatcatgtgatataattagtaaatgcttattgaataagaaaatgcatggataattcctccttagggagaggggttctggcccattgactctctatagcactcaagatagagacagtgctgctcaggtcactgccaacatctcccatgacttcctcaatagccttagaatcattctgttgccttcagggcttctagaatatggacttcggtcccctctggtaaactgaatccatgactttgatttacataaaagag

SEQ ID NO: 65506 - DNA, 1107 bp, Homo sapiens
gggattacaggagtgagccaccgcgcccagccaagaaggccatttttaaacaatagaatgagcaccactggttggtgccacaggattgcagagatttggatttacatggtaagattcatgggaggcagggacatgcttgctgtgtgttgagaggtaatcctaagcacttgagaagatctctttgctgtcttccacctaatggctcatgaaaaagggcccagtagatctgtttctcagagagtgtccagggcagagtagtttaattatatatagtctttaatttttaattaaagttttcttacaatccctaatatgtaatatttaagcaatatgagtgtgaaaataatacagaaacagcctgcagagtcacgcaacttaccaaattcacactagcatgagtgcacattttcccttctgtgtatcaccttctgctcagtttacccaaagcagtttataaagtttatgaccattttggaagactggctgataacatttattgacttgggctttgaggaaattattttcaagagaaattaaataacgactcatagtaaacaaatacaaaacaaaagcttttttttttttagtttgtttcacagtatctaaaatggcagagatttcaggaaagtctaatcacacttgaccatgagtgttgagttgcttttccttcctctgaggccaagagttacttatatccaagaccgtgaagaactctttttgacctgttggatatgatcttgtgactgggtcgaggaaaatgaactctagaaaatacataattggttagaatttttaaactttgatttcggagattaaaaaagataactcataataccttttccccaagttttgtgtagtactagttcttccaactttgccataatatgtaattgcagcaatattaattaaaaataatgcaattctccagtctgctaattattttactattttaaataggatcatagttaaatcataattcatccaaattctataaacatttcttttgttgttgtagcctttaggggaaatgaaaatattttaaaattataacatcaagagctaaggggatgtaaggaagagcacagggaagcataaacaggacagaga

SEQ ID NO: 65507 - DNA, 1012 bp, Homo sapiens
ctgatagcttttgataacacaatttcctttgatgacagaggatgaaattatgtatcataagggttgagaaattataatcagtaaatgcaggcataaagaagggagctgaagcttcactgaatacaatacagtatgtcatattttctattatgacatctgcatctctgttcttccctaatttctactttcctgtctctagatatctcttaatccctcccactccatcatcacattctgtattcattgccacattctacctcattaataattgagcaaactcagtccatatatcctcaacataaatatgaggagggagagtaaataagaggattggaaacagcaagacagggaaatgggagaaatttttgttccttgctgactcttttggttcttgaacccttagagagccttcatagacttccctgtggttgattttctgaactcctataatgccaaaagggggagatgaaaaatactagcatcataccaaagtagggccattaaacattaagttataaaatgaaatcgtgattataaactgaaacactaactttgatgacaaggaatatacatgtgaattatttcttcacatacataaagtgatgatacagtgttaacatttggtttgttgtcattttattttaagtaagaacaaattgtttgagtgctcagcatgcccttcatttttttgtaagttaatgaggtggcaaccacagttgagaacacagattggaggaggcaatattgtttttcccaatttaattccattaatgggggcagtgtggtattgggtagattctgcatgttagtcagagtcttcagattgctgttgatcttttggatcacatgaagtagaagttaaattcacatcttctttatatgaatttgaggaagctgaagtgtctggttgcacatcttgttctgaatctagattggacaaataggctaaacatgtgtcttgtactgagctttggccagaagaagaatgaaaatctgccttcacgtcttctga

SEQ ID NO: 65508 - DNA, 1111 bp, Homo sapiens
ttgtcacactctcaggcccagaggactctccatctcttcgggttttttttttttttctctccctctctgagccactcatgtgatgcactgtgacaccaagcagtggtttgacaagtgctgggaaagactaatgaggacaatatacaaaaatggaaggtatacaatatacaaaaacgtgtgagtctatgtgctctgctctcttcttctcagtccaccttctcagtctgagtaatctcatttactgccatagcaactatcactttttaagtaggtgagtcctaaatgatagcattttttgtcaagtccagacccacatgattcgttcttctcaaacatcctctctcaaatggcccaccaacactctatattcacattgtcttaaagaagaattggaataggctcctaccttcaaacatgtgccaacagataatttccctagcctttcccctgcctcagtaaaatatacataggggcaagtcttacttacccctaagattttcatttttctagcaaataatttttgcaaggggctttgagttgaaaaggtcgtggctgaaagttctgtggactcatattctgaagcagtgatttctggaggaaataccagaaacaccggactgtgtgcggtgcttgaatccatgatggtgtcggtgataatttgaaaggagatgatttagttggtacttcagtctagaccatgttcttttcttgtgctgaggctgcctggagcactggaattgtttgctttgtcttggaattatagaaccatagagtcacagagtcatagaatctcaggactgctcaagatcccaagatggctataagtaaaatgcctgggactggggatcagagaacctgacaagtagtcctggtttagttaggagtttactgtgacttttggcaagtcacatccccctctcctggtttctgattcctcatatatacattgaccaaattggactagatgatctacatataaagacattttagggaccgcgcatggtggctcgcgcctgtaatcccagcactttgggaggctgaggcgggcggatcacctgaggtcaggagttagagaccagcctggccaacatggtgaaaccccatctctact

SEQ ID NO: 65509 - DNA, 1627 bp, Homo sapiens
atgggaatattggcacagctttgcagggtgtgacagctggtgttgtggagatggcatgctaatatgctggtaacagggtgcctgatgctcacttaagatgctacatgaatgggagctactgctgtgtgtgttgatgaaattctcgtcctcattagcaggttgtgagcaggatacaagatatttcttcttgccccgtattctcctgagccctgctcagtgtgtttgtataacaaaggtgtccatcctaacaatatggctcaccggttttcaccctgtactgtacctggtgttttgatttagaaccgagttaggtagctgaaaatacagcgtgagctttttaatggggagttggttgactccaggtgtgatcctaaatctagaaggaatttggccagatgttcatgaatttctggagtcccatgaggaatgttgcccagcctcatctgcctcttatctggtcctgctctgtgttaggggcctgagtgccctggggttggaacactatgagctagaaaatgctgatggactgttccacttacgagcaagtagtgagcactaggcataaacaagctgagctctgaggtttttcaactaaacctagccgaactgcagttgcccagaaagctcaggtgagaagggggggctggcattgctttattcattcatcccaccagtgaaaaatgccaggcactgagggaggcactgggggtagtgtgcaggtcagcctagggaaaacaaacaggagcctgcggtgtgataaatactaattagagaaggcctggttgtttgggaatctgttattagggatcagtgttcagactaaaggaggaaaagccttctcacagttgcctcttatctttctcctcagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataaccataaccacctccccgtgtctgtctgcaccaggagcacctgggactgggaaggtcaaggggagggagcacacactgggacactggcttccgggaagcccatcttcctttcctttcacagctcttaccctttttttttttttttaattgcacagcagaaataaaaacaaatctgcagatgaaatttgccatgtccctgcggttcttgaccttgtgtctaaaggcc

SEQ ID NO: 65510 - DNA, 1095 bp, Homo sapiens
cctacctttgctgctcttagtctctctccctggtgggctctgaccacaggtctctcttccctcctccacagctctcacctgtgcacagttccaccctgacggactcatctttggaacaggaaccatggactctcagatcaagatctgggacttgaaggtaggacatggtaggcctccatctgaggcccagggccagagggagtgtttgtgacaatgcagtgctaattaggtgcttgtggcacctggccctgaaggtggagagacactggctgtgcgtgtgtgatatgatggtgtggtctggggggtcccgctggctgtccttcctggaaggacgtgagggacatctcaggtaggagtttggtgagccccattttcttcctctcatgatctgtgggtgacgtattttactacccaccgccactgtaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtgtgcccttccccctccgcccagctttccattgtgtctccttgtttgtcaattatttattgaattaatctaattgcttctgcttatccgcaactgccccatagtttctgttccccttgtgtgaccttctctctttctatttctggcaggtaaagtcactgatctttgaccagagtggtacctacctggctcttgggggcacggatgtccagatctacatctgcaaacaatggacggagattcttcactttacaggtagaggctggtcctgggctcctgggatctctctaggtgcccaggcccggagggaagcctcactgggttaggaatttctagggcttgcatgaatttacctaagcagctttctgttaccacctgaggcagagctttatgactaaggaagcaactgagtcagactgcatggcagtagatgctagtgcttgttctgccacttccatgccctgtggcattgggcaggttactaaagggagagaaaag

SEQ ID NO: 65511 - DNA, 1044 bp, Homo sapiens
gatgggtaaaaatcatgttgactgttgaaagtggtgtaggttgtaaacagaacctctggtttacagggtaaaggtaactcatgggaccagattaatgatattatgggattcgaattttaagcctaagacagtttgggtttggggctgcaggacatggttggtttagtgcttcgcagtcaagatttcccttggaccttagggaaatgagaaatataagaataacatggtgaatttttcatgactaaatttgttcaaattgagagcactgttttcttgcttatggggtattaatagttaggtctcatgaaattgtattgataaaaaaagatggtagttatttttaccttatggcttttaatatcctaactaaacaaaaaattggtgagtgacgcgaaattctctccctgccccaaatcttttggaaaattaacttaccctggaaatccataaaagtggaatgcactgaaatacagccatgcagccccttccagtcccagtactgctcagacctgtgccatacagtacagtagcagttagctgcatgtggctatttaaatttcaatgaaatagaataaaaaattcagtccctcaattgtactagctacatttttcctttggtcctggaaatgggaaaattgctctctgttgcagttagcctttttaccactagatggcgaggacgcctccacaagccctgatgctgtatgagttagcactttaatagcgtttaccattggctgtcttgggcaccattgggtggataggtggttccagggagggcagagctgaaaggagaagcaattgttggcagttgtgggcatccccagccccgttttataagattgttttggtctgtatctcttttctgactctgatattctgtctttgttttccttgtaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcc

SEQ ID NO: 65512 - DNA, 1039 bp, Homo sapiens
gtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaagtctggattgcttccatgtctcctctactgctaaacccatttctgtagtgcagctccgcctcccaatttctccctgtgggggcagtgtgaagctggcagaggggagagctgaaaaggcaggctggtaccaggtacccttccctccaggagcacaaggaattaggaaagcatgcccccattacaaaacgtaggaacgactggcactgctggaaatgcgtgtgcttgctgggcagaggggtcaccccttccctgcagtgtgctgaggtgggtgggcagcctggagaagacttgcctgccctccccttcaccacccacc

SEQ ID NO: 65513 - DNA, 1037 bp, Homo sapiens
tggcaatgatgggggaggaggggtggatgcccagcagagcctggccaaggattcagggcagagaaagctcacttcattaccatattttactacactggcccagtctgccgacggttgcaccccagaagtgccttggtatcagaggcgagtagatggagggcaggagttggggaaaaggagacattgagaaggctgttggcgagaagaaggccaaggtctgtggaaagtagaaggaatagctgggaagcatccagtcctggactcagattcgaatcctggctttgctacatactacctgtgtgaggctctttaagcctcagtgacctcatctgtgaaatggtggtgagaggggaagggacatttacagcccttttctccctcccttgcccacaactactgtgccccagcatggcacccgggtcagcccctgccagctctggagctgtcatcatctctccctcttatgcctcttcagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtaaggagggggcaccggggactctcaggctaacaggactcagggcctgaggtctgctgggtacaaattgggagccttccccagccccggctgtgctccccatattccagagggggaaactgaggcccataaaggttctcttctgccaagctgggatcccatcttcctagatcttcccctcccaagctcctcttttgttaagccctctcattctccctccaggtggtcccccctcgagtcactgagccccaccaacggccagtcccatgggacgtgcgggccgtttcagtggaagcggctgtgactccagcagagccctacgcccgggttctcttccacctcaaagg

SEQ ID NO: 65514 - DNA, 1027 bp, Homo sapiens
tctgcatttgtgtgggcacagttacgcacacacacctttcctccttcctcatgtgggtccccaagagaacagcttcttcttgagacgagaaacctcatgggaggaaccacagcttcaacttcttttgttccagccacctctctcccgagtcaagtaaccctaacagccccccgaccttagacactttcacgctcattattgcactggcaagtgcgctggcctgagagagtcgagagcacatactctgggatcagaaagttttagtttgaaacacatctttgttgtcaaccagctttgtgatcatgggctggtctcttaacctctctgagcctcgttacctaaactttaaaatgagaacatatcttcgggttgttgtaagaattaaaagcactttaagacagtatttagcagatagcaggggctgaaacaatggcagttattgctgttataatatgatgtaataattatacaatggtaaaaattattattattattattaccggtgattgtgaagtgaaataaaagggagggtggtagagcaacttcctctatcttgaagttctaagaggggaagcatggagtctgcatgtatgcaaatcccagccacctgaagggggaaggtgcctttccccacttgtggtcctttgctcaaatgtgtgtggttcctgctggagggccttggtgggagatctgctttgtcccacctctgcctacctggctgtagctggttgccaggtggctccaagagcaatgtcaaaggccagcatgaataaggagccaaagttttgggttcacacccctgctctgccaggaggaagactggtatgcaatggccagttcccctgactgagccccagggaacctcaaggaatggcccctacagtaaaatcttaaacaaagaacaggggcttaaccaacaatcctgctgcaacatgcattccagtgacacacagagctgaactcagtgggagcccgtcctacggcctgaggtcagggctgctctcttctggcccatgccttttttttt

SEQ ID NO: 65515 - DNA, 1053 bp, Homo sapiens
tgtggcctatctctgtgggagtggtttctctgtgcatgcgtgcgtgccctcgcatgtctctgcctgtgtctgtgtgccccacaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgg

SEQ ID NO: 65516 - DNA, 1050 bp, Homo sapiens
taatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctatgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcacatgtggtgtggtgttgctgggtttgagtgaagacgtggctgcatgtgggtgccttgaactcttctgcagccttcagatcgtgctctctggaggggcctctgtgattcacatcccaaagccccatccgtctggatgtcagccctcccttgcccgctcgccccagggctggccctgggagtatttaccttccctctcccgctcttccgctttctttcttagccgttttcctattggagcctacgtttgcctggtcctggactgagagcaatggcatgcaaggccacaggatgccacgagggggcgtctggtcctcagcctgctcgggaggtgctgcgttcctgccacctgccgggctggcgggatgtcggcgtgtgggcctgtctgtgagccatctaattctaacctgggcttgcaggatgggctcagaggaacagcaggc

SEQ ID NO: 65517 - DNA, 1031 bp, Homo sapiens
ctgagtttaaacaatgtaatgatgatgtgcttttgtgtagtgtaattttctttgtgtgttttgtgcttgggttcattgagttttttggatttgtgggtttatagctttcatcagatttggaaatttttcagtcagtaactctgcaaatattttttttattcccttttctctttcctctctttcggggactccagttacatgtatgtaagggtgctagaggttgctccatagctctctgatcattcatttttcccagtagtccctttttcttttctctctgtggtttgttctggttagtttctattgctctttcttcaaattcactggtctcttctgcattgtctaatctgctgatattacctttcagtatactttttatcacagacattgtagttttcatctctagaagtttgatttgggtcttttaaatatcttccctgtctctaacatgcttaatctttcttttagcttcttgaacatatggaatatagttttaggaactgttttaatgtccttgcctactaattccattatctgtgtattttttgggtctgtttctattgcttccctcattatgagtcttattttcttgattctttgtatgtctggtaatttttattgtatatcagatgttgtgaattttaccttgtggggtgctggatatttttgtatttctagaaatgttcctggcattgttttaggacactgttaagttacttgggaacagtttgattctttaaagctgctctcaaggtttgttagttggaatcagaacagccttaggcccaggcctgatttttcctcactaccaaggcaattctgtccttagtgctttaccaatgtcctgtgaatgatgaggtttttccactgtggctggtgggcacgcaagactatttctgtttcagtttgagctccaaggattgttgccttggactggtatagatcagtaccagctgagaactggagggggaccctctgtaggtttctgggttctctgtgtggccctttcctctctggtactctgccctgtg

SEQ ID NO: 65518 - DNA, 1023 bp, Homo sapiens
agtagagacggggtttcaccatgttagccaggatggtcttgatctcctgacctcgtgatctgcccgcctcagcctcccaatgagctgggattacaggcgtgagccaccgcgcccggccttcttttttttcctgagatggagttttgctcttgtcgcccaggctggagtgcaatggcgcaatctcggctcaccgcaacctccgcctcctgggttcaagcgattctcctgcctcagcctcccgagtagctgggattacaggcatgcaccaccatgcctggctaattttgtatttttagtagagacggggtttctccatgttggtcaggctggtcttgaactccgacctctggtgatccatgggcctcggcctcccaaagtgctgggattacaggcgtgagccaccatgcccggcctgcaagggtgctttcttcccagacactgacaaatgtgtaagttcctcttgcgaggaccactgtgtaaacacgtgctttctgtctttccagacattgacgaatgtgtaacctcctcctgcgagggccactgtgtgaacacagaaggtgggtttgtgtgcgagtgtgggccgggcatgcagctgtctgccgaccgccacagctgccaaggtgagctgcagagaaggaatggctgctctgggaggggtaatggggatgccacattgaacactcagccctgccatgcccagtgcagtgtgctctgtgtgccactgcattgaaccttcaccaccggcttcggagggagatgctattatggttcctgtctgactgatgtggagactgaggcttgcccaaggccaagtcgttagtaagaggtggagtcagagtttgaatcccagcacatctaacagttagaaccgactgctgctggcctggtgggttgactcacatctgtaatccttgcactttgggaggtcaaggcgggaggatcacctcaggtcaggagtttgagaccagcctggccaacatggtgaaacctcgtctctactaaaaatacaaaaattagccaggc

SEQ ID NO: 65519 - DNA, 1073 bp, Homo sapiens
aagctgagccaagataggctctgatgtttgagagtgggcagagagacatgagaacaaaagaaatgtgtcacttctgttattttacaattatttattgagcacttcttaggggcaggaactgagctagggactggggttatgggagccacagttggtccctgttagggagttttttttttttttttttttgagacgaagtttcactcttttgcccaggctggagtgaagtagcatggtctcagctcactgcagcctccacctcctgggttcaaatgattctcctgcctcagcctcctcagtagctgggattacaggcgggtgccaccacacccagctaatttttgtatttttagtagagacagggttttgccatgttggccagggtggtctcgaactcctgacctcaggtgatccacccacctcggactcccaaagtgttaggattacaggcgtgagccaccgcacccagccccattagggagtttctgaatatgaggaaggaagacaagtaacaggacaagaacagctccattgtcatggggaccttcactgggaagggcaaggtgccagggcccacagaggggcatggaacccagagttgggagggttggccaggggaggctccttgggaaaatgacatttaaaagatgagggacgctaaactcaataattagtttgtgaatgtattatttgcttgtgatttttaaaacatttctacggacaaaatctgttaccttccccagaaacagtcactgtgaccagtttcttgtcaatctttccagagcgacaaaagcctttttggagttttaacttcgtaaaagtaatatttctccccctgaatagaaaagcaagagatagttcattgtagaacatttggaaagtaagaggagaaagatgaaaataagcattctctggaagtccccacccggagatatttgttactaaaatgaagttttttttcctgcccttttccctgggtgtgtctgtgtttgtgagtgtgtgtatgtgtgtgtatgtatgttaagcatgcagcatatatgtatgctttataaaactgggattatatcttatct

SEQ ID NO: 65520 - DNA, 2715 bp, Homo sapiens
cttttttttgagacagagtctcgctgtgtcgcctaggctgggatgcagtggcatgatctcagctcagctcactgcaacctctgtctcctgggttcatgcaattcttgtgccacaacctcctgagtagctgggattacaggtgtgcgccaccaagcccgactacccacattactgtttcctttacgtggactcatttttttatgtaaaggaaaacttgggaagttttgtattcctggtttggtgtgttcattgtgttttcatatttcataaatatgtaatagtgaaataataaatgttcaccccagtgcctcataaaaccgtttcctgtcccgcattgcactttgagaagtagtgctgcagatgaagggtcgaagagttggggggagtcattctgagagagctctggcccctttggctgagagagacaatgcccttcccaggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagaggtgatgctggtggggggatgcgagcagacttcttgcttgagccaccgcccctgcaagtgtctctggtggggaaggataagccagcccagtattaggggcagaaatgttttccccggagcagacattctacattgattaagttttttttttttttttttttttttgagacgcagtctggctctgtccaggctgaagtgcggtggtgcgatctcggcttactgcaagctctgcctcccaggttcacgccattctcctgcctcagtctcccaagtaactgggactacgagtagctgggactacaggcacctgccaacacgcctggctaatttttggtatttttagtagagacggggtttcaccttgttagccaggatggtctcgatctcctgacctcataatcggcccgccacggcctcccaaagtgctgggattacaggcgtgagccactgtgcccggccctgattaagtatttttagagactcccaactcaaactctgactaggctccatctctgggcagttggcaaccaaatgggctgcgttggcagagaggtcggggagaatccctctagggtgacacttgttgaacaccatgctatatcttctgcagggtggggccttgctcctgaataaaggaaacacaagtcccagaactggattccgtgcaaactgctgattatgctttcttctttcaccttgtctgttttaagattgctcgagactttaatcccaactggatgagtgctgtggaaatcttggatgatgacaattttctgggggctgaaaatgcctttaacttgtttgtgtgtcaaaaggataggtgagtagtggccagctctgggagtggtggggagggctgggagttccttggtctctggtggatgcaagcattgggttctgtgtcaggttcaggtgctcctgtttacagagatagaactttcctcgtcagagaataaaaggtgacagaaatccacctctttagactggctcccctactgtggagtatgtcagctccccagggaaattgagcaccgtgaccactgcacgtggtcctgtctcagggcctgtggtggaaacaggaggttcagaaagtgactttcttaccgcctttcagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgataggtaaggtcacccctgtggggcacacccccacacaggcctccttcctgataccagcattctgagggactggggagagcaactgtacaagacctaggtgtttactagaggaggctgcagcacattagccctccctgagctgctcacctgggctgccctttacgtagaggatacatgctgtggggttgagctctctgcagctcactgcctccttcacttcttcagggctggtgacctcactgtcagagagctggtacaacctcctgctggacatgcagaatcgactcaataaagtcatcaaaagtgtggggaagatcgagcactccttatatccttcccagagccatccccttgctgggaagcacatcccggcatatgtggcacacggagtcacattacccggaagctactacatgtcttgattaggttcctgtacagaacaggttttttgttttgttttgtttttgactttttcatgtggaaaatttcaaacatacacaatagaacagtatattgactcccaaagtacttatcacctagcttccgctggtccatcttggaaatgtacatttatattcctgaaatgtgtccgcctctggccctctcggtgtagcaggccaaatgtgaatttagatcacaacacaggagcacatcctttcagggatttggttgagggcaacagtgtctgagactagagaaactaccagaagaaagggaaaggtgaagaagcggaaaacactgaaagaatctgccaccctgggacccccagaatccaagtgctattggaagtttgtgtagtacaggagatataaagggccctcccc

SEQ ID NO: 65521 - DNA, 1104 bp, Homo sapiens
tttgaaaggccaaaagaacaaaagggaggggtgggagaagtgaacgatgggtaagggaatctagtgacaacaggtataaaaattcagaatcttaggtttgttttccacttggttgctcaggcatttaggtgctctttccagcttcaactctgtgtttatattttaatatcttttctcgttacacccacccaagatggctctaaagactatcagcccggaaatctcagatcagatagctgaaatgggatctggtttccatcttgagagagagatctagagtttcagggcgagggggcagatcctagataccaactggatttctctgcacattatcttggggctcatacttcacgtggtcattaactccagtagatactgagtctgtgttgtttttttagatgagtggttttggggggcaagaatttgtaccacaggggcaaccagaggattcttttgatgaggtaaagtgtgggctcatagagactcaaacatattttttccacccccaggaaaactacagactgtggctgaaaaggaagtgaaaggggccgtgtactctatggtggaatttaacgggaagctgttagccagcatcaatagcacggtgaggcctggaccacttggtacttactttaggctgcccatcattgtctgcagaatgtgtctctcttaggttgtctggggccacgtgtgtgtcagatctgaaggagaacaaagtagcgggtgtggaggatagagctctgagttgagaatctcggaaactgaggttgaaccacgcattagactaggttacgtgaacccccatgtgtttcagatcctgagtgctgtgggacttgagaaacgagtgagacctatggtccctgcacgtaggatgttccatgccaaaagaaaatgagccaaatcagaatatcctgagtgcattcctgaaagctagtcctttgaaatattccactgcttatgccatgaccctacctcctcccttgctaaaaagtttttttccatctttattgaggtatagttgacaaaaattttgtatatcgaaaatggacaacttgatgttttggagtagggagatagcagcaaacaaaatggacaatgagctgc

SEQ ID NO: 65522 - DNA, 1301 bp, Homo sapiens
ttcaagcgattctcctggcccagcctcctgagtagttgggattacaggcgcgtgccaccatgcccagctaatttttgtatttttagtacagatggggtttcactgtgttggccagcctggtctcgaactcttgcccttgtgatctgcctgcctcggcctcccgaagtgctggaattacaagcgtgagccactgtgcctggcctggcttccaggtttattgctagctgtgtgaccttgggaaagcctaaacttcagttttcttatctgcagaatgaggcagataacagtctggagctacacatactaggctcagtggtgataccagctggtcattttcttccatgtattctctgcctttcatgtttccacatatctgcgataggacctccctccgtagtccagagttgaagtcttcatggcttctgtttttatttgaagtgcccccctcctcttcccattgagggtagtggagtctgtccccattaggtcacctgagttcctttttagctgtgcttgattgacttgaagcatcactgttttgtctttaatgacccttagatttttactgtttgggattgatgtttcaactacatgcctcctctgaaacactctcctcaggctccttgagctgccagccatcagagttcttggctagctgcagcctttgtgtcctgatctgacgggtcccttcacaatgatgtctcagcacttcttctgtgtttgagaaggatgatgtgcattctctctgtttgcaggctctgtccagcagtgtaagctccagcaagctgttctccagcagcactgctcctcatgagacctcctttggagaagaggtggaggtgcacaacctacttatcattgaccaacacacctttgaaggtgcacatgagctctttcgataatttttatctacgccctccctaatccaggctgttctgggctctggtacctgcaaagcctgacagatgtggcagactgtcctaggaggagcagaaaggaggggtgggaattctgtgagatggcagtgagtttggagggctgggcatcctctccttagcttaggctggtgggggatggataatctgatgagacagggacagcaggtggtacacgctttgtcactgcctaagccacaggcctcagaaatacggggttatgtgtgcgtgcagatatgggtaacctgtcatcacgtagtcatctctctactctctagtgcttcatgcccaccagtttctgcagaatgaatatgccctcagtctggtttcctgcaagctgggcaaagaccccaacacttacttcat

SEQ ID NO: 65523 - DNA, 1906 bp, Homo sapiens
tactcaaaaaacaaaagttaaccaggcatggtggcatgcgcctgtaatcgcagctacttgggaggctgaggcaggagaatggcttgaacctgggaggcgtaggttgtggtgagctgagattgcaccactgcactccagcctgggcaacagagagagactctgtcccaaaaaaaaaaaaaaaaaaaaaaaagccaaaaaactggtggtcacagggtcttactctattcatatcttcccacaggatgcagtttgtattacccaagtaagtctcaattagaatgaaataggccttttccccaccagctgtaggtttgtaagctgtaagctacttttaagctggcctccttcaggcattcatgcaaaaatgacatctattgtaatcattagcaggactttggggaataagaaatagaagcctcatgtagcttattcgtagggctctattagggctgcatttaccacctttccactcctgtgtggaccctggcagatgcttggagacatttgttcatctgctgtttatctagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcaggtgtgtgtgtttttctgtctgctcgctttcctcctcttttctctaggacttctttgagccttggattccttcctctgccatattcttctttgttcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggaggtatgtgtcatttagggacctgggttgggacagagtcaaaatgtggaacaagaacataatgtccccctttctcacagagatcattcctcgctccatcctgatgaccacctttgagagtagccattacctcctttgtgccttgggagatggagcgcttttctactttgggctcaacattgagacaggtgagagtagtattttgagtgagggactctttcaaaaatagagtattagaattacacagaattcttagtcccagggttctgcttttgaactttcacaggccagctttttgtcctgttttctttcttcctttctcctgatgtcattctctctgtaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacaggtgagtctctttttccttatttaatgagagctattgattgagggggtcatgatgttttcctcaaacccttacctcaaagcctttttccggtgtcaaaatcataactgagatgggaagtatagtgcagaggttctcaaaactggctacccaatagaaacacttgggaagttttttaaaactacaggatttttggaatcctcagtgggtctgaggttgagctctggaatctgtattttcagaaaacttatcaggtgattcagatgactgtttcataatccctaatttagagatcattttgtgtccctctagagcaggaattctcaaagggtgtccccaaccagcagctacagcattacttgggaacttgttagaaatgcagattctctggctg

SEQ ID NO: 65524 - DNA, 1232 bp, Homo sapiens
gcagagagggggttccagctcaggactccatgttccagcccttccagtggtgtcaggctgccatgtctatatatatatatatatatatatatatatatatatatatatatatatatatatctatcctttttttttttttttttttttgagacaggatcttgctgtgtcacccaggctggagtgcaatgacatgatcatagctgcagcctctttctcctaatcttaagcaatccccccacctcagcctcccatgtagctgggactatagttttgtgccaccacacctagcaagttcttttgtatttttagcagggacaaggtctctccattttgcccaggctggtctagaactcctggttccaagcagtcctcctgcctctgccttcccaagtgttgagattataggcatgagccactgcccctggcctgccctgtccgtagatatgcatgctaagtgttggtctgtcctatgcatctgaatccttggtccttgttccaggattatggccactgcggtctgaccctaatcgtgagactgatgacactttggtgctctcttttgtgggccagacaaggtaaggatgggtctagtgccagctgtaggtgctggtgagaaggttgtgaggtggggaagctggtcccaggctgacccaggccctccattctgctgcagagttctcatgttaaatggagaggaggtagaagaaaccgaactgatgggtttcgtggatgatcagcagactttcttctgtggcaacgtggctcatcagcagcttatccaggtgataactgagaaaggggcaggtgttaccatatacttgaattgacctagatgcagtacagagcaccactggattttaaaacaaccaatttttatggctccaaaaataatgtaaaaattctagggaaaaaattacagataatccactactcagagatcacaactcttaaccttagagttgctccttttagctttatttttcttctgcaaatgtctgtgtatttatttacattttcttttatagactcgggtcattatatatataaacataaaaatatagtttcggatcctattttagcactaattatatcttccgagacactcaaattttttccctttgttaaactagtgatacatccttatttataaaattagaaaatgccaaaatgcacaaaaaaagaaaaaatcatgatgctaccatccaatatgactcttggcagccctttccaca

SEQ ID NO: 65525 - DNA, 2361 bp, Homo sapiens
agcctgggtgacagtgagaccctgtctcaaaaaaagaaaaaaaaaagattattgctgatttcagttctgggaggaggctcccaaaaagtttaatattaatacttaggcagtatcttttggagcaggaatatgcaagacaaattatagatttttctgagtgtagggatgcaatagatgaagaatcaaaaacttcagagatttagaaacatttgcttagtgtgacctgggaatttgaaacagaactgttctgaattatggctgcagttgggagttttctcagcagatgtctgagatgtgggtagtatctggatcccacgtagggtccattctcatttctttcacgttgctgactttcttccagacctctattgctgagtgcttgacataccttgataatggtgttgtgtttgtcgggtctcgcctgggtgactcccagcttgtgaaggtgagaagacacttgtttctggtttcttttttgctgtactcactgtttcttcatcaaatttctcctatgtttggcacctctcagaatctctccattttatccacatccctactatccagctttctacttggttaatttaacatcctacccctgactagctctttgcctttgtggttcattcagcaaatttgccaggcaaggtgctaggtgctgtggatacattgatgaacaagacccagctcctaccttcaaataggtcatagtttaatgtaatggacttcttctagaatatgaaaacttcggaccttctctgcagaaaaatgcatgcaaacattttacattaattttcaaacattcactacttctctgaaatccatccatggactctaggtcagcaatccttggctgattaatgggtcacctgtgggacaaccatattctttcgtcaatagtccccttctggaatcatcccttggaacatgagaatggcagatctagaaactagttattgagagtttcttttggacaataaccatctcttttgggtgggtctgttagggtgttctaggactaacataacattgttctttcttattagctcaacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggagggtgcactgaaaatacttttaagagccccctcatgaatcccagtgatataaggataactactgtttattgagtgcctatcttggtctgccaggcactttatatacattatctctaattacacaagtaccctagatagggatatttggccatctcagaagtgaggaaaattagggctgagaaagattaagtaactttttccaaagtcacctaacttaataagtggcaggtgtatctaacagatcctgtgctcattctagtaaactaggtcccagcgatctaagcaagcttgctaggagcagtggtagaagctttttgcttcctggactaggatgtcctgtctgctctgtaaatttgaaagactttggaaatcaacctctgccaagtctgcatcctcaaacctagccccacaataaaggttcttggatttaggtataccgtgtttactttctgggcatcagtatgactggcccagtatcttgagggggttctttagaaacgttttctctgcttgcagctggtcacttgctctggggctttcaaggaaggttctttgcggatcatccggaatggaattggaatccacgagcatgccagcattgacttaccaggcatcaaaggtagcttttttggtgggcataggatgtagatcttacatgagggactttggccttgttacatgttgtgaaggcgttttggtgggagccagaggaaagcagatcaagtgaagagtgaaagtcgtaacaacagatcagaagcttaaacatatctgaaagtataaaagtaaactttagaaaaaaaaaaaaaagaaaatactactgatcaaaattggtagtggaatagaggactaggggattaaaagattataaattaaaattaatgttgtttatatgaggcaaccgatagaattcataaagaaaggagagactgaggatattttatgaagatataagtataaatgtggtttctagataaaaaatataaatcttcctaaattccaggagaattttaataaaaaaaagatcagaggctaggcgaggtggcgtggctcatgcctgtcattacagcactttgggaggccaaggtggaaggattgcttaagcccaggagtttgagacca

SEQ ID NO: 65526 - DNA, 1076 bp, Homo sapiens
attgataaattataaaggctaagaaagtcaaaaatgtcaaggacttagaatatcaagttgtaaaaattaagccttaaaagtttcattttactttctttttgagaaaaaagaacaaaatctagctggctacagtggcaagttcctgtagtactagccacttgggaggatggcttgagtccaggagtttaaggctacagtgcactgtgatcatgcctgtgaatagccaccgtactttagcctgggtgacatagaaagaccctgtctttaaaaaaaagaacaaaatctgtggtagcattgccacagtggtagggggtaattagtggtattaagaataaataacaacatttgtagtagcatgcatagttcagtagattttggcagcagcttcctattctgtgtatttctattttcctgcagaatgacgacatatcagtaaacatataagatatattgatggagcgcctcagaaaattatcttcaaaataaaaaagctccccattttctattaatgggcaataggatctatcctcattttcatgtaatgttatctgagcgatttgtctgctggtaaaatggctgggtttggtaaagggagtggtccagtagggtttgttttctggtgtagaagatgctgaatctctaatgactgtttccttccaattggcagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagaggtagagcttgttctccctgttcctctacaatgttcttttaggttcctaaagacaccaaatgtgtggtcccacacctcaactctgggaattatgttacttaacacctaacaacaaactgttgttcctgctgtggaagttgactgttgaatgagttaggtattggagcatctcacaggatcctgtgataatctatccaagcagcctgtgagaaaaggaaaagaaagggaaacagaaaaggatataatctgga

SEQ ID NO: 65527 - DNA, 1031 bp, Homo sapiens
gtagccctgataatggggggaagttaagctaaggaacaagagtggaaaccaggaaaaaaaagtaaaagcttttacttggaaaggattagaagttgagaagaaaaatgggggagaatgcatggggaagaacatggagaagactccccacccataggaatagtcgaacaccagaagagtggcagtaaaaatactaccaggattagataatggccagttaacaaattctaagagtctcgtaaaggctatcatgttccctgggctttgatgtcctttttaaaataatgatgaccttaaagtttgccttggggctaactagacctgtacttttgccagtcctggtttggcagacccagagtgctgagcattctaattttgctgtctttcctgcagtcccagagccctttgggggggccatcatcattggacaggagtcaatcacctatcacaatggtgacaaatacctggctattgcccctcctatcatcaaggtgagcgcagtcctacctttttttcctttcatcttttctttccttgtcctcaccttgctcctccctttctcttatttatcaaaaggagattcacagatgcctgttacacaatttactatgtatataaggtattgcgttggccattgggaatacagagagagattagcctggatttgcttacagagaacttgcttgctaacttagataaatgataatcaaaataggcttccccttttcattgactggggcaactttttttgtcaaagagacagggtcttactctgtcgctcaggctggagagctagaatgcagtggcatgatcgtagctcactgtagccttgaactcctgggctcaagtgatcctcctgtctcaacctcccaagtagctaggattacaggcatgaactaccacatggggcaactttaagaggggaaaattttggcagtttcttttttttttttgagacggagttttgctcttgttgcccaggctggagtgcagtggcacgatctcagctcactgcaacctccgcctcccaggtt

SEQ ID NO: 65528 - DNA, 1029 bp, Homo sapiens
ctaatttttgtatttttagcagggacggggttttgccgtgttggctaggctggtcttgaattcctgacctcaggtgatctgcccacctcagccttccaaagttctgggattacaggcgtgagccactgtgcctggcacacagtatctcttatagtacctagtgcagtgtgacaagttcatttttctaattctttaaacctttcttggttggttgaattgttaagaatggtagatctcagatgctgcagtctacctaggaattcatcccaggctcagctagtgcttgtcagtatagtgatggataagggtgggagggctgacatgacaggactgtcagatgctgggtagtggtggcttattccttacagcacctctctctagcccaaggctcacccttcctaagggctaaccattttacctttcccccccaggaccctcaggggcggcacgtaaaaacctatgaggtgtctctccgagaaaaggaattcaataagggcccttggaaacaggaaaatgtcgaagctgaagcttccatggtgatcgcaggttggtagggggtttaggaaatgtgcctccacctgggtctaggctagttccctgttcttgttcgctccctcaccttctctgcccttcgttttggcgctcggtattattgaaggtgtgcattgtttaccactcctttatgttttctttctctaattgtgctttgtttttttctgtctttgagattttctgtttttcacttctccccccaaaagtataacttgtcttttacttgggtggagggattgactataaaacattgagattgatttgcacagtggcatatggaaatgagtctcattattttattgctgggcataacatttaaaactgaaaggaagccaggatctatagtcccagctactcaagaggctgaggtgggaggttcacttgagcctaggagtttgagttcagcctgggcagcataatgagaccccatctctttaaaaaaaaaaacaacaacaaaaaactgaaagggagcaatag

SEQ ID NO: 65529 - DNA, 2184 bp, Homo sapiens
tccatctccaaaaaaaaaaacaccaaacaaaaaaaacaattaccatcagtattttcattattttagcgcaaatgttttcatccaaatcaccaccacattgctttatgttgtcttaactgaatctggcaagaaagcagtgggttcaaaattttaattataaccctttgaacaaaacagcaattttttggagtctgtgttaaataagtaggactttgttgatccattttagcttccgttgttattcccacattttttttcctctttcttcaaatacttggggaggagtggaggaggcattacattcatctttcagaatttgaatgggatgattgagattagcttgagattgaaatagatgaagactttgtttgtagaacagagagatggagaatcatgaaagtgagaactagatgtttaccagcttcagttctggctttttgtacatgcccttagggtgtatgtgtacctagtgtgggttacaagctcaccatgtattttctctttagggagagaagaatttggaaaattcttaaagaatttggtgtgcttaaagactggacaggttgttcctgttttaaaaagaacctcttttgatagcataatattggtttccagggggagagcaaggacctgctgtttatcttgacagcgaagtacaatgcctgcatcctggagtataaacagagtggcgagagcattgacatcattacgcgagcccatggcaatgtccaggtgaggtggctgctttaggccaatgaaagttttctaagtagggctgtcatgattcatggaaaaaattaaagtgctgggggcagctctctattcgatcagagaaataaggagaagacactatgggtttgagctttttggagaaaggactcctgtagttcactcaagacccaagggacagggtaataattcattgagattcagtgtttcatgaaaaaggcatgcactgacattggggctccaactatttggcctatcaaatagatccattagttttaatacctctcctaaaatttttctgcacaagtggtgcccagcgtcctctgttgctctgtggatgttgaggttcttccctaatcccgattttgtttctcaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggtactggatcaggaagagagagcgagaaactgtgaggttgatgtgataggagttgtttttgctaactggcatgtctgggtttggtaggatagagagaagtgtttaatgtgtttgtcctgaaatgttttgaacaacacaattaatatgggtcagactttcgttgcttcttgagtgcagtagtacttattgtggaggcagcaagctctctggggcttgtagcaggttttaatcctgagattacactctggttgtgggccttgggagatttcataggatgacccagtttatactttgattctcttactggagtgctaggggattattaaaacttagttgtcaagaaattatctagatcttgcctttatattaagcaaagagaaattgtcttggtgatgccttatatgtgttttttaagaagaggtttacattttgtccagtaatcacttactggtgacttgctggcttattttaattttattttattattttttttgagacagagtctcactctgttgcccaggccggagtgcgatggcctgatcttggctcactgcaacctccgcctcctggttcaagcgattctcctgcctcagcctcctgagtagctggaattacaggtgcatgccaccacgcccagctaatttttgtatttttagtagagacgtggtttcaccatgttggccagaatcgtctcaaactcatgacctcatgatccgcctgcctcggcctcccaaagtgctgagatttcagacgtgagccaccgtgctcggcaacttgctggctcttaacttctattttagtctgcctaaaactgtagcagagctgatcctgggcagctgttctctggtccagatctg

SEQ ID NO: 65530 - DNA, 2826 bp, Homo sapiens
gcaggcaaggttctagtctgggatatgcacgaatcgcggtctcccttccctctctatgcctccgcagtccttcccgttcccaaaggaggaacagcccgagggctcctggagcaacggaaggaggactggatgcggggaagggcaaagggcgcggaacggggtggggagtctgcgggcgagctcggaggacactggcgcacctcccccgccggctcacggccgcatccgccacatccgaaggcgccgcgacttcccggagaccccgaagcgtgcgctctcatccgggtcctgcgggcgctggcggaaagaggcgaggcggtgcctccgggggcggggcctccttcggttggcggcctcgggcttcgggagtcctccaagaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggtgaggctgccggggccggagaccccggcgagtgagggagttggggggagccgcggcctagggaggcccgccgccccgggggcggccgggcaggagtgggcccggcgaatggaaggcgctggcggccgaggaacctcccccagcaccgcgacctcgaaagagtcgtccctgtacgcgctttttgggggttggaagccgctctcgagggtcccctttcgtcctggggaggtcattcggcctcgagaacagggcgggcccagtgagacagaggagtgtgagttggttgtgcggtgtcgtttgggcccggagattggctttctgtggccaggaaaaggggaggtggtaatgacgactttggggtcaagattttcctgtggggaagtctggggggcccaggaggtggagggatgtgaggaatgcccgcattatcccacagagggagaggagccctcttcaggctaacccctttgcctggggctgttgtttacatgagggccctgctggagaagagggtttggtttgcctggcccagtgctgggtttgccttgttgacgatgcgcttggattgttaaggacaccgatgttcagaacccgggaagagtcatcttaacccacattctcagctgaatatgcagaccccaagcttgcatgtttatatacaccctaatcatgattccaaaacaaaactgttgttcagagttggaggtagctgagtgtggatggaggtattggtagactgccaggagggcagggggtgtggacaaaacagtgttttcatataaagctctgggacttcttcatttgacttggtctgtcagataaaagttttgtgagactttagatgaagactggaagaagtgaacactttctccggcattctcaattagagcctgccactgtaactgtaatagagtaaaattggaggggcaagaggcatgagaagggattacgcagtcattgtcatttggaggacacacggctcttaggtccagtccagttttcttagtctgattagggaagtagctttgttgaatgcatgaactgagactctttgaggtgccggatttggcaagaaggggagtagctggagggagttggagaagtatgtgaagtaaatgagaattctggaggtatttagacataagtgataggattattttgaagggatgggaggcccttcccctgagttcaaaagttagagggtctgttctttcaggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaaggtaagtgttgcagttgggacaagcagtggagggggaactgttggtcgtaggttgttttatgttatttttgtttgtttatttattttctttgagacgggggtctcacagtgttgcccaggatgtcttgaactcctgagctcaagcaatccctccactttagcctctggagtagagtagctggggtattgtaggcatgccaccgtgcttgggctgtgttaggttgttttgcgaattcttgggatgggtggaatatgctttaggagaaaaactcttctcttttttctctctttggatagcaaatttcagtatgtactcttgaccaagctttctagaagtaaaaggagagattcattagggaaacatttatgaagttgacttctttagaagggagaaattaaagcagtttgtttcagaggataggctacagagtggggcagtcctggcttcatttcttgttaattctgactttaggtgccacttaaggcacctttcagatcaaatcccctgggttgttgtgacgatgaaatgattcagtaacatagggcctatcatatagcaagcatttacagttatgttaacaattaccaggccgggcatggtggctcacgcctgtaaccccagcactttgggaggccgaggtgggtggatcacgtgaggtcaggagttcgagaccagcctggccaacatggtgaaaccccatctctactaaaaatacaaaagttagccgggtgtggtggcacgtgcctgtaatcccagctacttggcaggctgaggcacaagaattgcttgaactcaggaggcggaggttgcagtgagtggagatggcgcccattgcccgg

SEQ ID NO: 65531 - DNA, 1026 bp, Homo sapiens
attaggtggcagagagacgatttaactcaggcttatctgacgcacagtccgtgttctctgccatcacaagaccctccctcagccctttccaaagggctgtaggatccccttcccagtgcatggctcacccagggagcggacggtagcgtcggctatgatgcccagttccaggaatgacaggccacccaggttgttgaccatcatcacaactgaggagcctgcgggtagacatgacaccccaggtgagaccctctgggcgtctcctccccagaggtttaggaggggttgggagacgcgggcgagaggctacccaccgggctgcacaggcacatgggacgcgttggtggtgtttgtcatgtggtcgagcatgagtttcacaatctcatcggcggttgccatctgtcagagggagccaggaatgagctgcatctggggggccttggccttagggcggcctgtgccagagggaccacctacctttatccggcgcacaccagcttccccgtggatccctgcggatagatgtggtcactgctgacccactcaaggcctggggatttgctcatcgtttttatcaaggactcacacagtgctggactcacacagtaagtgggcgggagtgggggatggaaatggacagaataatgaaaaacacgatctctgttctctgggagcttgtggcctggtggtggagatagctttaactagagatagttaaggaggaagcacaggcgaggaaagaaagctttgcagccaggtgatctttgaacagccgttgaaagaagggtgtattctggcagggacaggaggacctgggaatggcaggcaaaggctaggaggtgggcagtgcacagagctccacatggccaaagctgtgggtatagacagcaaagcaggtagaaatcaggcaggttggcccaggctgggcctcaaatgaccaggtaaaaatactaagaccacctggggagaggaccaggttgatggctctaagggtatgcaaggtgggcaaagtccagggccaaggag

SEQ ID NO: 65532 - DNA, 1045 bp, Homo sapiens
ctaccctacatgtgtgccaggcatgtgctgtttgtctccacatgcatacagtgcccctgctcaccctggtgccatcagtgatcgctctagaaagagacctaggggctggcttggctgcagtttcttttttttttttttttttttttgagacagggtctcgctttgttgcccaggctggagtatagtggcatgcttatggctcaccgcagcctcgacctcctgggcccaagccatcctcccaactcagcctcccaagttaggactataggcacacactactatgcctggctaattttgtattttttggtagagacagggttttaccatgttgcccagactggtcttgaactcctgagtgtaagggatccgcctgccttggcctcccaaagtgctgggattgcaggtgtgagccaccgtgcccggcctggctgcattttttgatctacaactgaaccttagactatgatgatttcttttccttctggtgtcccaaatgcccattcgactcccgaggagccactgaattattaattcaatgctaagaaaagcccctctaccattcttacatgcatcaggtgtgtgtactggaaaggggatgggtcgggggtctcagtggaagcagcccagctgaggagacactgccttaggggctcaggtaataaagatctgcctggtagaagatgggtcatgatgcctgcagccagggctgtgggcccccttgtttacatgcttgggaaaaggtccctcagaggaggcagtgtctttcttgcttccatgtattatagtttattaactttctttttcacgctcactggggttaaggtgcggaaagcatttcacagggagtcttaaaaccaaattaggattgccaggtaaaggctgcacaaggaaaatgccttatctctgaagcccagagctggcaggggagggcatgacccagggactccaccctcctgcaaagggaaagggcatgctggagaggcatggggacccactccagctcactctgggtgctgtctgtagttctggaagcttggtggaggat

SEQ ID NO: 65533 - DNA, 1142 bp, Homo sapiens
cctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagaaggatcccggggctgggagttcagggacctgggttcgaatgctggttccgctgctatctcgcttcgcactgtcgcgatccccttgctcggcctcaattttctcttttagaaagtgggcacctttctccgcgctcttccttccaacgcggtggttataaaggcacgaaagctcttcagaggacgcagaaagcacctggagctcctcaccccaattttcacccattgttagctggcacgagcacccagcagaggagtcagggatcacccctcgggtgcctggaacggttctttggacacctgagccggacctaggcacagcctgaagtcggggtctataattattccggtgctaaggggtaacttgttcacctacctccttggcaggaatattgagcccttcactcctcatgttccgactttaacagaagctacctttgagaataaggaatcctcagagctgagagggagtggacccgaattcctgtaccagctcggccacttaccttggctaagtcattttcttgttttgggccccagtgtcacagtgtttttgatttgtaagatgagggtttagggcttgtatcctaaatctggtcctcaagattcttgaagtcccccagtccatcggggagggagagcaacaaactgattttctaccccttcatttatttgtagttctaaattataaaagtaacactgcaagagtttggagtagagcctttttctttttctttcttttttttttttctgagacagagtctcactctgtcgcccaggctggaatgcagtggcacgatctcggct

SEQ ID NO: 65534 - DNA, 1054 bp, Homo sapiens
cccaccaacatgaggctctccgtgctcatgtgggacaggtatagcacagctcgtacagggagcatgtggctcaggtcctgcttgaagcccaaggagcctagatggtccacacgagatgctctggccacggtgatcaaggaggagaacttgaggtcagcaggggactggttctgagaaggggcaggatgggaataaccttgcccctccctatactggagtgtagaagagtctcttgggctgatggtcctggtttagaagatggtacccactggccttatgctgagttgcttgcccaaatgtctgtgctgaagaaaagccacacagcctttctcaggacaacttgccccaccaattctcactggtgtggctaaagtaccagaagcaatatgtgtggtgtcagcctgatgggctgctggctgaaattctgtacttcaaatcctgtccatacgatggcagaaagaaagaaaatgttaaaagaccagtgaatgagagcagctggcctcgactgttctatattccaagcctcctggccccaaaggatagggagagtatcttccctgagtgggaaacgatctacctaccctaaacaggaaaggcaatcccatagccaccccttcctccctctagaaaaaagtcttctagaccccttaggcttcagaagaatactgaatccctccctgggatgggaacccaaccctctagtgatgagaaatggtccctcagcagcagtacctggagaaagcagccaaggtgagcacctcaagtaaaagctctgagccacagaagaagagcaagatgccattcatgatggcttccaggcggagtacgtaggtctgcagcagcaggtaataggaggccatcatggcagatgggaaggtcaaggccacgctaatactgagcggcatctttcgctggcagaggtttccctttgtacctgtcagacacagcccatggagtcatctccaaatggtctgcttttcctggcccaggggaaaggcgtgggagatgtgatggaatggcaaggcacaaaaaataatcctgagtgggggtgtgc

SEQ ID NO: 65535 - DNA, 1099 bp, Homo sapiens
tttataaggcacccttcaacttccaattgagccttccaatcatttatattgctgtggcagtgagcttaaccagtgaacctctaaataggccatacagaatgggctctcttccagtttgataccagcgatttcttcaacacagggagaaagtagcagaaaattggtattagtgggatttgtaattatcagggcagttcctattgaaggttttgttactgtgtcatggctgattagacctgtctactctggtttttggatagtccccaagggcaactgggaggcaagggcacagaaggggtaggaaacaagaaaaaacatcagtgctttggacagcagagcccctcaggataagaatgagcttgatcatagaaagtaagagttaaagccagcatagaatgcttaaagttacattttacttcgagtaagagcagataatctaggattcatctgaaaacagaagagcctcaaggttttctgaagtggattccgtcatggctcctcgtggcttcttggaattaaaaaacatggccactaccaaggaaatgaggaataattttaaagatgcttacttggagaaagaaagtatacattgatctagagtgacagttctccagcttaaaaaaaaaaaaaagtgttccttttatgttgactcaaaattttatttttgagacagggtctcactcctgcacaggctggagtacagtggtacaaacatagctcactacagtcttgacctcctgggctcaagctatcctcctgccacagcctcctgaatagctgggactacaggtgcgcatcaccacacctggcttgtttttaaattttttgtagagacaaggttctcaccatattacccaggctggtcacaaattcctggaatcatgcaatcctcctgcttcagcctcccaaaatgttgggatcacaagtgtaagccactgtgccaggcctcaaaatactaaaataaatgaccaaaaaaaaaaaaaaaaaaacatcagctggttgcagtggctcacacctataatccgagcacattaggaggtagaggcgggaggatcgcttgagcccaggagttacagaccagcctgagcaacaaagaccc

SEQ ID NO: 65536 - DNA, 1148 bp, Homo sapiens
ctcataaaggcacttttagccaggactcctttaaaaagaaaaaagaaggatttaagagtttcctgtgtatgtgcatcctgcctgctagggcctcttgggtgtttggggattaatggatttggttgtgtacatacttgttttcttaccactaaacctcccatttccagatttttccccctccccttaaggtaagctatgacttgcacagaatagacttcttaacctatatttaaactcaccttattcccttttagcaacttttcttgaaatatgtcacagtttccatacttttgcagccaaagtctccttttcagtcgaacgttcagagacctcattttgttctgttttttcaccgaatctttatagtggatgtcactgctttttttctctctactcacagtagcttctcctccagccattcctcaccacttctagtgtcagacagtcctgctttgttttcccagacttgcattctctgtctgcattccttacttcttatgttgtagcgttagaatatgtgtgttttatataagcccctgtcattcagaaagtaacctctaacttgtgttttctttcttttcttctgatgttctcattgcaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatga

SEQ ID NO: 65537 - DNA, 2070 bp, Homo sapiens
cggtgaaaccccatctctactaaaaatacacacaaaaaaattagccgggcatggtggcaggtgcctgtagtcccagctactcaggaggctgaggcaggagaatggcatgaacccgggaggcagagcttgcagtgagccgagatcgcgccactgtactccagcctgggcgacagagtgagactctgtctcaaaaaaaaaaaaaaaaagatgtccttgattatttgcctgcttgatctaaagtaatggtaattgaaaaggaaggtgaggggaaagaatagtagttctttttggtgtctttgggatggcgatatctggatgaagaaggacaaagaaactcaccacctgtgagcccctatagttcatgagcagtagctggaatgtaaatagttggaaaattagcagtattttgcccagtgacaacctactaaaaaccaaaatactccttttaggtttggctactgccctctgtcttgttctttggccattagcttaaatagatttatagccaggaattgtttttatcttctcccaaacaagtaagtggaaagatgaaaaattactaatattttttgtctctgttctctgttgttagccactcatttattccacaaaatcctagagtgcttaacatcattgaaatctaggttaactcatgtagaatcaacagttaggctgtgggctccaggtacttctttctagattttgcaacaggttgagtttggggagatgcccatgtatcctctggaaaagcagacgctattgtagatggagaccacaaacaactttggcctaattcagtctcaggtgggcatgagggcaggcattagagttggtcttggtccagtcctaactcccttttcttgtttgagtctgcacagttgctagtgttacttgtgggttgaaaagcacatgtaggctacagtgtatgtcttttggagctgactgggataagagtgaacaggaaggtgatgattgacctgtgcagagcatgcactgtcgtctttggggctgcattcagtttagtagttagaacataaatgcatgtcaccattcctgatggctttgctcctgacagccttatgacagggaaattaccagcgagatccactgatccagcagtagtttgagaattaaacatctcaacctgagtctttagctgtcactttgcattatttcttccacttataaaatggggccaggcacagtggctcatgcctgtaacttcaacactttgggaggccgagaggggcagatcgcttgagctcagggaccagcctgaggaacatggcaaaacactcgtctctaccagagatacaaaactagctgggcatggtgatgtgctcctgtagtcccagctacttgggggtgctgaggcaggaggagtcccagctacttgggggcacttaggtgggaggatcacttgagcccgggagatagaggctgcagtgagccatgtttgtgccactgcactccagcctgggcaatagagcaagaccctgtctcaaaaaaaatagtaataaaaataaaataagatgagactatttctcccattatgaggataactctcttttggtaactttgaaaatgctgtaacaatattgcctagaaaacagtcatttgacttgtgtaggcccatgacaagatgggaaaaattaactctgaggcaggttttctacttcctcacttttcctggtcacccgtttgatatagtggttattgcatctgaataatagtctgaaagaactgaatcaggcaccccaagaatgtcaatttcttacattctcaccctaaggactcttaattccatctgtagtgaccaagttatggcttaggaagtttcatgttgggaagatggtacatggtcctcatttatagcaaccttttagttagaaatgaatcatatttatattctatgatgacagctgttccctgagagtgaaaggtacattttgtccagaggcagcaatagaacagtagccttctttgtccatcttttctcggcgtaagacccagttctggggcctgaaggctaattggcccacttgaaggaatctctgatttctgcctgca

SEQ ID NO: 65538 - DNA, 1627 bp, Homo sapiens
tagatgtcaaatagcccctggacaacagtgtgtcagtttgttcatctgacaacatctgttaaattccgaactgctggaatataggtgtcatccagttttacacttgcaacatctgccttgtctcttttaccgcggttgtttgggacggctagctactcttggtttgtgtctgcctgagttctccttttggtccagttagtttaccatctctcctcacccttggcctttctccttcatcctttatcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggtgagttggtgattgtgtcctcacctaccagccccaagcagcactcttccagggatagggagtggggacaaatggagcccagggaatctgggaaagacctggccgaaagtctggacgttagccttcatgtctttttggggaagaaactaatcagatgctttcattaataagtgttgtaacatctggaatctggtgggtgaggcagtgggctcatgtaggaaaaaatacagacagatatttttaagaacatgggttttggagccctacaagcttggattggaatcccagttctgctgctaactatctgtatgaccttcttgtgtatggaagttagtcaactttccaagccttatttttctcattttctaaaaaagggacactgatagtatttatcttacagacctgttgtaaagattaggtcagataatccatacaaaattattagcactacacctgataaattagttctcaacagataaatttacctgttaatcatcttcccaaaaaagagtagtcctcaaagagctaaaatcctcagacagcaggcccatgatagagtaatagaggaatagtttaggcaaatatcagaagacaccaaaacaccacattcttggaaagaaagtggtaggccttctgagtgaggctgaaggatctttctaataggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggtggggagaagccccgttcctggctgctgggggattttttattaaaaaaagatttatagtgaagaattctctctctttaaagcaaaagtaaatgcagcaagggtagggggaacttctgatttacataactggaatttcagggcagattttctgcacatttatggggagtcttaccctgagattcagctgtttctgcttgtttcttgactgccttaacctggtatctgagtgagagtatggtgtctgcattcaggtaccaatttgaatcccagtttctccactaataattggccatattactttctgttccacagtttcatttgtaaatgaagataataaaagcaactgtcccagtgacttgctaagttttagtgagagag

SEQ ID NO: 65539 - DNA, 2220 bp, Homo sapiens
tagaggattttggccattgaaatgtagcgggagttccccagattggagacatgttttgtagcaagcttttgctaagcatccttactgtcagctgtgtgctatctgcttgtgctgtgggcggatcttttattggcgtatctcccaatttttcttatctttcacttaacctccagttgtctagtcttcatgtgtgtctctttctcaccctgattactagttttagtatgtaaatagaagtgccatccagttcctgccactccctctcttcccttaaattccctagccaacaccctgtggcaaagagaacattttaagtgtgcaacaggaagaggttaactagtattagtttaaggagagaggtcctgaactcttcaggagatgtggggtttcaagtcaactgcaattcacctgaacatcagtgaacactgtcattttctcgtgggctatcaggatccttctacatttaaaaatagaagatacatataaggataaattaaatctgttctgaagcacttctggagttatggatggaaaacattctttgacaggatttaggacgatattgttttttggatttaatgtcttcactgagttgcttctgacctctgaagccaaaaaaaaggcagtagatgattttaccttctcagcctctttagtcaccttcctttgtagggtgtctgataacttctgaaggatgaactggtcctgtgggtttgtgtaaagcctgggcagtaacatcagttctgttttgcttcataggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcaggtaaggactattgttcctttcagatttgagccagggtaaataagtgtattaagcattttattctccctgagaaagtgagcactgaatccttgttctttcccttatagacattctgttatcatagcattgactcctgggaagtagtaccatgtcctttatacccctttttaaggtgcttaattaaatgcgggagcaggtgttatgaatgctacagatgtctagcattgttctgtgttatgccaaaattaccaaagtgttgtagagtacagtaaaaataataagggatgtgagcaatcaaggatggtattttctctgtacagccgagattcgggccctccaccctctacagtgagtgaagccgaatttgaagatatcatgaagcgaaacagagcaatttccagcagtgccatttccaaagcagtatctggagccagtgcaggtaactcagtgcttacctttgctgccttctccttaacctttacttttttttcctgattttgtcatttctactggcaaaagttcaacaagataaagttggagtactgtagatatcaagagcggcatactttgaagagcaatatgtaacctgatttcttggccttggggaagctccggcagtattacttagtctgtatctaggcctgccctcatgaaaaccaacttaatgcctagaatataaataattaataccatctcgatgtggtgtttgctgtagagtgaaattcctgccttgtggaaatctccatctcagtggttgatctttagatctagtgtctgtgtagtagacccaataccagatatagaccctgggtcttctttaggaatgatgttttgactggataatgtgtttttttgtttgtttgttttgagagggagtcttgccctgtcgcccaggctggagtgcagtggtgcaatcttggctcactacagcctccacctcctggtttcaagcgattctcctgcctcagcctcccaagtagctgggattacaggcacttgccaccacgcccggctaatttttgtatttttttgtagagacagggttt

SEQ ID NO: 65540 - DNA, 2658 bp, Homo sapiens
aaaaggaggtttttcttactttgtttcctggggtaggacaaggaagttttgtacatgttttaccaagtatttaactggattctaataaactagagtgaaatagaatgaacaaaatgaagtttgcagacctacctttgccaacccctcatctcttaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtgagtgtgggtaaccaaaaatgcttaggggtgggctggagggagagcactgggaggtgatggcattttcagaaactactgttgcactgttttgtgctctgatggggttggatttctttttcctgggatcaggttggattgatctctgaaagagaactatcctgaggacgtactggtgccgaagaaagcaatgattaagtgggtagttgctttttctgccatcttgttactgcccctgaccctggggctttatgtctagcagggtcatctgagggacgagatttcagagtgaacaccttgaactcttggtggtcattagatggtcctgtgataatggtgggtgatggggattaaagaccttgataactctagtatacttggggtaggtggtgactgttgttctgcaagttattttgtgatgttttggggctggtggtgggggtggtttttccaaattaggaagtatatttactgtgggggaagttctggcaatggtcaactctagcctgacagatctataattaaaaaattgctagctgtcaatgtttgaactgatgaccagccagcccaaacggcagtcaaagttacaataagttttaatcttcgtaatctctaaagatggagattgggggtgagtgggtttggaattctgtatgggtgaggacaataagaaaagtctgcactaattgaaatattgccaggcttttgagtttcctctggggggacttagttgtgactagaatcctgggtttgggacattggcgggcgggggtgtagctcttgacatctcttccttttccatcttgccggccccagtggaccacagaccagcagctgatccaggttattcgctctataggagtctatgatgtggtggagttgaaatttgcagagaatcgagcaaatggccagtccaaagggtgaggtctggatttgagaagccccttttaatttgtaaccattgggataaaagatctgtactatattttggccctggattttaatcactcccacccctggcccagcttactgccttggttttggcaaactgccttagaaagggacctagctgcagtgtagtagaatatccatctgttaaggggcgaagaatactgatttttaattccaaaaaaataaagatttaggctgtctctttgttgttagtgctgtatgtgtgtttagtttagcaagatgtcctttgctttatcaatttttactaaaagtggaagagaatttcttttttcttctcttggctgtctacagatttcattcatttttaatttttctttcctaaggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggtacgtggagaccatctgtatgaggggggggtgtttgtgggtttgttttctatggtgtaggcttagcctacagtgtgggtgagtttgggggagggtgatggtggttgtgagtggtgtcatggtcgacaagtagtcctcagaataggtctatatagaagaaagagcattgtgctgggagtcaagtaggttcaggttgtagtttggttctgccactgactcgtgtgaccttggccaagtcactttactacttagggcctgtttccccatctggactagtgacatgatgtttaaagttccatcacctctaaattctgtgtttctgtctaaaacttggcattaggtgaatgggcttaatttttaagacatgcctctctataaattatcaagaagcagccaccctaaaatgtaactaaaaggtgcctataatcttttcataaacgttgattggaaggatactgtaaggaatcaaccaagaggagtgttggagaataagacttgaacaatatttctccagcattgtccaggggagagggtgctcttttgattaccaaatgttttagtctgcttggcagttatatcccattagtaaagaaagttacaggccgggcgcggtggctcacgcctataatcccagcactttgagaggccgaggtgggtggatcacgaggtcaagagtttgagaccagcctggccaacatggtgaaaccccatctctactaagaatacaaaaattagccgggtgtgggtgacacatgcctgtaatcccagctacacgggagactgaggcaggagaattgcttgaccccgggagacgg

SEQ ID NO: 65541 - DNA, 1050 bp, Homo sapiens
cactgcagctaggtccctttctaaggcagtttgccaaaaccaaggcagtaagctgggccaggggtgggagtgattaaaatccagggccaaaatatagtacagatcttttatcccaatggttacaaattaaaaggggcttctcaaatccagacctcaccctttggactggccatttgctcgattctctgcaaatttcaactccaccacatcatagactcctatagagcgaataacctggatcagctgctggtctgtggtccactggggccggcaagatggaaaaggaagagatgtcaagagctacacccccgcccgccaatgtcccaaacccaggattctagtcacaactaagtccccccagaggaaactcaaaagcctggcaatatttcaattagtgcagacttttcttattgtcctcacccatacagaattccaaacccactcacccccaatctccatctttagagattacgaagattaaaacttattgtaactttgactgccgtttgggctggctggtcatcagttcaaacattgacagctagcaattttttaattatagatctgtcaggctagagttgaccattgccagaacttcccccacagtaaatatacttcctaatttggaaaaaccacccccaccaccagccccaaaacatcacaaaataacttgcagaacaacagtcaccacctaccccaagtatactagagttatcaaggtctttaatccccatcacccaccattatcacaggaccatctaatgaccaccaagagttcaaggtgttcactctgaaatctcgtccctcagatgaccctgctagacataaagccccagggtcaggggcagtaacaagatggcagaaaaagcaactacccacttaatcattgctttcttcggcaccagtacgtcctcaggatagttctctttcagagatcaatccaacctgatcccaggaaaaagaaatccaaccccatcagagcacaaaacagtgcaacagtagtttctgaaaatgccatcacctcccagtgctctccctccagcccacccc

SEQ ID NO: 65542 - DNA, 1751 bp, Homo sapiens
cggtccttagttcttctcttttttttttttttttttttttttttgagacagagtctctctttgtcgccaggctggagagcagtggcaccatcttggctcgctgcaacctccttttcccaggttcaaatgattctcctgcctcagcctcctgagtagatgggactacaggcgcgcgcaccgccatgcccagctaatttttgtatttttagtagagacggggtttcaccatgttggccaggatggtctcaatctcttgaccttgtgatctgcccacctcggcctcccaaagtgctgggattacaggcgtgagccgccgtacccagccacctttgttattaatgaaaagcttttccccttctaatttcttatctgtggattgataatagtgccattcatttcactttgagaaatacgcagaactcattgtccagtggtcactgctttgttagagtataagttattggcctcaatagtttgttctctggtctcctcagttaaaaaggacttttttatgggtctaagacaggctaaaggtagtatgtggactttaatagatacatatatccaacgggcaatatttgacactaggcaagctgaagaaagtgtgaattttgaatatcttatgttttgtggaaggtgagggatgagtgcttcccccccacacacatatcaattagttatttttgacaaagttagtgttagtgtcatctggaagctacagaaattatttaaaaaacaaaaaaacaaaaaaactttggctagaattgttagaagctggcttagtctgaaggcacccagtacaaattgtgttttagaatgttttaagaatgttactgatttcgccccaagctggcccatgcacaggaagcccttcatgtgcactttgctcctcaaggaaaattaatatttttcctagatggaaccctatggtgcttattccctgatctcttagagcatttgctgcaaaagcctgtttttgccagagctactttattcctgtaacacagggagtcctgggattcacattggctctcttgggccagggagaactctggaaaggtgactgagatcagttgctctgctgggagttttggcttttcatactgagacaggctttgcacagtgtccagttctcttccttatgtccatcaataagtatttatttattgagctacttgtgtttgctaagcactgtgccaggactagtgaggtaaaaggaaaaaaaagtgggtccctgtactcaaaacagattccactcctggtgggtaggggtggtggacaacgacaatgtacagtgaaggacaaggagggtgtgaagtgggaactgtggaaatggtcattataaagccaaaatttttgattaagccttggttacaattaaaagaaacaatggtatcaagttggttgctctgagaaaaataaatcctaggctagttacttccctcagtgggatatgaggaagaagagggtggaggttaggaacactgagcagacaagtggagaagatcttatttaaattgaaaatcacacatgttctcttttgtttacagggaagcaggaagtttcatgagacagtcacagttctttctgtgccattaaacacaaaattctttgagatagttattcagtattaaatatatgtttcatgtttaatctccctggaatgaaactttgaacatcagtgcatgtaaaatgtacttttcacttaatttgtagaatttgattttactttaatctattactgcataaat

SEQ ID NO: 65543 - DNA, 1031 bp, Homo sapiens
cggcggcctgggagagcggtgggcggcgcgaggccgggggcggggcggagcgggtggggccgagctggggccgccaggatgctgcgtctctggagatgggaggttagcaatcattaccctcttcccagcccaggaccctcgtgccttctaattcttgcatttttccgaatcccgcagtggcatcttccttactttgtccatcctccggactcgcgatcttccttccggagccatgtcagaaggagtggacttgattgatatatatgctgacgaggagttcaaccaggtgaggtgtcatcaggagctttgggattttccttgatcatctgaggaatcattttcagcaaactggcagtggtttcaagctgtaccagtcctaggcttgaacacgcgtctatccggtctaaaatttttctcctgcagaaactttaaagactacactccattcctctttatgttaatttgaagctccaggcttaattttaaaggctttgatttaagagcaaataaaaagcaggtgtaatagaatggtgaatcaacctgtggaatttactccccaggaagccaaaggtgggtgtcagactaaccacacttaaaaatcaaaagtacatttgctacggtattcatgaggacagtgttgataccggttcctttacattctcaacctgcagctggagaagtgtagtcccctccatcgtgacagtgcaaaagcaaagtagaaaagatgactttaacatttagtttcaactccattccaattaagttttacttccttttataagtaggttgactccagtcatgagaagtccacaggcattttggtataataaattgtattggttacctttagtctttctagagggaataaaagagtaaagacgttagacaaaccagttagaaaactgataatagacccatgcacataccctcagttggatttgtttttattgtaccagggaacattatacagaaatttatctagagctgggcaaggtggctcttgactgtaatctcagctgctctggagcctg

SEQ ID NO: 65544 - DNA, 1097 bp, Homo sapiens
gaagtgtttttaaaagctctagggctgtgtgacttctgtgttgctagtggtgccctccctggaggggttttgccctcagagctgtaatctaggcagtagaatcagtcacccagactggaccaggtgcatctaaaggtgttgactagaagaaggtcggccagatttgatgagcaggtggttggtgattataggagccgcacacagggactacacacgcacatgtttccagcattgttgagctccagggttcctacagagccacctcatggttcctgcctgctcttcagtatccctggtggctcaggagggaagggaagagatctagcctttacgtaatcacagttaagcctcacagcactctagactagtggtgttacctgtattttatacataagaaagtgggctcagagagaggaagtaatttgtccaaggtcaggtagctattgagtcgaaaaagcagaatttagtatagctcagtctgcctccaaagctcttgaactttctactagaacacactgccttactgctggaaatttaatagaagtctctgtttgggaaagctgtggcaaatagatgtgacagttctgagacatgacctctgtgttacatggtgggtaggaatctgccaggtgcttcgccaagtgagtagatctgaacttgatcacccagtgaagcttctgtgaggaagcagcgcagtgcactggttacacatttaaatcctggctctgctgcttacctgctggatacatgaattgacctgagcctcagttgcctcatctataaaatggggatgacaatgcttcctgtctcagctagttgatgagatgaaacacacaaagctcttacatggtaacttgcacagtatgtactctagatatgaatgtcagcatttagtcatagcctcagtctgagacttaaaacctgtccctaacacaaattgcctggcatatcaatgaggtcaccatagctacatccagggtttctcatctgcaggtcagaaagctgagcctattaatagaaccacagaatgtcttacctcccagtgaagacgagagagaaaacagaccctggtgacaagacctttgatggaaaaatct

SEQ ID NO: 65545 - DNA, 1046 bp, Homo sapiens
atatgagcgtctggccctgtcctgaccgactcaagtggtcttgtgagtcctgcacaggctctccacgtgacaccttaaattgggtcaggaaaggctgttctctttccatcgtttccttttaatcatcctaagtcttaaaaatccataagccaaacaccttgtgctggagctttctgtgccttagacagagtgtgtcttttgggggtcattgtagaagcactcttactggctttgagtgttatctggaggtcatctggtatgtcttctgctccagccagggtggcaccaatacagacctggttcatatttttaaacatcactgggaaaagattccgatgggatagttggggtctctcatttatccttcagtccatctgcagctatttgtggctagacaaagagaggaaggtttaatgataagctaaacagctgtagatggcaagcaggtctgtgagatttttgagctgacagccccacttaatagtatgttctgtagtatctgaggacagtggactcaccatcccgcagctatcaagttgatgacactgatcagtacccagtgaaactaactcctgacacctcagtttcccagtgaaccctctgggaatgaggagtggtgttcgaattttcctgtcagggaagatggcattggtgggataggtggcttcaggccagcagtactttttgtggcttaagaaacaagtgttgttagcagtttgttagaggggtggtagaaagtttaagctatccaggacaacatcagtctttaaaggagatgggtagatttatcatcacctatagctgcaaaagaagagttaaaagccttttgttggatcccggatctcagaccccagatactcctttttttttttttttttttgagacagggtctcactgtcacccaggctggagtgcagtggcaggatctcccctcactgcaagctctgcctgggttcaagcgattccatgcctcagccaccctagtagctgggattacaggtgcacgctaccatgcctggccaatttttgtgtttttagtagagacg

SEQ ID NO: 65546 - DNA, 1022 bp, Homo sapiens
gagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaagtagggccttggctgtttcctccgtgggtcccagccctccctcacctccctgggggcagaggcagtggggtgaagggga

SEQ ID NO: 65547 - DNA, 1034 bp, Homo sapiens
gtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccaggtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagc

SEQ ID NO: 65548 - DNA, 1050 bp, Homo sapiens
ctcatctcggactctgttcaagaatcaagatgtcagcatcatcctggattatgttcttccaagaatcagaaagagggaacattgtgggaagacctgggttctatccccagctctgatgctacttgtctgagattttgggcaagacctggcctctctggggctcagtttcctcattggtagtaataggagggccccaggtgatcgctaaggtccatctgctgattctcccaggtccctcttgttcttgcctgggtctttccttgcctctggggaaagcacacggccctcctgcctcagcttccattcctggaaggggaaaaggatcctaggaagtccctcccccacggtccctctaacccttccccactccctcccctagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaggtaggggcgaggcaggtggtgtggtgcacctgctggcaccagtgaggctccgttccttaaaagaagcagcgggggtagtggacgggcacaggctggacaccaggagagattgggatcagtctcctctcctctcaggcctctgtttcttcatccaaaaataaggggatgagatgaccccctccctagggttcctctctgagtgtcctcctatgggtaagtcagctcaggacagactgccagctgagcagggagaaaaggagtgcaagagaggaatggcctggatctcaaaagaaaggtttactggacaggatgatgacgttggagcagtattgcccggggtcccatctgcacagggtgagctgcgtggggcagtgttgggagctgcagtcagactccaaagacctcgtttcagttcccactccatctgccgataaacaaccatatcaccttgggcaagtggctcggcctctc

SEQ ID NO: 65549 - DNA, 1094 bp, Homo sapiens
tcacaagccaagcagggagaggacagccgggccaaattgtggaaggacttgaagccaaggtagggtgcccggcttttattctaagtgcactgggagccattgaaaggctttaagcaggagcatatcatgatggaatttctatttttaaaaggtctctctggctgccgcattgagaatggacggtaggagaaagcgtggatgcggggagggcggtttggagacacttgcagctgcctaggcaagaggtgccagcggctcggatgagggaggtggcagtagagaaggggacgctgcggtaggaaggatggaagcacaggcaggaggagaggggtgtggagtcacaggacacttgtcacctcctgcttctgtgcctttgccttttccctcccaccgatgcttccccatgtccctctgccctgagtcctggggcctgcgtactggcagctgtggccacctagacagagccacttgcccagacccgcctcgggacgattggcagaggctgctcagccactgagatggacacaaggtgcatgggtgaatggatgatcgcagttctactctttactagctgggagtctgggcaagtactttaagccgtctgagcctcatctgtaagatggacgagatgccattcaccttggagaattgttgagggaatcccatgagacggtgacagttcttgctagcacttcagtaaggtctaattgcaatccggtgtgcctgctggcccggtggggtggcagcgggagggcacagggcctgcctcctcttcccagggccttccttgcctcccgggccccgtgcagcccctctgtccccctcttcactcacactcatctatacccccaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgtaaggccccatgggtgggtcttagctggacaggcagcagggcagggctgggagatctggtcccagaccctt

SEQ ID NO: 65550 - DNA, 1040 bp, Homo sapiens
cagcgtggccaaataactctaacgttctcatatcttcagcagtcaatctcacactctccctgctcttccactctgtttctaacctgactttacctctccagctgtttcgggctcctttccttccccctgcctgcccgtgtgagcacgtgtcctctcgtgtgtgtgtgtgtgtgtatgtggtgcgtgcgtgtccacatgtccatgtgtgccatggccctctgggaggggcgcccgcgtgtcgctgggtggagtgggcgtttccgtgttgtagaggcagggccaggttgtcacagcaggtgtatcgtgcttctgataatcaggatgttgggccctgaaaccactccctgccctttccgtttcagtttgtctcccttcacgtgcacacgtggcatgcctgggtctccccagtgcatctcctctcgggatccctgcgtgccatcgctgtatgtgtgtcgtcactgctgctgtggttggcctgactgtggcctctgccatcctctccctgcccctctggatgtctgtggggctcatgtgcatgtgtgtgtgtacatatgcacgcacgtgcgtgtgtgcgtgcgtgtgcgtgtgtgtatgcgcatgtgtgcgtgcgtgtgtacatgtgtgtgcatgcatgtgcgtgtgtgtgtgcgcacgtgcaccctgctttgggatcctgatgtctcccctccagggcctggcatattccatgcatgtctgtctgtgcctgtcgtggtcacctgtgtgctggaggctggtctctaccagagggccatggctcatgtccaccctcagcgtgtggctcccagtttgtggctgtgtgctctcaaagctgttctattttagcctgtcctgagcctcatgctactggtcccccgtctcctcctccctacctacccctacctctcttcctcctcatgggacattccatcctggtccctgggcaggcttttagtgcccccttcctgacccccagctgaacggagcctgggctcaccacccagccattgggtcaaagaacccagcatcctgggaacggcatg

SEQ ID NO: 65551 - DNA, 1048 bp, Homo sapiens
aaacaaagaaccctgaaaagagggcaaagatccacgccagaccctgaattctaaggctgtgctggccacagggtggaggtctgccgcttccttgcctctgtggacaaagtataagaactgatggcttccccggcctccccaggattactaggccagctctgcactggcctggatttcttcctgtctccaaaggatgccagtacttagaacacagaggcagactttcctggtgtcccccagcgaaatagcgggaggggccacagcagctccctctacccctcccactccaacatgacaggcagctgcagggcccaggggacctgccttcaccacgcagcctcagcagcactcgcagcccactcagaccggcagggaggtcggcctagccaggaggtattctggcactagctgagccagggccagaaggtgggtgggcagagccggcctggggcctcagggtgggcgcgagggctttgcagcctcctgggcgaggcagtggcggcgacggcggtggcgacagctccgatggaggcctggcgaggtccggcagcgcgcaccctgcactggggcctcctagtcctggccctcggcttctttctcttccactgtgatcccttcatctgcttctcctttctctcctctcctccacctgccccaagtttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctgtaagtcctccccttgagcg

SEQ ID NO: 65552 - DNA, 1071 bp, Homo sapiens
gggcagcaggcctgtggttgttccatctcatcctgggtatctggcccactctcagcctgacaatcacccatcagctcccaggctttccctcttacagccagcagatggctctagacccagaagttgagccattccatttttgaccatcgggtgactccattggctgtcccagtcttgcttgaaccatacatcatctgttgtggaagccactcacgagcagccgcaggctgccccatcggttcatcctcatctcagccatccccgttggctgtcccagtcttggtcaccgagctatcccaccactggctgttgggaccgtgtattcctggaggttgggttgtcaaaccccagctagcttcacttgccagatgtcatggggtgttctagacatcaggcagaaggagccgtcccctctgtaatagctgtctgagcttgtcgaacagtcaggcccactcttggctgatggacgtaggattggcccctgttttccacagacagtatatcccctctcatggggcagctttattctcatcttggcctttggaaacttctgattcccctcatcagagcccttctaggccctgagtcctttgagctgtgaccagtctcccttggggtataaattccattttcagaagttggaactcccagctaatggagcagcctcccatttaacaggccaacagccctgccccttcctagctgttgggccatcctgttgcctcaactgagggtcctcctgattctcttcagaagacctgtggttcctgccattgggagcaccgaaggccaccgtaccaagatctctttcgctagttggcttgagtgcacacaagccaatttctcccaacatctggccccaggagggtcccacagggaagccacacaccccttcagagagcccggcccagtgccccaccctcccagcctgccccggccagtctccaggccggttaggcctccatgccatccactggctccaggcctggaggaaccaattttagtttcctgtgactgagaggttgtaaattggactaattttggatgtgataggaaaccaaaatgaggtca

SEQ ID NO: 65553 - DNA, 1100 bp, Homo sapiens
caaggagtttattctaaacatttcaccctacgccccttatggcgacccacgactgtccctcaagtgagtgactttacctggtttgatcatatgtaccgagtatccgcgcacgccctccttccctcctcctgcccccacccacctctggacccgctcactccctctctcctctcgctcctgtcccccaacttccccacccatccaccccatgggcaggccgaccatggagacgagcaaccccacctgccccaacccacctgcctgcccgctcccgtcccctcccccagggccagccttgcaggagagccccctcggcagccatacctggcccccccagctggtcccggggcccaccccaccttctgtgcagtcaggatggggttgcccgtttgggtcccgccccctcggttgtggtcgcttcttcctccccgctgtgtgctgccgtggctgctcggtggtcggtggtcggtggtcggtggttcgtggcggtggtggcggtgatggtggtggtggtggtgatgaactctgactaacacggctttctctttctccctgccttggggcctcctggcctggacagcccgctcttcctccgtcgttaacccttcgttgtcctgtgggatagagttggaggtggctgccctcccccaacccccgccgcccctgccccaggcggtggggaggggccccccctccgttgtcgtggtgcgttgttctccgacccccagcccgcccggtccccctctctcctctgcaggctccgctgttaacccatttgcagtgctgatgtctctctctctctctctgtctgtctcatgtccgtctgtctctctcctcctcctctctcactgtctctttcttccttttatctgttattgtttttcttcctcttccaccccccgacccccacgtatggcctgccctctctcccccaccgccacccccggtgcccctctggcctggctgcctcgtgcatgcctccagtggcaccctcctgtcgggcgccaaagtggccgccgcggcggggctggcggtggagcgggaaggccggctgggggagaagccggcaccggtgccgccacccggagaggacgccttga

SEQ ID NO: 65554 - DNA, 1029 bp, Homo sapiens
caatgagggtgtgacctgtacctgtcctccccaggggcgccctcgcgcgacgtcctgctggtctctgccatcatcaccgtcagccttagcgtcactgtcgtcctctgcggcctctgccactggtgtcagcgcaaactggtgaggctcctgagggccccttggagggtggtgcctagccctgcacactgccccccctccccacacacacacacaattacaggcttgggaattttcccaagggtgcacacaggtgactcacctgtccgcatagtcaggggcacttccatagaaattcagaccgcgtgcatacgcatgcatgcatgcacaccctgcgtttacccgggtctcagccctatacttctgtttatatacccaaagccatgcatctagggacacattcggggacagacttaggactcacaggcattcgcacgcgagcagctacacacacgcgcacacacacacacacgccctgcctcccgcataaagcaccgcaggcacacacgcgcagactgagaatagagcccccactctaagcaccgcgccccctcccctctgcccgctcccctccatgggcgtggctgagccggtggccaatgcggaggcgccgcccgccccacccccgcacatccatcctggctcttgggtttgtacaagcacaaacggctccttttcatttttaacgagggctggggaattaacgagcaggattagtccatcaataagtaaagagaccgtcaggagggacattcatcccctgagggcgccggtagggggagcggggctgagccgcccgccccgcatcgcgccgccccgcccagcccgcagcccacagctccccgagccgctgctccgcaagacctccactcccgtccccactcctgccgcccggcccagaagtgtggtgggactttgggggcagcagggggcgaggggggcgacggtgggcccgggggtgtccgaggtgctacgcctttggcggagtcaggtgaaggagggtcactagcaagcatcccccatctccccggg

SEQ ID NO: 65555 - DNA, 2039 bp, Homo sapiens
cactaatccagggcacgatgtgataatgctatgataatagctagcatttagtgcctacttattccgtgtcaggcactgtgctgagttcactgtacatgctaattcctttaaacctcaccatagtcctatgagactatactattatcagccctcatttacagatggggaaaccaaggcacacagagattaggttacatggcttggaagaatcagagccagaatttaagcatgagcaatctgacttcagaggcctggcactaatcactattctctaaaagaaggatgtaggcccagtatgctgggaactcagaggcaggagaaattaattcccactgggcagactaagggaggcttcctggaggaggtcttttcatctgggcctaaaaaaatcaggagtttgtcaggcaaagttgagcatggggaaagaacagaaggggtcctagtgtatgtgtgtgtgtgtacgtgcgtgcgtgtgtgtgtgtgtgtgtgcatatgtgtgtgcatgcatgtgtgtgtgcatgcgcgcacacacacttgtaaaagagagctctcaactcatcactgcagcctctcccatctcatcactgcagcctctcccatctcttctcttccatcttatttgggtgacaaatgagataacatatacaagcattgaacattcaacaaatatttgctgagcaccccccgtgtgtcagacgccgagctcgtcatagagtatactggagtgagcaaagcagatacagcccctttctttgtggaccctgtagtgtggcatatagtaggtgcttaataaatagtagcacctattattatctttgttcctggaggcctgggattcttcctccttcattctttcaataagcatttattgagcacctattaaatgctccaccgttggtgctgggaatacagtggtgaacaagagaccaagccctgcccagatgctagaagggaaggctgtgcatggacatcttgtccaccctcagaagcaggccgcttcctggggtacacagacctgaccctgagatctccttggggggtggcatggccaggagcataggctgtgcccacaggacccagcaaagcacacaggactcagttagacccttcatcctgagctgtagtcagctgatatgcctaccacaggcctgggtagaggggcagcagcctgccccagctcatacctcactcccaagacatcccggcattggacctaggagatctggctctgcctagctcctggttcaccctgccttccaggtttcctgatgttgcctgtctgcccttgtctatgctgtgccttacccgccgggacctaggatgtctcctctgcctcaggataggttgtggcactcaaccctgtcaaaaggctgactagggctccaaattttctttcccccagtgttaatatgctgacagtaaggggacttgaaaccatgcatgtcatctgaggaggggttagagggctggggcggctttgcctggagaagacttgaaggggacattagaactgtcggcaaggatttggaggcctgtcatgtggtagaggcagccagctcgttcctggcagctctggagggcaggctcaggaccagcagggaaagttctggggagacagattcggctctgcgagaggtacagcagccctccctaacaatgcccgtccaggaaggacctgcttcctgccttctgctccctgcagaagctccctgtcaccaacagggctgcccatgggctttgtgcatccctggggcctgacttcatgactttcaaggtcccttctagctggagacacagtgactccatatgcagggaatggttcactctggctggtaggcgagaacatgcttgcaccccttgatggcgacatcccccttaggatctccttaggatgtcggcatgctggccgaggacatcatgtcactattattcacaacatcaatgcaatttgcagtggcaagtgtttgtttcaccctgcctttgagggctgtccgagggaggctgaagggtctgggaaatctgtgggggccgtaccaact

SEQ ID NO: 65556 - DNA, 1054 bp, Homo sapiens
tgtgttaccatggagacaggccccctccagggccctggttcacactgttctgtggccttgcagggaagcttgatcaacaagctgcccgcttgagggctggggcatagtggggagggagatagccccaaagcccctcctcatactggggagggggttagagcaggccggattgaggtgggaacgtacaggccagtaggtgacaggtaaggggacagctggaaggcaggtcaataggtgggtgctgggtgagcaaagacaggccctgggcagctgggttctgctcctggctgaccccaagctcaggcttaaggggcattgagggcaacatggagtgccagtgggggctgtctccttgttacaccctctagcccggccattgcaggatgttgtgtggaacaggcagaggagccgtatatggttccctccccctcctgcccctcctgagtccccccatcctactccccacccaccccctattctctcacggactttgaatccttattgaatctgatggaccgttttcgttttcaataactggttcccccaggggagtgaggccaagaacagaagaacagcagggagaagagctgggaggggtcacgtgggggcgggaggcccagtccggagctgatgacccccagctggagaatgagttggcttgatggctcctcagagcactgtggcatcacaggtgggcatgggcagccctgtatagagctggtcctctgctccacagacagtgcccggcaggtggcatatgtggccgagaggtcaactttctctcgtcggggcagtcactggtctggccaggtgccggcaccagcctgtgccaggcccagcccgggtgcctgcctgccttgccagggaaccccagctggtgatgccaggtgaattctgccagttccgtgggcatggaggtccctgaccttccaggcagcaggggcagccctgctgggccctgtccaactagtgtctgcagggcagggctttggtctcacccagcagaattccccaagggctggaacagagttggcagacagcatgggacttgtgg

SEQ ID NO: 65557 - DNA, 1098 bp, Homo sapiens
tctccctccctcctctttcctcccatgcctgggcaccatgacatcaccactcctccaagcacctctgccctcaccacggaggccagcttgacgtgcttggcatcttctaggcaaagggtctggagtccagtaccatccctggtgtgctggcagccctcaactcttccctcaccccctccttgaatgggcctctctggctgcagttgggacctgtcttgcccaccccagttgcagctgcgggacccaccagtgcctgtggtagggcagctgtgactgggaaaggggctggcctgaggctgactcctctccggtgtgggcattgggctgggtggggtcagacataggctggagagggcacagtctgcctttgagcctagtcatctggggtccttgaggagtcaaagatctcattctggcctctgccctctggcatccctgcccacctttgtaggctctatagttccaggtcagatttcccttccccccagctcccccaaggctccctagactcagctccccaagccagggctctgtgtcccccatttctgcctccccatctccccttggctggtactggttggtactgagatatgcaaattgatttatgtgtaactcaggccacccctcccctcccctctggtctcccaggggccagtgccttttatatcctgatcctctcatcccactctcaggaacacctgcggcccaatccttaaaaaaaaaaaaatctgtcctctcctgctcccctttgcctcatgctggttccagaagatccctgtggtactccctccctcatcccacttactatgcaggtccctaagggctcagctactgtgaggaccttacctgacaggtgtggttctctccctacttgggcctcaggcccccaggcccttggttccctgatctattgtgaatgaagaaaaggactgtgggaaataatcggagtccagtgaagaacccagaccagccccctcccatgcacacccaggctccagctccacactctgtccagcctccctagaccagacctgcagcctcccttctgccccctcccagacttcacggcctcttcctgccctcagccttcaccctctg

SEQ ID NO: 65558 - DNA, 1224 bp, Homo sapiens
cccaaagtgctgggattacaggcatgagccaccatgcccggccaaagataagtctttttcttatgcataagtcagcgtgtctggtctggggtccccggtcacagtgcacctgccctgcctgaggtgaggctcctgcagccaggggcagcccagactcccccactggggtgactttcaccatcgcctccctcacctccagggtatggctgatgatccccagggcttcacaccgcttctcccgctttcttacttcctctctgctttgagtcttccctgatgatgcccagcactcctcccattttacataagaggagagggtggggaggggacagctgagaggtgggaagcccccagcttgcaaacctctgaggccaagtttagtttggcatcacctaggtgactaaatctaaattccagagtctaggcacataggatatgctcggagagtaatggctgcatgaatgaggctgggaaggcagccaaggatggggcagaggcccaaagctgtgtgaccttggcacgtcagcattcctctatgagcttagggtactcatctgtaggattcggggaatcagggaggcgtggcatctgagttccctgggcctctccagctctgaacttctggggactgtcacatgtcttcagtcctgcttccttgcctgtttttttctaagcaatttttgctgcccaagaagacctcacctgtgtgttccagctacccagtgagtttgcgcgtaaatggctgctcagggcagggctctccagtcaagggcttgagcaaggccactgctgtccccacagccaggcttccatgctgtggcaggaggaagggagaccaatgctgggacatgagagcgatccaccacccatagcagagggccggggtgcctgggtgtgcttggacctgacattggcctcacgtgcaccctttgtgcctctgcgccggctgcctgtcagttgtcaggtgtctgcctttcatcctttcctggccaaagctgcctttattcaagtgccccctgccaggctttgtgtctgataccccatttccggcagccctgaatctgtggccctttgagctgctgttttccatcgagtggctccgtggggaggaagggtgggagaaatccattcaagtcatttgttttaaagacattgaagtaaacccatgggattcatgcggtcacatgttttcagtcttctttcaaagtaatagttgggtttctg

SEQ ID NO: 65559 - DNA, 1049 bp, Homo sapiens
catcatccacgtggtccacaaccaccctgcagagcagtgctggtaggttctgccagggtctgctgctgcagggggtagtggccagggcaggggcagtggagagcagggccggccttggctcaatcaccgctcggggctgggggtggaggctgggagaagatggcccagggcctccatggaggggtttccccagcatcgggctctggaaatggaacaaaaggccagccctgagcaggactccaggcgtctctctccatagtctggctttgcctccagtgtcagcccttccctggtgtgccccagggcagctctccccactggtggtccatttaaaagtaggtgccctggagggctcacccctcaggccctggccagctcacacctcagttgtcacttggtttcaccaagggaattcctcgaagacagctgtgagcaaggtgggggctgcgccaggagagagaataggagcaggcaagtgggtagacctttcccactgtgctccttcagacggctgggccctggctcctccctccagggtcggcttcctcccctgacacagctggtgagctgggccgtgcagcaggtggagcaggtgtggcccaggccaaaagcaggtcgaaggctgtggagggaccatggctgaggctcgaggtcagcctttcccaggctgagggcagggcaggagccaggccagggaacagagccctgctgccaggcaggccaggggcctccaaaccatgccagctctgctgagcagggcagagaacagagccaggaggccctggcaccgagggccaggccaccaccccacccttaactcccctctgtccatgtccctctcagctgctgtgagcaggaggagcccacatactttgccatctggggcgacaacaaggccttcaatgaggtgatcatctcgccagccatgctgcatgagcacctgccctatgtggtcatggaggggctcaacaaggtgaggcagctcccggcagggtaccaccagggaataaggcactgtcaccccatcagaaccccgtaagcaccatcag

SEQ ID NO: 65560 - DNA, 1103 bp, Homo sapiens
acttggagtggatgtagccatagcccaagggtggctaaagattctgggtctcctagaagagagggttctccggctgggccagtggctcatgcctgtaatcccagcactttgggaggccgaggcaggtggatcacctgaggtcaggagttcgagaccagcctggccaacatagtgaaatcccgtctctacaaaaaatacaacaattagccaggcgtggtggcaggcgcctgtagtcccagctccttgggaggctgaggtgggagaatcacttgaactcaggaggcggaagttgcagtgagccaagattgtgccactgcactccagcctgggcaacagagtgaaactttgtctcaaaaagaaaggtaaaaaaaaaagagaggggtctctgtaggcagcctgtgggggctcttctgcatttttggtaagaagctgggagagaacaaagactactgtgactcagatcgaagaacctgatagaaaaacggctcaagagccccatctttgtcaggtgtggctgctgggcccaagctaactgagatttgatgcggagaggcaaagggttgcttgcacaagcaaacatctgacctgaaggcattttgactaagacggctctggtcacaagttgaagcctgaagcagggcagctagcagttatagattttttttttttgagacagagtctcactctgtcgcccaggctggagtgtggtggcacgatctcggctcactgcaacctccgcctcccggtttcaagtgattctcctgcctcagcctcctgagtagctgggattacaggcacgtgccaccatgcctggctaatttttgtatttttaggagagacagcgtttcaccatgttgatcaagctggtctcgaactcctgaccttgtgatctgcccacctcggcctcccaaagtgctgggattacaggtgtgagccaccgcgcctggccatagatcatattaataaagagagaaagcccaaaccaaaggaggtgaggccactgtgccttgcccccatgtaaactggttgggagatgagccacagcactgggggccctctgtgactggggcgatggggaggggctgccagggcaggcagggagg

SEQ ID NO: 65561 - DNA, 1356 bp, Homo sapiens
ggactgacccctggaggacacggcaggacagtgcctgttgggtccgagccatcccatcgagggcagtgggcacccacggggctctcgactcagtaagcacctcatttgtgcctcacagcaccccataagacagaggcacagtgaccccatttgacagattagtggaaaggacttgttccctgtcacacagctagaaagaggcatggcaggatcggcctctctgtacccagatccatgccctgggcccctctcctcctctgagactcaaggtggccttgtggtggggcgggggggcattatcagtgcttcctggaggggtgccaggcagtggagggtgagagccggcccccacatggatacctgggtgggaaggagcaggggcatctgttttggagggccagcctgggcagggatggagggctgggccctgaagcccagggtctgcagggagctgggcctcttccctagcccatctctcctgccctgcaggccacgacatcaacggtgccctggagccctccaacatagacaccagcatcctggaggagtacatcagcaaggaggatgcctccgacctgtgagtggccccctcgcccggcctgcacccgcccagccccagcccttcgcctcccttctgtcaccagggaggtctgagggccggacctggggtctgctgtggtcccacctctgaaagctgctcctcgtcccttcccagccactgactcctccgaaatctccatagttccctgcagggagggggcggctacttccctgctggggctggggtcctggctggagctgagccgccccccttccccgcagctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccagggtgagtaagggcagggagtagggggatacagcggcataggggcaggcagggagcagggctgtggccgtgacctgggaggtgctagacactggcctggcatgggatgggctgggtgactggctgtgcgtgggcaggtgagggaagggaggatgagtccaggtcaaggggggactcctgggctttgttctgaggcagtgggcagccacaaagcttctaagcatgggagtgatgagggctgacgtaagtgctagaaaaatctcgatgctgtgt

SEQ ID NO: 65562 - DNA, 1335 bp, Homo sapiens
cggaagctccccttccctggtttttgtggcccaggccctctgtggcttgtttctgatcacagggcctgctctccatagagcccccactataaagggtgaccttgagtgtgacactgcaggcagggacaaactcattcattcctcaagcgattgctgtgattctgtaagccagccctgttgctgggcatgatggagacaccaagtcaggtgtggctcctgtccacagtctgggggaagcgaagagtgacagaagcagaaaatgacagcacagagcaatggggagtaggaggaggcaaagcctgagggcttcctgaaggaggtgtcctctgggcggggcacatcctggcccaaacaggctagagaggggagagaggtggatactacccagtgggaggggctcggggagagccagcccccacggcgcacacttctgtttccccaggctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggtacatggctggccaactcttcaaggtggggtgtgggacccaaggtgcagggcccacatgggcgttccctccctccaggcctcctgcaggacagtgacagcctcagtggctcctacctggaccccaactaccagtccatcaagtggcagcctcatcagcagaacaagtgggcgaccctgtacgatgctaactacaaggagctgtgagtgccctacaacactccccactcctccaggcccccccaccttgggacgccccagcccaggaccccatcaaggtcctggagcagggcctgggagcactcatttcacagaagagcaaacaggctcagggaagagccaggactggcagtcagggctcctgactcctaggccagccccaggcctccctgagaaggtgatgactgccagggaggggcagctgggaaccaagtcagggagaagtgggcagatgggtgttttttcccccggttcctccttccccacctcctccctctgcattccaggaaggtagccggaagctgagcccaagctgggccctcccggcagccccctccctagagggagggaggaggggctggggaggatccggtcagaggctgcctgagcattcctagcaccccctcaacacccagatggctcc

SEQ ID NO: 65563 - DNA, 1121 bp, Homo sapiens
cccctggtctgggttacctcccttccttgtcggaatgtccacagcagctgggacccccaactcctgccccacttgagactcagggggccacagcactccctatccttccaaggcccccagtgtcctcccagcaaagccccggcttccaagctgcaccacgggggccttgggggccctgccctccgctccagctctgccacttgtggtaccatcgcagcccccgccctccaccctgtggctccctttgccttggatgcccttcccaacacccatccctcctctccaggcagactccatgctggtcccctccccaggggcccctcccctaagacccattgggaggcaccacagcacaaccccagtagtggctgattttgagtctatgagctccctgtgggcatggctgggtctgtcggcttcggtgtgatgagtgagccaggcatggtaccttggcatggctctgccagtgcacgtggaggagtagaggagacgtgggtatggagaggatctggggagtgagtgggcctaggtgcaagtggatgggcttggaggctgctgtgaggtgtgtgggtatggacatgagggagggtggggctgtgagtgtgtgtgtgtgtctgtgtgtgagtgcatacatgcagaggtggggggagcgtgtgggtgtggaatgggggtgtgggtgtttggggagtgactgcatgcgtagctgtgcagaagttgggggagtggtatgctgtgaggggtgaggagggtgtgggtgtgaagtagggtgtgggggggtgtgaccatgcagaaggcatctgagcttgtgggaatcgcggctgagggctgggtgctgccctgtttcctggtgagctctagttgggccaggcctggctgagagggggcaggagggcaggaccagccgggtagccccatcctgaggtgccactggcttcactccccacagctggaggccctgaaccagtccattaacatcgagcagtcccagtcagaccggagcaagcggcccttcaacccggtcacgtgagtgtctgaccctgttgggggtggtacctagaagggtccacaactaaagctggcttgggaatggaggggccagggaggtacccagggtgtccgcc

SEQ ID NO: 65564 - DNA, 1022 bp, Homo sapiens
cttcagcgagaccaccgctaacaacatgcgtaagaagggcaagcccaacccggaccagaggtgagcaggtgggggccctgccccggagcccctccatttctgaggcaggaagacactgccctgggtggcacaccaggcacagagtcctacaggctgagccatttcacagatgagagacctgagatttagagcccttcattgacttaaggatgggaagagcagaagcctggcttctgggttgagaaacagccctggcttcttgctgtgggccctggggaatttctgccccctggtggaggctcgggttcctcctctgtaggagggggtgagatgaacatgcatctggccagggaaagggtggccctgggggcgggggcaggccatgagtacttctgagacccctgtgtgtcccaggtacttcatgctggtggtggccctccaggctcatgcacagaaccagaactacacgctggccgcccagatctcagagcgcatcattgtgcgggtgagggccacctcctcccagggcgtagacagccctccccaggactgggagaaacagcaagcagaagtacccgggtactgagagtcaggagtgggcatgctcatcctgctaggcactggctgtgtggccttgggcaaagctcccaccctctctgggctgcagggtctccacagtaaagcagggaggtggacgaagcctggtagcttctgggatcccacaagtgacaaaaagttgtcacagtgggagggacagttcaagttgggcttggtgcagtgagaaaccctggctggaaggggaggggctgctgtggagtttccccctgctcccagggccctgcaggtcccctccctatcccccaggactgatccagccccaactcgcggtaggcctccaacccaggccagttcgagagcgacagcgatgtgttgtggcagcgggcacaggtgcccgacaccgtcttccaccacggccgcgtgggcatcaacacagaccggccggatgaggcgctggttgtgca

SEQ ID NO: 65565 - DNA, 1056 bp, Homo sapiens
tgggctccggggcctgctccgggacggccgcaggaggggttcattcccgggcctggctccccgcaggtggacaccaccgagcaattgaagaggatctcgcgcatgcggctggtgcactacagatacaagcccgagttcgccgccagcgcgggcatcgaggccaccgcgccagagacaggtagggaccgggctggtgcggactggggtccggaaacccagaaacctcgggcctcagtgaccttgccccctgtcacctggaaatcctactcctcttgactcccggaactgcgcccctgggaatcatgccttctagaagtcccgcccctcggaccttggaaaatcgcacctctccaggtccccggaacctcgccccattgtcagtggaaatctgagaatcacggcccagggaccctcgcccttcgcgctagatgaatcctacctttaacctgccagaatactacccacttgccctgggatccttacccccaggaatccgccccaccccagcccaggaacctcacacctgagccctggaattgcaatcctgtgaacactggttcgtgggatctccctgctccagggctccttggaatccaaatctctgggttccagaacttcaccctctccagtcttgctcccactgtacattacaaagctgtgagtagccctttaccacccccccacccatctttggcttgtcccctgcccccaggtgtcatcgctcaggaggtgaaggagatcttgcctgaggctgtgaaagacaccggagacatggtctttgccaatgggaaaaccatagagaacttcctggtggtgaacaaggtctgtgggtgggggaatgggagggagcccagaggcaagtggggagccagctggggaacactcatcacctccatagatactgggggcactgcaaagcagaggcaggagcaccctcggctctcatgctgcctccagagcgccctctgcaccccacagggaaggggtgagtgttcaaggagatgagtgggtagggatttggcccctggagcctgtgtgatcaagggcaagagaaac

SEQ ID NO: 65566 - DNA, 1113 bp, Homo sapiens
gctccagctctaacggtcacccttttctgtggctccagcgtggtgtccatgtccacactgtacgtgctgagcctgcgcacagaggaggacctggtagacactgatgggtaggttcctggaggccaagccaagctgccaggccaggtggggctttggtgggcagtcccaggtcagagagccatgagactgtcttctctaaaggagttcatccttagcctcttagcctgctggggtgctgtggggatccagggagggcctccttggagggtgggcagcctttcccagtccctgctgacgctgatgtttctgtctggcctgtttagtgcccctccaggtagctgggcctgcgagtcagggctgtctgaggggctggggttggaacatggggtaggaggaaggagggccagggcagggccttgggctctgtgagcccactgtcacccccagctcctggggccacctctgactgtgtcttctcttctcttcccctttgcctgtctcaccctttgcctttttgctgccccttagctcttttgccgtgtccacttcctgtctcctggccctgctccggccccagccccctggggggagtgaggccttgtgcccatggtacgtgctgaccagcgcccctctcctctggctcctgctgcccctcttcctgcctccctcccctccctctctgcctcttcctgccctcctgcctctccaggactgtcaggccctctcccctcaagctctcccagcccctctgagctcagcccatccttccccagcaggtccagccagagctttgggaccacgcagctccgacagtcccccttgaccacggggctaccaggcatacagccctctttgctgctgggtgcgtgtctgggcaggtctgggtaggacagggaggttgctatgttctgtctttggggcttctctggctcatacagcctctggcctcctcagtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctca

SEQ ID NO: 65567 - DNA, 1109 bp, Homo sapiens
gtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcagggtaccctcaggctaaggtgccagttttgcccctgcaggcctgggaacttcacctaccacatccctgtcagtagtgg

SEQ ID NO: 65568 - DNA, 1023 bp, Homo sapiens
ttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccg

SEQ ID NO: 65569 - DNA, 1033 bp, Homo sapiens
caagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcagtcctgtctggggcccattctgcaggggtggtgggtgctgggacctacattgcttccccaatctcttccctttcccatttctcatctgcctttcacagttcctgctgctgatctacttaagggggatgagatttgtgtagcaccggtgttttgtcattggaatttaaggcttacctgtggatagggtctgggcctacccttttctattgtttctaggacaaacttctctgggaacccacatcggtccattctgccctaggccagtccctgccataaacatagccaccattctctgtgctggggcatcctcaccaggctcagcttctccccctaagaaggcttttctcctcagtggctacttttaatgcaggtg

SEQ ID NO: 65570 - DNA, 1112 bp, Homo sapiens
ctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaaggaggagaggagggctagtgatgcccaggggcaggttatagccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccctctgcctggctgctctgagccagataggcctcccagaaggcattgagccaatgcttttctcctcag

SEQ ID NO: 65571 - DNA, 1028 bp, Homo sapiens
ccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaaccagtccctccagggagaacagagtctctcagcgaccctggcgtacccttctccaccgcttgtccccactccacccacaccaggtccccgcaggcccctgctccctctacacccgaaatcgcaggactacaagtccctcaatgccacttgcgccggaggcacttccttttccggttgtgctaggcgcctgctcctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatcttt

SEQ ID NO: 65572 - DNA, 1049 bp, Homo sapiens
cggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaat

SEQ ID NO: 65573 - DNA, 1010 bp, Homo sapiens
gaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattc

SEQ ID NO: 65574 - DNA, 4607 bp, Homo sapiens
atggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtcccccaaacagcattttctcattagcctgaggctcttgttctgcaaccatgtgaagggagtgaccaagacagtctcatgtcccttcctcagccagctttacctggagaatgctgggctggcctttccatctgatattcaacatgctctcccctgaccttttccgccagctccaggccacatgcaatgtccacaagtctgccttcaatgactggttcagtggacacctcaacttccagattgagcaccagtgagtagggagcctggggaagcagggtcctggggagggtgtaagtgttgggtacaggtgggagcagagaagcaggaaccactgactcccccgttctccctaaagtctttttcccacgatgcctcgacacaattaccacaaagtggctcccctggtgcagtccttgtgtgccaagcatggcatagagtaccagtccaagcccctgctgtcagccttcgccgacatcatccagtgagtatctgagaccaggaagatggctagtagggagggaagagggcagggcaatggaaatgatgacatgtagggtggggagtgaacagaaggtgttcccagtcgtgtgggatggagttcaccatggcaaaggcaggattctttattggacctgtggccaggtcaggcctttgccctcattggggttcccctcagtaccatggcccaagctagctttctctaaagtagaggggaggaaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaagacttcatttgtaacccatgatgttcatctgtgtgtgcacaggattcctgagtgcctctgctacgagttactgttcacctctctgtgctcttaagttcttgaatcactagactcccctttgtattgggcagaggaagaaacatcaggaccctccagaaaacaccaaggcaagggtgaagtatggcaaggaagagcaaggcaaagtccttctgatgactcccgtgttcaaatgtgagattgtcaataatctcaccaagtttcacacgtatcacttcctcctattcatgaggcaat

SEQ ID NO: 65575 - DNA, 1029 bp, Homo sapiens
cacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggtgagcgcagccaggcgggggcacaggagagggcgggaccggaggctgagtgcaggggagacagagttacgcactccgagccaaacaccgactaattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggac

SEQ ID NO: 65576 - DNA, 1062 bp, Homo sapiens
cttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaacgcgggaggatgtggaacccgaggcggggggagccggaggggcgggcagaggaggtgtcgaggccctgagctcccggggagtttttactggaggcaaaagtccatagcgggagggctgagggaggggcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggtaagggtctgggggcgccccagccacccttctctgctgcaggcggagtcaggatccctggctccccgtgggccaaacagacctccggcgctgaatggagcttgggacgtcctgtagggaagg

SEQ ID NO: 65577 - DNA, 1405 bp, Homo sapiens
actccgcgcttgtcccgcactctccatccagactgggtggcgagaaggaaagctcgtccccggccggagatcgctcctgctgggactcttgtctaagaagttcctcaatggccacctgggaaaaaccgcccagcagctcgggttcccacgctccagggattatctagactcaccccaagctcgagccggccttcttggggaccggcgtccgggattggtggaaggagaacggcctggggtttgcaaagcccaggtcgagtgaggccttgagccggtggatttagcagcactagactggcttggcaacaggtccgtctgcactcgaggttactctcgggcgttcaactcaatggctctctctttttaaatcctgccaagaacacccttccctcatcttgcactcctaaaggttgtgggcctctctggagccattgctgcccaccttacccccaccaaatgcgtggctcagtgattaccccgcaccagctacccgcaccggggaccccagtctgaaatcctggcatttatttaaggatgcagctggtatcccatggattcgaatgggccagaaggaaaagaacagaggcaaggagggaagaaagggcggcttttggtggtggtagtgaattggatgcagagaaaaaaggtctgatgggatacagaaattggggaaagtgaataggagagaggcagaaaggagggatgaacttgacgtagatcattccacctggaggtctaggatgcccaactgttggtgggcttttgctctctaagctgtgtaggcccgacccttaacttccccacctcttgcatctcatggagacaggcctaggggaaggccagaccaggccaccataacccaagctggacaatggacaggtggtgtgggccagcagggccagggcttatctaagattgggaaggtcagcgatactgaaattccctacagctttcagtcccatcctgttttacttgcttgtggacattgcttaagcccagtgggtttgtgatgctatttagaacttaggtgggtatgtttcacataccttcagtgctatctcacctggacctttacgcggcccagtgaggaggttgggttaatgtaactcctaagtaaaggaccttctggatcctggctgggatctttccactatatgttgctggacttgggctggtctgtttctgatttcataggtaaattgtagaaggttcctgtcctgtccaggccctcaccaaaaagtttccagaaggaaaagtcaaatacgatgaatttggtctgattattccacattgttaaacatattttcttatgtgaacgcttagtctggcaattgccttgacctttctggtttaattaccatatcagattgatttatttcttccttgttctggatgttctcagtgc

SEQ ID NO: 65578 - DNA, 1970 bp, Homo sapiens
tctgagctgacagccccacaggcccagtggcagtggtaagccctggttagggccaaggggacatacatgccaccttaatgatggcctcctcagcccttgcactccctggggccactcccgtcctggtccctgaccctggtccatccccaactttgcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctcacttcctgtgtttcctgcacgccaatgccaggccatggtattgggtgatagatgaggcccttctagctgggcctgggcaccaggaggggtccccat

SEQ ID NO: 65579 - DNA, 1041 bp, Homo sapiens
gaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggtacaggctgggtggccacgcgccctcactcctgcaccctggggctctggccaaggct

SEQ ID NO: 65580 - DNA, 1098 bp, Homo sapiens
ggcgaagcatccccattaggaagcaggttaggaatgtgcttcatccctagtgagaatgaaagtattaacagcataagtatggaaggtcccttcatttcaaataccaaaatgttgcagtaggagggcaaaggttgagacgatccttttttttttttttttgagacagtctcactccgtcgcccaggctggattgcagttgctcaatctcactgcaaccaccacctcctgggttcaagcaattctcccctcaacctcctgcgttgggactacaggcacaccacgacgcccagctgatttgtattttttttggtagagatggggtttcatcatgttggccaggttggtctcaaactcctgacctcctgtgatccacttgcctccacacccagcccaagacaagattcttaaatattaacatcctttgctgaacaggccacagatgtttgccaagttcctgtctagccctagaagcaagactgaaattgttgcccttttaagttttcaatcataatagctgcgtgttctgaccgtgaaagtaactgcttgagaatccagaaaagggaagttacacttcctcccacgtgattggggctgaagtggggtgtttataattgggtgaaagtgtccaggaaatctggaataaagggaaatatctgattttgtgacagctttgggctgaccccaaggaagcaagaagtattttggtgaggttcccaggcagtgagaaaatgacctaagggcgctggacaccctcaacctcaccatctaccagttcctaggagtgaggcagttcctgccaccctttcctgtagtgcttgggtactaccctaaatagttatgggggaagtgttcatctgtcatccagctgactgccacctcatggttttgggtcagccacccttgctcaaagtaagttggggccagtgataacatctgctcagctaagcctggcctgtcagccctggggcagttctccagcagcattctggtcagcacaacctcatcttccttcacctggtcccaagaagtcttccgggtgataccagggtgaagtgagaaaaggtcccgaacacttccctaggatccctgtgaaggtgg

SEQ ID NO: 65581 - DNA, 1025 bp, Homo sapiens
gtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaagggaccttccatacttatgctgttaatactttcattctcactagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtttctttttgattagtgtgattagaactgaacaacggcacttaaggaatctggaagatagcctggatagatttctgattcatcccaagacctcaaagacaacacctgggtaccaaatttctttatttgaaggaatggtacaaatcaaagaacttaagtggatgttttggtacaacttatagaaaaggtaaaggaaaccccaacatgcatgcactgccttggtgaccagggaagtcaccccacggctatggggaaattagcccgaggcttagctttcattatcactgtctcccagggtgtgcttgtcaaagagatattccgccaagccagattcgggcgctcccatcttgcgcaagttggtcacgtggtcacccaattctttgatggctttcacctgctcattcaggtaatgtgtctcaatgaagtcacacaact

SEQ ID NO: 65582 - DNA, 1951 bp, Homo sapiens
gtttttaatttgtgtgtgtgtgtgagagacagagtctcgctctgtcgcccaggctggagtgcagtggcgcgatctcggctcactgcagcctccgcctcctgggttcaagtgattctcttacctcaggctcctgagtagctggaattacaggcgcacgccaccacgcccagctatttttttttatttttagtagagacggggtttcaccatgttgaccaggatggtctcgatctgctgacctcgtgatccgcctgcctcggcctcccaaagtgctgggattacaggctgagccaccgcacccagcaggggtttttaattttataaataaatatgtggtacagctggcagactcctgagctcagttttaaccatgctttaacatggttaatacaggagcagggaggagaaaaggactaagtgcagggtcagtactccagcgccctctcatcagacaatgaattctgacactggctgtaagttttctgtgcagtaatacagatccttaagacattgccccaggcaatgcccataatatcctaaaggttccttgaagttaagtttcaaggatcaagtttcagttttctattttagaatagaaacattactcttgggttcaatccagtagctcatctgccccccagtctccttaggcactgattccttcatgctgtgctttgagaaaggaagcctaggctgacgagaccatcttgcctccctgtagatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggtgaacaaaagatcctaggggtgtcatacttcatcatctggcagtgttcgggtatcagaaatcacttaaactagcaattgcccttataaagtgatgatacactgggcttttgccttttgtgcttttttaggcttaccatctaaactaaattaggcaaatagtaatgtcccttttgccaaaacgtggtggttagagatgatgggcttgctgacttctaggttagttggtagagatgcattaacctattctcattcagaaaccagactgtgatgactgggagagcgggctgaatgcaatggagtgtgcattacatttggaaaaaaatgtgaatcagtcactactggaactgcacaaactggccactgacaaaaatgacccccatgtgagtattggaaccccaggaaataaatggaggaaatcatttgccttagggattgggaaagctgcccactaactgtcttccccattgttttgcagttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaa

SEQ ID NO: 65583 - DNA, 1246 bp, Homo sapiens
agctatgatttctaacaccatgccccgggccaggagcctcagggtgcccgttcgggaaaatgggagccgaatcaggatcaccccatgcgcccccgcacccttcccccgccggttccaacgcccgggcgcccctagaccggggggggggttctgaggtggacttcctgcgcctcctcgcagcttccctccaactccactaaacgggcacagagacgccaccgctgtcccagaggcagtcggctaccggtccccgctcccgagctccgccagagcgcgcgagggcctccagcggccgcccctcccccacagcaggggcggggtcccgcgcccaccggaaggagcgggctcggggcgggcggcgctgattggccggggcgggcctgacgccgacgcggctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatggtgagcgcgggcgggcctaagcggtggcgggggccgggcgcggttcccggggcgcgcgctggggcgggccgggggtgtggccacccgcgggctctcccgcctccctgcgcccttctggaaaatggaggctgctcgaggtttccgaggacttctctggcgcagaaagtcggggcagctggttcttctcggctgtaccctgagaatgctccctcctaggccagggccgcctctgcacacccttcttttttaaggagaccttggtgtcctgaaatcctggggttgcaagactgccagcctgtgtgatcaatcctgcggttaggaaggtggagttttgctttcccatcttttcctctgcctccggcatttggccctaaatgccagcgttttttgcttaggtatccagctcccgtccgcctgtgtgtggcggagctgctgggtaacggtgtcgaatagcaaaccttgggggctggcgggaggtggcttatcttgtgggtagatcc

SEQ ID NO: 65584 - DNA, 1818 bp, Homo sapiens
gtatagcccgtggttaagggcacggttctatttatgcccctgatttaccggctgattttgacttctctttgcctcaatttcctcatctgcccatgcgtatcctcaaggttgtggtgagaattaaatgagatgatgtctgactcgggcatggagtatgactcagtaaatgggagcagctgctatgcgctttctgcacagaggtgtggtaggcgcccaacttacagcaccctgaaaaggacaggagtcatagaggaggacgatggggccttcagtctggtgtatggtgtggaagaagtgttggagaggaggaagactggagagtgtcttcctcggtgaggtgttgagtgctctttatctgtgtgcaggtgcttacatgggttgaagaagagatttttgctgctcttccaggagcctgattcttggtacactgattccttctttttcagggtcacctctgttttaacttacggtaaccctttttaaatcgttgcgctaaggtctgctagaagcaaacctccccgtgaaagaagtccaattgctttcatggactttgtgaaagaagctctcatccacgttgcccatttgaacaaatactttttaaaaagttagccagttgttgcttttctctgcaaacctttggcttccttaaacagttttctcttttctggcctgaggtcctgcgctttgccagggctgtggtctgggtgcagaagggttaggggaaggtgagggatgacagtgaaaagggcttgcccatgattggctggctgcagagccgaggtttcagcccaaagcctgtacgatcctgcccatttggccctgccctgattattgctgcccttggcatctgggaacaggggttttgaacatgtgttggtcagttctaacctgtgcagattaagtttatttggtgccctttgtgtggtgggatgagcacctataggatgtttatttctaggtgtagagttgatgggtggattaattcatttaacaaatagtccttgttgccaggcactgctgtgctctgggcattcaacgatgagcaagacagacaggggtttgccctcagagagcaattgtttagtgggcagggacaggcagtaagcaacaggtaaacaagcacgcaagtgctctgcagagaattacaatcaatgaatgggatcatggctggggctactttagattggttttcaggttttcctgaggatctgagatccaagccatgaggagtgagccatacaaaatgtgagacaatgttccagacgcagggcagagcttgttgaggaacaaagactactgtgtccttgaatcaagcctgaggaagtcccatgagactgaaacctgacctggtgctacgccctgtgagggatcaaggggtcagcaatttatcccttccttacaagaccttccattgtaggtgggaggctgagttgtgcatggtttttttttttttgagatagagtctccctctgttgcctgggctggagtgcagtggtgtgatcttggctcattgcagcctctgcctcctaggttcaagcgattctcctgcgtcagcctcctgagtagctgggattataggcgtgcaccaccacacacagctaatttttttgtatctttagtagagactgggtttcaccacgttggccaggctggtcttgaactcctgacctcgtgatctgcccacttcggccttctaaagtgctgggattacaggcgtgagccaccgtgcccggccagttcttggttttaaagaggtaagtcaggatggtggatcactgccattgacttgaggcatgcagtttgttgttatggcttatg

SEQ ID NO: 65585 - DNA, 1407 bp, Homo sapiens
gaaagtgagaaaaaactgtttttgtgttttctcttgctcaatgcttgtaggcaagttttcttaaaagcaagatattgcttactgttcccttcttgttctatttatgctccatttggagggcatttcagctcaagggagagggttgtgggaggccccttgagggcatatctctggatcactactttctcactcattcctttggaacacagaatctcttctgctcactggcctcttaaagaggcagttgggtttgatgttctttggcctgatgtctggagtcagcttgtatgtagtgcagggtggctgtgtcttagccctcacttaaccatgagtagtaagatgagggcctactggagagcgagagcaggactgtgtttgggcagggagtgaggggccctggggtggccaggaagacagatggcagtgccctgtcatcttaagcccagaaaaggccatttataaggaggactgtcaatgtcagaattggttgggaactgtggacttatggggacagtcatgctggcgggggggtggggacagggaggtatttgaagagtgtgagtagaagggcttctctttgtagagatgaggctaggggatgagtgtttggaattctgcagctctggggagtggctgtgagcagagaggggccctggttcgggcactgggtgtttgtggtggttgtgggtcaggtgggtattgcagcttggagaaagccccagacccctaccctgggcccctaacttgtgcctcttgtccctgccttcaccagacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccaggtgaagacgggcacagtgagaggctgggaacaccagggcctgtctgggctgctttggtcttggggacacaacagcccctcgtccccgcctacctggcaaaacagacagcctgtcagggctccctgctgtatactgtgtgtgcagtgtgctgggggcctgacctagtgtcatgggaagaggcagcaggagagatccagtcccttgcctattcgccatcgttgctggctgggcctctcagggtatgtggcaatggacgtgcgcctgggagcttgcttccctgccgtgtctccaggaggaagccctgagtgcccgcaggtgacttgcacatggccttggagagctcacttggtgctggacaccccagcttgacctgtcgctgccaggaaatgggcaggggccaggctgggtgggagaggggaccagtggttcccaggcagcctcgagtgacaccctccttgtgccaaacagagaattcagcaaagag

SEQ ID NO: 65586 - DNA, 1269 bp, Homo sapiens
cctagccagttctgtgcggactgtggcatgatccccaatttacagttaggaagactgcggctcagacaagaatggcctggggcctcatggctagaggtggcagaatctggcctggaacccagatcttttgccttcaccttctcttatcatactctatccaagctggtggctcttggagagactgggtgccaccctgtcctgctgcccgtctcagcctctgccctgctgcccctgccaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaaggagctgtccagagagctttctgcagtgaggtagatgttacacatctgtgctgtcctgggatggtggccgctagctggcctcatctggcgattgtgtcctcaaaatgtggctagtgtgattgaggaactgaattttaaattg

SEQ ID NO: 65587 - DNA, 1006 bp, Homo sapiens
ggcactttaagatttataaaatgaaaggttatttcatttggtccttacagcagcattgttagcttgtgaggaatttttcactttacagaggaggaaactgaggcttaaggaggccatggagtctgtaaatcgggaagctggggcttgagcgctgtgtgtttcattctgtccagaaagtcaggtgcttgcagaagaggctttgtgcaaggccgcagggcagggcctgtcaggcaggggagggcacctcaccttggcagctttctctctgcctgagtcacactgcctggggacgggcctgctccagggtttggggtgacatactctggggcgtgtgcagatgtgcagtctgccacactgtctatttctggattctcagaaggatctaaatggttctgatctgttttggagattttctcaggcctggatctgatcttgggaaggggcttcaagcgggggcaggtgagcctgggcctgtagagggagggccaggcagggttgcagagaatctctggagacctttggagcagacatccagatctgcagctctcatgcccttccatcactcttccctctctgtctaccctttccctgcccatgaatgggcttctgatttgactggtgcatgttacctgggtctgtctgactcccagcccagcatcatctctcctcttgagggggtggaggagagagaggaggatacaggatctaggatctggagtcacacagaccctgggtgaccttgggcacaccccttctctcaacctcagcttttctgtgaaatggtgataacacttgctttgaatgtgaatagataactcatcttagtgcttgagtgtagtggatactcagtacatcttatttgagaaaactcaccaatggctgatgctcagtttgggtgcgacaaggccgacccctagtgaggagctgcaagggtgtcagggagtggggcggtgacaggggaggaggcttcctgggggtcttcctgataccaggctctgggagaggc

SEQ ID NO: 65588 - DNA, 1028 bp, Homo sapiens
tcagcacacagaagagtagaatggcatgtacttgagtttagatttagtaaaattaggacttttgcaggcgcagtggctcacgcctgtaatcccagcactttgggaggctgaggcaggtggttcacttgaggacgagttcaagaccagcctggccaacatagcgaaaccctatctctactaaaaatataaaaaattagctgggtgtgatggtacatgcctgtaattccagctacttgggaggctgaggcaccagaatcccttgaacccatgaggtggaggttgcagtgagctgagattgcgccactgcattcagcctgagtgacagagtgagagtctgtctcaaaaaaagaaaaaaaattagtactttttacaccttcatcaaggacattcctcagtgaaactggacatctctccttcccgtgagtgtgtggtccgaggatagtgtttgatgctctggccttgactggggctgaggcttcagcagctagttcctcattgcttttgtgccatcagggcaaatgtcaacatagtgaaagggaaagtaacattttagtatcataattttagtatcatgattagttacgacctcgtggatcccccatgggtctcaaggacgtccaagggtcagaggatgcaagctgagaaccactggcctggacatcctcctcctttgtaaactcctccaggccagctcaggtccccccatcataggcttttaaaattctctgctctggaccaggcgcagtggctcacgcctgtaatcccagcactttgggaggccgaggcgggtggatcacttgaggtcaggagttcgagaccagactggccaacatggtgaaaccctgtctctattaaaaatacaaaaattagccggaagtcgcttgaacccaggaggcagtggttgcagtgagctgagattgttccactacacaccagcctgggcaacagagcaagactccgtctcaaaaaaaagaaaaaaaatttctctgctctgttccaccattgcccatgctggtgttgttgatagg

SEQ ID NO: 65589 - DNA, 1034 bp, Homo sapiens
ccccccgaggaggctgagcctgtggcggcagctgagccagaggtaagacggctgcctggggaagggaggactcacctctggggctcccgctctgcactacggccatcctgggccttgggttccaggtcaagacccctaaagccttggttctttccacaggtccctgagaacaatggaaataactcgtggccccacaatgacacggagattgccaacagcacacccaacccgaagcctgcagccagcagcccggaaacaccctctgcagggcagcaaggtgaggcttcctgacctgccgtgtgcagtgcccggagccacagcgggccttggcggcctcggcctgaccttctctctggggataaggaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgctttgcctcccccgccagctcctttctgacctttgtatgtccatccttgtctaaagagggctggagagcagtgggtttgggagtgtcccagggtcctgctcacatctccctgagaagggtgcctctctctggtggaaagtgcactgtagctgtgagatcttgaacacggcctcctcctctttacgacgtggtcagggacaatggtcatgccagccctgcagccccaagggctgctgtgaggaacttttggagtaaggtgcaccttctcctagcagtgaaacaaaacaatactgaccctacaccctccatgttgaccctgcagcgggagctgccccctcctgctgtcagggccacaccagctgcatggcccaggaggggtggaatttagaagctgtgca

SEQ ID NO: 65590 - DNA, 2990 bp, Homo sapiens
ctggtgctgaactcctgacctcaaggatccgcccaccttggcctcccaaagtgcttgtagattcctcaaggctagtcagggttaaggctgatatgtctgcgtttggccaccccggagctgccaggaagggagccttgcccactgccaaggctgctgcccaaggaccccttccccctacacccccattcccaccctgccgccgccatcgtttctgcagccttgctgaaattgctgtcttcacagaggccaagacggaccaagcagatggacccagagagccaccgcagagtgccaggtttgcatccgggaaggggtgtgtaggtaactctgagggccctggaggatgtggccttgtgtccttgctcagggaaggtggatgtgtgctcaggggcttcagagcctctctgctggggtgtggcctggtgttgtgacttaaccaaggaggcagctccatgctgtggatgagcgcaaacctgggaatagggcgacccgattgttgaccccgtcttagtgtggtctcctggccatgtgaccttggactgttcacctcccttcctctgagtgggcagcagagggttgcttaggctctgcagcctctttcagtctagaggcctgtggcctgggcccggtattgttcaccggggtgacttttgatggggtgtggctgggctgtggcgggctgccctgtgatgccgccgcccgcgccttggcaggaggaagcgcagctacaagcaggccgtgagtgagctggacgaggagcagcacctggaggatgaggagctgcagccccccaggagcaagaccccttcctcaccctgcccagccagcaaggtgagccaggcacctgccctctcctggagccctgacccccttcagtaccctgccccgcctgcccacttctgaccctggtcctcgtctgcaggtggtacggcccctccggacctttctgcacacagtgcagaggaaccagatgctcatgaccccgacctcagccccacgcagcgtcatgaagtcctttattaagcgcaacactcccctgcgcatggaccccaaggtgaggggcctgtgcccaggccgggctttgtgggagctgggcagtgtggctgaaggtccagtctgtcctgtaagatactgggagtagtgtgagcctgggcggaggcaagtgtggcctggcactgttaggggccggttgaagcctctgtggccaccggctgtcttgacctctgagggcactgtcctgcacttgaccttgtgggctctggactacagcctggaggcttggccggctcaatgtgagccctggggatctgtgtagttaaggtgagaggtacttgtggacacctccaccactggggtgagggttgggtgacaggagaggcggtgggggtgctgctggcaggagggcaggccccacgcaggcttgctggcacagctgggcatgtggcctgcccggcaggatgctccccggcctggcattaactcttgccttttcccttgtctcctccacagtgcagcttcgtcgtaagtaaagccttttcctgtcggtaacctcgccccacctagcactcacccgctgtagccccttccctgcgtagctgacagcacctgtagatgcactaacattgtaagcgggaggggagccttaggaagagagtgggacggtgaggggtgcactggctggaggcgcccagcagttctgggccccagcgtccttctctgccctccctgcccttgactctgctcttaggaggaagcaagggggtgtggcttttcaccagggctacagcttgatgtgttctccacagccaccttccctccctcctcccctgcaccaggccccgtcagggtctgtgggtctttgaagagaacagacaggttgtctgtggtccccagagctactgagatttattggttcacagacctgagcagtagccttgaggcagtggggtgatgggggagcgcaagtgtgggtctgaactgaggtggaagtgctgggtcttgctgtgctgggtgacagtagaacagtgggtggtagcgtctagaaacaagtcgcagaagctgttctcttctcagacacctcagagctgagccgagccaggcaggccctgagcaaggaccctcagatggggacatgcttagcctgcagccccagctccctgtgccatttgccaaggccacagacacctcattcctttagttcctgcaagccttctgaagggtcctctgcagccacacagggacacctgtgacagccgggagggcttctgcctccagttgagggcctcggcaggtgagaggggcttcccagcagctggccaggtgggccctgagctggcttctccgcatggaggcctgttcccctcttgttggagagggtgactgacagtataccttccagtggccttaccacctgtgccgattagagccctgcaggtctcacagggtgatagagaagaccaggaagtggtcccctttcctgctttggggatcccaggtccctgcacaaagcatctagtgggtggggacagtccatagttaggagaccagggggctacggagtcattttggactgcatcctgaacattctgctatgagtctctgggtcttgtttaaatctatggacaatgttgatattttctcagcattgcaatttagtagcaattgacctggttaggtttaggctgcaggttcccatctgccttctgtggactctggttccaatgttagtcccgattttgaagatggcagtgctgtttggacttttcccgggtgtgtgccagtcagcagtcagcctgggacttggcaggtggtctgttagtttagttctcagccttcggtgtggtaattaggatcagatcctagcatctgcagcttagagctgagcctgggcgttcgtcaataacctgcagcatcattttcccgatctcctctggggctcccttttctgtcctccagccaggaagctggggcttcagttaccttgttctgct

SEQ ID NO: 65591 - DNA, 1656 bp, Homo sapiens
gcatctgcaccacccccttactagaacattcaccatgattgggagagctgcctttctgctcctcacccttccaagctcatccttcattttctttttcaatgcacagtttatgtagttgtcattagcacataaatcctatttggagcctgacttttgtgttgcccaaaacttggcagggctcaatggagggcactgtggctcaggcccttgcgaggtagctgagtgctcctgggaggaaaggcgggagctgcgggccttggcttgggtgctgttggggccacgttggggatacctctgcctaagaagcattctgatgctgccacccacgtggctgcaggctgctggggactgtgggcagcttttggggctgggtggggggtcgtccttgctcatgtcccatctccctcgctccccgccaccccaggagaaggagcggcagcgcctggagaatctgcggcggaaggaggaggccgagcagctgcgcaggcagaaggtggaggaggacaagcggcggcggctggaggaggtgaagctgtaagtggcctggcttcctggactgtggcccatcccagccttggtggggctccccatgactatcctatgccccgcaggaagcgtgaggaacgcctccgcaaggtgctgcaggcccgcgagcgggtggagcagatgaaggaggagaagaagaagcagattgagcagaagtttgctcagatcgacgagaagactgagaaggtgggagcctgggctgtggaggcccaggcaattcaggacttgggccaagggttaggactggacccctcaggaaattgcagatttgtcactgtacccctgtacccatctcctgtctgccccatgggccctggagtccactcagctctgggtttccctggcagccctttgtgagtggggtctgacactcaggcaggaccggcttctggtgtcctctccctgggtggtgggaacaagccaggtgtgcaggggcaggtggggcctgtcacacacagttctgggctccactctgcaggattgaatgtgggtgctccaatgggcatgtgtgggtgggctctgcaggccaaggaggagcggctggcagaggagaaggccaagaaaaaggcggcggccaagaagatggaggaggtggaagcacgcaggaagcaggaagaggaggcacgtaggctcaggtggctgcagcaggtgcgagcacaggtgggcctcagggaggaggtgggcggggtgggcgctgtctcagcaccatggggccctactgggtgcaccccaccttgtggggttgacccagaccatcttgttgcttcatgctaagaaggaggtttcccagaagtctccagggcggggatggtgaccagaatctgcctctcctgtagcagcagtaatttgagggttaagtgcttgtacttggagccagactgcctatctcagctctgccatttattagctgtgtgactttctacaggctgcttgacctctctgcttccatgtcttcaagtagcagtgagggttaaatgtgttaatgtctgtaaaatgctcagtagtgtctgatgcctgctaagagttctatacaattgctgttatggtccaccccctgactgttctgcctataagagtaagggcccacctcttcccagccagtcttaggac

SEQ ID NO: 65592 - DNA, 1126 bp, Homo sapiens
gctaggccctgctgtgtgttgtgcgtatcaacccagcaaccccatgaagtgtaggaataactgcagtctccattttatagacgaggaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcgggggagtagggctgctgtcctgcctctctggcctgggcctggccgcagcacctgaccttgctctctgtttcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacactgcccattggctatgggagatccaaggagtgataggtgggcttgcttagggcttggcttggttctgcctccagctgcatgtgctgacctcttaggtgtctttttgtaactgtcaggagtgtggtgctcagaggatgagctgatatttctcagcagggccaccatgggcattttgggcaggaaagatctttgtgttacattgcaggatgtttggcatccttggcccctgtccccactaaatgcatctcccctggtgaggacgataactcagattaccccctaccgatattttcagactgttcccctgccttgggaaccgtggacccaggagccctgggattttccagctgtgcagatgc

SEQ ID NO: 65593 - DNA, 1337 bp, Homo sapiens
gtgaagagtcacagccagggggctgcactgagtcagggctgcttgatggggacaaagctgtccttggtcctctgggcagagtctgggaaggcgagaaggcgtagggtgtagctaatgtgcagggtgctgggcagagcagggggctttgagggtggcggtgtgatagtcatagtgtcggcagctttggtgggtacccgagctgcatgctttacacctgtttccttgtttagtcctcagttgaagcccatggtggcatgggagccatcagctccacttcacacagggggaaacaggtccagagaggttaaatgacatgttcaaagtcatgagccagtgtgttgtggaggtgactccagaactcatccacagcctcttgttcatgcttggagccagtgtctgccctgaaggttaggataaaaaggggtattgtggattatcccatttgattctcatgttgaccctggaggaaatgtgttatggtctccattgtataaaagtgttatgaggctcagagacccaagttacaaggaaaagtgggggccaaatgttgggctccagcttgtgttccctgcaccctcaggtgtgcacacttctagccccggggcaaaagcgcagctcttggctctaagctggttgcccattcagcaatcccactttctaaggtgtgtcctactggctgggcctggtttccccagcagggatgggaacagggcttgggctgggcctccacttcctgtcctaacaggctcttgctgggtcctcagggagctgcaggagcgggagaaggccctgcggctgcagaaggagcagctgcagagggaactggaggagaagaagaagaaggtgaggggagctgggttgcgggctcccctggggtctgccctgagctgtgggcgggtctggactcctgcagcaggggctgcctagggaggggagggaaagggaggagaatggagcggagggaaggggaggggagggaagggcacctgcacagctccctaacaccccattgccacctgggttccaggaagagcagcagcgtctggctgagcggcagctgcaggaggagcaagagaagaaagccaaggaggcagcaggggccagcaaggccctgaatgtgactgtggacgtgcaggtgccacctgggccccagtggagaggctctcaggtggaggggcccactctattctcttcccagtagctagaggcacaggctgtgttaggcccctaaggaaaaggacagatacacttggcccaattgtttttacttctttttatattctttgttattctaaaagtagaatttgttgaggtgggggataaaaaggaactaaact

SEQ ID NO: 65594 - DNA, 2077 bp, Homo sapiens
ctgaagagacttggacctaagtaagccacctggggcagaggcagagctagaatggggaagggtttaggcagaacaccaagctggagcctggggcttccagccagctcggggaggcaggaaagtccttgaggagtgcatgaggcacttgagcaggatctgacctggagtttacaggccccagcattaaaccagaatgtgggtgagcgtgactgcaatgtctcaggcctgagtgcaaggccagcttgagtgagcagggtaggtgctagaagtgggtgctgccagagtggatggggcccgtgggtaccatgggtgccttgcagtggttgctgagccggaagtcagggaggggtgcagacgccccagagggaagggcctggaatcccatagctggtaggcacactacagaaacttgtttttgtgagtttcacctcatctgaaccctacagtaactggcatgtgctttaagcctcttaactactagtgtcaagtcatttgggagatggcagtgagcaggagccagctcgcttgcaaagccatctaatcggaggtgactttgaacagcttacttaaatagtttcctcatccgtgaaaggggggtgaagacaagacccagctgaggagttctgttgagagtgacatgagtgagctcacggctggcccttagagccgcacctggtgctgagcaagtgctggtgcatgtctggcctcctgatcccctgggtcttcctcagccccgttgtcaggactgtgccttcccacatccactgcccagaggccccctcagcactgcaccagggcctgtggggtctgtgagaagcagctggccaaggtggtcaaggatggcatcctatgcttaagctctggaactgggcttgtcttcaaacacaggctctgccattattagctgtatgcctttgggcaaatctgctgaatgggagaatacagaacctgcctcccaggtggtggtcgggacaggttcaaggagtgcctggctcatgcgagctctcaaggactttgtaaggttaagctgccagaggaaggttggaaggatgtgacacaagggcgttctctgggtttgatggtggtacaggcaggggcagggctgaagagggtgacagagctctctgtagggaggttggagagggtgacagggctctgtggtgggcaagggatggggaggttcatggagagccccaaggcagtgtctggtctgtggtctcctgcaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgg

SEQ ID NO: 65595 - DNA, 1104 bp, Homo sapiens
ggcgtccgcgtcctgcggtgccctgggtaagtcggcggccctcccggagcagccgcccgagacgcgggagggcgaatgaaataaacgaaaatagacattttcccgaaggcgaaatagacatcctccttcggcgccggggcttggaggcgggcggcggtgggcgcgggttaacgtccccggggaaactgagacccccagcaggtccgggccgggggcggagaggaacgcgggagggcgccgggcccctgggcttttcgtaccaagctcgaccgagccgcccctacccacccccagctgcgaacccagccgttcagaacagagactgggcattgtccccacagggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggtaaatgtgcctttcagctagtaaataatgtgagtcaggtcaagctccttcttcagaataaatagaacctacatagtgttagggaatctaatgagctttggggtgaaactaagtatgtaaaaaagaaacaatatttaatttttctacctgtgctgaaaagagtcaaacgctaaaatatttgtagagatttatactgaggcaaatatgagtgaccaatggcctctgatacagctcttgggaaatcctgagaatgtgtgcttctggagagacataagatgtcaatcagtacatacaagacatacattggttccatctggagaggtgagactactgggggagggggagtggtttccaggtcatagttaagattcaaagattttctgatgaacaattgatttaaagttttgtccaaacacctggaatccacagaagggaatgtctggattatataaggacttgtggctgcagatagaattaatagaagg

SEQ ID NO: 65596 - DNA, 1050 bp, Homo sapiens
gcagcctgggcgacaaagtgagacttcatctcaaaaaaaaaaaaaaaaaaaaagcaggattttgggtcccagcctgtatctaccaagtcactttttcctttcctttctcctcttggtggcagcttcagagtctctgtgggcccaagcaccccaggaattcttatacacactaaagtttgagaagcactcttacttttatccccattttatgatggggacaaagagacacaaaataaaacttagcatcacagctagaaaacggtggtgttgggattggatgtactcttaaagctgaggtgtggaggagtgtccagcaatccacctgtaacttacacgtagaatgagaagcagcaggttctttctagaatgttggaattaaatgggtgccccatcaacatataacatgaaactttaagtggttttaaggtacattgttggttatggtgttcattctcattttcagcctgtcactttttttctgtttatttttggcagaaacttgggaaccgtgggtgctgttgccttggactgcaaagggaatgtagcctacgcaacctccacaggcggtatcgttaataaaatggtcggccgcgttggggactcaccgtgtctaggtaggaccaagggatgcctcctgccccttcccctcttctcccgccctcaggctttcctcactctctattccctgcccctctccgtttcttgctgcgttccctttctgcttttggtgcagctccaggatgtctgggagtgacaatggggttggaaggggttgttcggggtgctgccttgagagggtgtttgtatctggcgccactgtttttactagattgcatgcctttttggaacaacttggggagagaagtggagacagggatgctaacgttgcccccagtctaccctgtcgtgattctgtcttctctttagccacagtttcaggatctgcagacttacttgagtaagacttactcccgagacatgggctctgattagcaatctgagaaatctgagactgcagttgttagatctgagcagcatgaaagtgacata

SEQ ID NO: 65597 - DNA, 1011 bp, Homo sapiens
agagtcttgctctgtcacccaggctggagtgcagtggcacgatctcagctcactgcaacctccacctcccagattcaagcaattctcctgcctcagcctcccgagtagctgggattacaggcgcccgccaccatgcctgcctaatttttttgtacttttagtagagacagggtttcatcatgttggacaggctggtctcgaactcctgaacacaagtgatccacccacctcggccccccaaagtgctgggattacagcaccaccgcacccggcctttgtagctgtttcatgggaacaaggaagtggccccatcaaccttgtctggctaaaaaaaatgcaggtgtcctctcccttttgcataggtgtaggcgtgacccagagaggaatggggatgggcagaaggacagaggcagaaccaggcctaggaatgggggtgggagtatgggcctggaacacagtggaggttgggggaggtggtgggggtgcccattagtggctgcatccagaatgtaaatgccattaaacaaaaccagcctttccacctcaccccaccccacatccacacccccacaaagagctgagccacagccgtccatagcacatctcttctgagaagttaaaaatatgtaggaggaggcataggaattattctacccttttggaagatgagaaaataaggcctagaaaaattggagtttccccggtctcttgtccctctcaggttaaagtgaagtttaactcagccttccctattttcaaatcctccggctctcacccctaagctgctgctcctagatctagaggcagccccaagagggccccaggcgaaaagcaagaaagaccagcacacatggacagctctagctttcaaaattctgggatttttacaaaccactatttaaatgaagttggattttcagtgacagaggtaggggccagccatggactctgctgataggggaaaccagcctggggtgatttttttttttttaatcactgatcatctcaaga

SEQ ID NO: 65598 - DNA, 1035 bp, Homo sapiens
aacactgagattcaagaggtgggcagaggggctgtcaagcggacttgataaggagggacagagggaggaggcagtaaccgagggaggagggctatgtcagcttgggaggcttttcactgtgggtaacagcaaagttgtccaggtgattagatgaaagggttgatttttctcacagtctgggtgttcagcagcaaagctctgtgtcagtgtcaccgaggccctcttgcctttctcctagccttgggcattacatcctcacatgatgcgttcaaaggcaggagatagcaacagcgtggaacagacgttctcctcatgcctcttttattggtgggatgtggggtggtgatgatggagggatcgtccccagaagattcctgctaatctccccctagatcccactgggcagaaggacacatgcttgctttggaccaggggctgtgcctgtcttggtgaaatcaaaaaatctctttcctgtccttgaacaaacaggattcttccagccaaggggagggaaatgccttttgagtaaggagggaatagcgcttgccattagcacatttcataaggaagagtttttctgctgggttaattgatgcagggaggtcgagtgggatgggtgctgagaagtagcccctagatgtgacacttagtggactatgtgtggcccttgagagggctgtttccatagaacggctgggcttgattgcacattttggcaggggagggggtgcttaggaattactgggagaagtttaggagattaagggggactaccaggaagcctagtgttgaaggtaagaggagaggtggcaccatcactgggtgcaggaggcagacatagggagatcttttcagtttgggggagacttgatgtttataggctgagcaaaaggagctggtgagagagagggtaaagattttgaagcaagatgggataatggatccccacgtcctgaaggaggcatggaggtggcatcgagtgcccaggaggtggtggttgtcactggatcaagcaggaaggcttttctgagaaga

SEQ ID NO: 65599 - DNA, 1032 bp, Homo sapiens
attgtgtctaaaaatggaaaatcacatgttactgtttatcaaaaggaaataaacaccttggattaatcgggttcttgccactggatggtgagtccagaccttgccggcaacccaggtaaaaaggccactctgcatgttctgcaaacactcactttttttttctttttcttttttttttttgagatggagtcttgctttgttgtccaggctggagtgcaatgacacggtcttggctcactgcaacctctgcctcctgggttcaggtgattctcctgcctcagcctcttgaatagctgagattacaggcgcccgccaccatgcccggctaatttttcttttagtagagacagggtttcaccatgttggccaggctggtctcgaactccttacccaggatccccccgccttggcctcccaaagtgctgggattacaggcgtgagccaccgtgcccagcccactttcgttgttttacagtttccgaaggggaagtggtcagatcctgtgtgtccgctgaggcttacttgccatgcctggttatgtaatcgtggacaacctttgattgggctttgctggtggcagaaataaggacaggaaaaaacatgggagtcagggcgtgtcccccactcactctactctgacatggattggactgttgattgttttgtatttatgagcatttgctgaactctcacggaatatggagaattaaaagttggacagaaatgcttcagtaagccagcgtgaactgtacataggttcacacagggaaaaaaaggtcttggaggtggctccgaacactacatgtctcagccttttcatactccagccaatgcccagggagcacttggtggtctctgcttttgacttagctactgtcagcctctgcagtctcaagccggcctctgcagccacactcagctcttcccagtactcttttaacatactcttctctttccagcacctggctttcatgcaggcttttcttcctcatcctttgggtttcagctcagaggtcatttcctcctggaagc

SEQ ID NO: 65600 - DNA, 2275 bp, Homo sapiens
aggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaa

SEQ ID NO: 65601 - DNA, 1990 bp, Homo sapiens
atggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaag

SEQ ID NO: 65602 - DNA, 1090 bp, Homo sapiens
gtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggata

SEQ ID NO: 65603 - DNA, 1143 bp, Homo sapiens
agaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgt

SEQ ID NO: 65604 - DNA, 1878 bp, Homo sapiens
gtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgcc

SEQ ID NO: 65605 - DNA, 1240 bp, Homo sapiens
gcaagcagcgccctccccagatcccggccttgggtggggcagacaggcagcttccaaactgtaatctaccccacagggcaagaccaagcgttctgctccaccccctctcctataggacgccaccctcagagttggtgtcttaatcccagtggttctgggtaaaggcccactcttccctgcttctgtgtccaggtgtggggactccccactggatcataggctgtccccagccccctttcacaaggattgcagagtccctcctggccagggagggaagagggaatctccctcgctgctggaagtgagagcttggagcttcagggcttccaagctcactgtagcatgggatggggctgtgcgtggctggggtagagagagatggagaaaggcgtcacagcagagtcagaaagcaaccagctggctgaggttggggtgtaagggctgccctggaagtcagcatgatgtgaggggccaggggaagggggtgatggggaggggagggctggaatgacaaggatggaaaaacttcctcctggtgggagttgtggctgggctggcgcctccctctcctaagggcagggagcagggaggaggccaggcaggtgcacacacacaaggggaggtgcaggctcaagggacacaggtgccaggtaaacaggcatagggacctgcaggacaactgtctattgtgagccggtgaaggctggctggggctgcaggctgccctgggctgtgtagagtggagaatggggctgagggtctccgtgtactaatggtgtgtatgtgtgtgtgtgtgcttgtgtgcctttctttgaaggtgcccaagttgcatgtgttttgcaacatgttcatctaattcttcctggtaattccacctccctaacctgcccctcctccctgcacactgcccagaatcagctaggtgggtttgtaaaagttgttaatgccagcttagactctgagatgtctgcgcacttctgctccggttagaatgtggcataatgttttttcctaaacaagcctggcagctgcatcctcgggggtccattcagagggccaggccctggaagggatgtcacccttgttcctttggaacaagggccttgggggtcagagactcctgggcttgcatttcaactctgtctcacacttgggcaagtcatcttatctcttgggcctgctttcacttctctgaaataaggatattaattcttttgacatagcatcatcatttgggagt

SEQ ID NO: 65606 - DNA, 1034 bp, Homo sapiens
ctccttgaggagccaacccctcggagctgaggacttgtggcagccagacatggtccagggccaggggtgggacacagggacctgttgagggagaaggtccagcgtcagcccagggtacggagttggctgggggtccccggagtcatcttagccctcaggaagtcctggggaaaggtggcggtgctgccaggctggattcttttgctcgacttggaattggctggtgggtcctggcagagccggtcaccctgagcctgaggagctggtttgaggggttggggcaaagccgtgggggcggaggggtgtgtggggctctggggtgtggtcaccaccttctttagaacttgggaactgcctggagacagacagagagacagaccgggagagctagtcctactccttatgggaacagtgtggctctctcccccaccattcccgaggccccaaagtttctctccccggagctgggctggcaccgtgctgtgcacgcttaggtttgaggaagggtgatggccgctggggaggatttagaatgtgctgcttgggcggtggcagtggcagggatggagggccttctgacttctcttcgtcccccatcgattcatccaggctggcatttccctgggctcaggccatccggtgggactcccaaggcttcctgagcacgagcaatttccagcgttcctgggtgtgcccgagggagtgtggggggcacgtgggtgggccacaagaggattccgaaggaatgaagccccttttcctccctgctggcctcagttcccaccagggctgtggctgagctgtcgctggcagtcttaggtaggtcactgatagcattgcaggtgtcgtcccactgtggctttaggtccttgtgaccaccatgtcacagcttgtctctgagtgagatgtgtgtcattgcctgtgagagagtatcccactggttgtgaatgaaggtcttccccttgtggcgtgcctggatgtgtcacctctgcctgcgttgtcatcgggcttggaggcagaggatggcagtggca

SEQ ID NO: 65607 - DNA, 1166 bp, Homo sapiens
gggaccgaaagaactccttaatactccttataaaacatggtgtgtaaaaacaaacaaaaaacaggccaggtgtggtggctcacgcttgtaatcccagcactttgggaggctgaggcaagcggatcatgaggtcaggagttcgagaccagcctggctagcatggtgaaactccgtctctactaaaaatacaaaaattagccaggcgtggtggcgcgtgcctataatcccagctacttgggaggctgaggcaggagaatcgtttgaacccaggaggcagaggttgcagtgagccaagatgagccaagatcgtgtcactgcactccagcctgggcgacagagctagactccatctcaaaacaaccaccaccaccaccaccacaacaacaaaacaacaaaaacacccaaaacatagtgtgtcgggggggtgctggcgggggagtagctgtgtaaattacctggtaggaaagataactccaattctctggaggcataggacctccaaggaattcaaaggacaaggtaaaggggtatcggagccgtttccgcctggactgagctttttgctgggattccatcttgccaaggtctctattgcttccaccaccaccacagttccccaaccccatattggacacacaataaatgtttgggtagctgcaagaaagacccacaagtagaggaattgctccctgggggctgagagccagaggaagttgtgacagcctgggatgcaggatgctatctattgtagaaaaggcaagggctttggagccagttatacctggagttcattcattcatttgaaacatgctcttgagtgattgctatgtgtcagtcagtgctctaggcatgaggggccagggtgcggtggctcacacctataatcccagcactttgggaggctgaggtgggaggattgctcaagcccaggagttcaagaccagcctgggcaacatagtgagaccctatctctaccaaaaaaaaaaaaaaaaattagctgagcatgatggtgtgtgtctgtagtcccagctacttgggagactaaggtgggaggatcacttgagcttgagaggttgaggctgcagtgagccatgaatgctccactgcactccatcctgggcgacagagtgagactgtctcaaaaaaaaacaagcaaaaaaccaaaa

SEQ ID NO: 65608 - DNA, 3750 bp, Homo sapiens
tgagctggaagtaacacaggtgtggggtggtgtctcataacttgaccacatgctggctttttatccccagctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaccctttcctgtcctgcctcctttgtgagtggtggcgtcttcaaggggagtagatatgttgaagcagggtactttctgtgttcgcagtacctcgatatgcaggagagaagacttcagaagaacagaaatagaggcctgtgttcacttgtgattttaattaccctgcctcctacggtgatgactgtcttctagctgggaaagagcggaagcagttggggcgggtagtgacatggggctttgtgactacctaattcttagggatcagattccaggcctttcccagtgaagggagagaatagctgctaataacaagagctaacgtgtataattcacagagcgcaaaggaactttacattatttcctgtaactgtcctgtgaggtaggtagctgacaatatgcaagggttgtagtttctttttctttttttttctttttttttttcagacaaggtctggctctgttgcccaggctggagtgtagtggtgcagtctcagctcaacctctgtctcccaggctcaagccatcctcccaccttagcctcctgagtagctgggactataggtgtgcaccaccacgcccggctaattttcgtggtgggtttttttttttttttttgtagaggtagggtttcgccacattgccgaggctgttctcaaactcctgacctccagcggtcgtcccgccttggtctcccaaagtggtgggattgcaggcatgcatcaccatgcctgccctagggctgtggttcaaatgcctcaaacctgcaggacaaggcacagactactcagaacagacactggcctggcccattggcccattcctggctgtgttatcagtctggtggtggtatccctgatttctaacgggaagcatagggatttacagatttcactaacttgactgtgatcacacattttaagtggtagaggcagagttttgaacccagtgggtgtcactttttttttttaatttaaaatttttttggtagaactgggtcaggaaaatgttttaaattttatttatttgagagctggggttcttgctatgttgctaaggctggagtgcagtggctggctgtacaaaggctcaatcgtgctatagtttttttttttctttgagacgggagtctcgctctgtcgcccaggatggagtacagtggtgcgatcttggctccactgcaagctccgcctcccgggttaacgccattttcctgcctcagcctcctgagtagctgggactacaggcacccgccaccgcgctaggctaattttttgtatttttagtagagacggggtttcaccgtggtctcgatctcctgacctcgtgatccgcccacctcggcctcccaaagcgctgggattacaggcgtgagccaccaatcgtgctacagttttgaagtcctggcctcaagtgatcctcccacctcagcccccttagtaggtgggattataggtgcatgccatcacgcctcacttgggtgtgacttttttttttttttttgagacagtttcactcttgttgcccaggctggagtgcaatggtgtgatctcggctcaccacaacctccacctcctgagttctggttcaagcagttctcctgcctcagcctcctgagtagctgggattacaggcacgtgcaccatgcccagctaatttttgtattttcagtagagacggggttttatcatgttggccaggctggtctcgaactcctgacctcatgatttgcccaccttggcctcccaaagtgtttggattacaggcgtgagccaccacgcccagtgggtgtcactttgaagcctgtgtccacaccctgctgcctcctagaaggtagagtagttgtaattgtcagctaatatcctgctcaggccaaaggttactattttttcccctttgagcttaatttttattaatatccttttcagattttcttgctcttctgtcttttccgaagatcatttaagatcttcctgtaaatttaacagctcaggtgaaactggaaacctctagattgagtcacattttgaggcatatgcagaaacggttgactgcctttggtccccagcttatgattttctgtgtggttttttcattctgtttcttagtccaggcacagaagagggctcttggcttggatggggaaaccaggtacatacaatgggctggtagttgggaggggatagggctgtcatctgcagctgagcactttgacctgcagttggagtgggcagaaaagagttgtggtttagaatccatatgggtggagatgggctgatgcttgctcagactgctccctggctgctcatcttgagctgggtccaaacttgataacctttcttctgagcctcctgagctcttgttagctaggatctgaaaatgctaggtgcagctggtgcattgacatgttcctgtagtcttggctacttgggtggggggatggctgaggccaggagttggaggccttagtagtgcttgccatgattgcaactgaaagtgctagatgcaggcttggggcgtgccttttagcttgttgctggggcctcactgaagctgtcagactcttcccaaattctgtttcaaatcacacctccttctgtggttgtgggaccttcaccaccttcctggtgtttgcttaccgtaacctcctgtggctgaagcctcaggcaggagggaccaagttggaagagtagtttaggttttagagggctgcttgaaaggctcaggagggaagcccaactgtgaagtgggtcgggggttctgggtgggccatgggcagcagcgggcctggcagcccacatggactaggtggtctgcgctggggcagagacccctacctcagccttcctctgcctgcaggaagagtgagtcatctgcacatcctgcctccagccctcgccacgcggtgcagagtaagggtggccaggttgttgtttgaagcagtgcttgcacttgggctagggccagtacccacaagcaggaggaggagcctcaagacgagagggttgtggccccaggaaggctgggccgttggcctctagatgggggtgggatgcaagggcttctctgctgtggtgggtaggggagaggttaacagtggaagtttctaacggcagatgtgaggcaggaaaggggaagcacatctggagttctttctgtcccccgccctgccccagggaggcctgagtcactgcagcaagggctcttgcccttcccatccccgctgggctctccatggcttgctggatccttccttttccttgcttttgctgtgggcagccaatcagagcctgcgcctgtggatgtctgtggttgctgggcagttttctcttggtgctagggagtctcatgccacccaaacaccacatagagctggcgacccgactccatggtccagcacatggcacagagactggggtgaggagcagaaagggaagggggtgtttg

SEQ ID NO: 65609 - DNA, 1090 bp, Homo sapiens
tagagataggttttcaccatgttggccaggatggtcttgatctcttgacctcgtgatccgcccgcctcggcctcccaaagtgttgggattacaggtgtgagccaccctgcctgtccttttttttccccccagacaggactcttcctctatcgcccaggctggagtgcagtggcgcgatctctgctcactgcaacctctgcctctcgggttcaagctattctcctgtctcagcctgccaccacgcccagctaatttttgtatttttagtagaaacggggtttcaccttgttggtcaggctgggcttgaactcctgacctgaggtgatccacctgccttggcctcccaaagtgctgggattacaggcgtgagccaccgcatctggccagtgtatatgtttataactggaaagaaagaaaacagagcaccaatcgtggagggagtgacctctgctatattgatgctggcattcttggctcagtatgccagattgcttttaagataacctgaacctaagggctttccagcatcggaaaaccttggaaaagactaaagcttgtttataggcagagatggactaaaggacatgggtgtaagatttggggtggaggccctttgagaatgttcactgcttacattcctgttacagcttgtgtaacctgaagaggcctgtatggtgggggggaagagacttgggtgagtcagtgacttagtgtggttcatggaaaacagcctggggagggcctgaacagggaaaaagaagtcctcactctgtctccacctgggggcagcagttagccatgcccttcctggggcaggtctcagagtcccactttgagttccaccctccacatgccttgcatacttatgcagaggagtgtcctaggcccctgttcaaaccccttgagcttacttccctcataaggtcatacacatctgccagcacaatgaccatttcctttatattagtaaattttaagtgaaagcacccttcacttctcttagcctggcaaccttcctccttattgattgacccctgtgctttcttcctcttagtacctttgtgttggatgaatttaagcgcaagtactc

SEQ ID NO: 65610 - DNA, 1045 bp, Homo sapiens
cgcctcctgggttgaagcaattctcctgcctcagcctcccgagtagctggggattgcaggtgcgtgccaccatgcctggctaatttttgtatttttagtagagatggggtttcaccatgttggtcaggctggtctcaaactcctgacctcaggcaatccgcctgccttggcctcccaaaatgctgggattacaggcgtgagccaccgcccctggctcccccaacatttttaatgtcataaaagtgatatcctaaaagaccaagactattaatgtccagattttaattctagttcttttaagacccagctaggtcaactgcagtggctcatactacttggcaggctgaggtgagagggtcacttgagtccagcaggttgaggctgcagtgagccatgatcgtgcccctgcacttgggtgactgagcaagaccctgtctcaaaacaaatagcttgaacagttcaggagggtgtgaaaaaattcccagccccagttttggtgtggttgaggttttaaggctcctcagatgaggtctcttatgcatttggaaaggaacctgggacctagggttaaaggacagatcctctgctttgctacagtgtaatcttggacaggtcattctacttggtctcatctgtaaagagaggggagggtcagggtaacagttgataactcatgggttataaggattgagtgaaattggaatactcatggcaatatttatgctatgaacaatagaaccaactaaacattcagtttaatattcaatgtttagtagatttatggcacaatcctgcattagaagattgtttggccattaaaatgtttgcaaagaattctgtttttgaggtagggtcttgctatgttgcttagtccggtgtccaactcctgatctcaggtggtccttctacctcagcctcttgagtagctgggactgctagtgcaaaaaattgttttgttttaggctgggcgcggtggctcacgcctgtgatcccagcactttgggaggctgaggcgggtggatcacgaggtcaggagattgaaacc

SEQ ID NO: 65611 - DNA, 1304 bp, Homo sapiens
attctcctgccttagcgtcccgagtagctgggactacagctgcccgccatcacgcccagctaatttttttatttttaggagagatgggggttcaccgtgttagccaggatggtctcgatctcctgacctcgtgatccgcccgcctcggagatcccagcagtttgggaggccgaggtgggcggatcacttgaggtcagagttcgagaacagcctggccaacagggcgaaaccccatctctactaaaagtacaaaaattagctgggtgtggtggcaggcacctgtagtcccagctactcagaaggctaaggcatgggaggctgaggcacgagaatcacttgaacccaggagatggaggctgcagtgagctgagatcacgccattgcaccccagcctgagcgatagagtgagactctgtctcaaaaaaaaaaaaaattgaaaaaaatgaagaaatgggaagtaatccagggaaggatgatgttgtatgaagctattgtctatagggtttgaaaagaaggtgagcactgggacttaggtagagcaaggactcttgctgtgaacagaactcttcagggcctttccactgactttgtttacacccttatgtcctggcaggttctagagccttctttccgccaggcctttcccaataccaaccgctggttcctcacctgcattaaccagccccagttccgggctgtcttgggcgaagtgaaactgtgtgagaagatggcccagtttgatggtgagtctgaggagactgggaggcatatggccaggatcagggtctggtttgctctgcatcaaccccttgatttcctgtcttgcttttgggttatggggacctgcagaatgtagggtgtcaatgtggtagctaatattatgtgcagtttcgtgtacactcataccctgactaatttgtattactatatagatttgcgatataaagtatttgttgctgagtgtgttgttgctggaggacacacagtgaactgatgagcagtctggggcctaagttccttacttgtcccattcgtcagtttcctctgttaccttgcttgctctgtgtggttttggaggggtgtggaaagaggcagaacattcgttcactttcctgccttcctctgcaccagctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaag

SEQ ID NO: 65612 - DNA, 4108 bp, Homo sapiens
cgctgtctacctccacgtctagactccgattggcccgctgcacctggggggcgggccagtcaagagctccaatgcgcaggcccgagctttttccgcgctggccagcaggccccacccacccagttctttttccaattcagcgccactggataccgaactgtcgtacgtatgtcttctgtttcgtcctcgctttccggctgctgtttctccacggctctcctctttccccctcccttctctcccgggcggcttactttgcggcagcgccgagaaccccaccccctttctttgcggaatcaccatggcggctggggtaagtttgctggctctggtggttcgggtcatcctatccaccgccatcctttgcccgagtggggccagtcggcgccagaggagttctgaggttgagtggggaactgattcgggggtctacagactgtactgctggagagtagggttcctagggcctggaggggaactgaggctggggctctcggaggccagaggtggaagggtctggggaagaggagaaaagagatgccgggtctgggccgtccgaagcctgagaaaggggttcggctctgttgccgctttgaggcgtggtatctgggcaggttgacgaacttctgtgtccgttttgtggagtaacacaggggacaggttgaagaggagggtctttgtaggcaggtccggctggcacggttaaaggtcgtctctcagggaggtttgggagcgagaggattctccggacagtgaagtcagaccaattggactccgctggccggcataatagagaagcccaacgccggggaactcgctgcgggacaggaccggagggatgatattcgcgacacggaaagaaaggctttttgagagagaggagttgatttaagaagacggcatgccatcccctatctctggctagtctgaggggaactagaaatctctcgatcgtcgtgcgtgccttagagacaggacgatgcttttgaagcggtgagcagctgagcagtagagtaggcaggcgctcggaaccatcaatgaatgaagcgagggctccgggaagggaggagagtatgtttgtaggcagatggagtctgatggagctagaagttctggatttcttggagatagatttgagaggaagagaatacttccagaggtgtccttagggaaggtcaaatctgtcaacaagctttatttagcagttggtgtgtagttctgttcttggtatttcggaggattctgattacatatgacaagtactaaaggacttggttcaccagaggaagtaaaagggtgagttgaatacattgggattattcaggaaagtcatcctggagagtggcattaaggactgggacccttctactcattaattttgtccctctctttctcccatagaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtgagttgggagatggggagcatccttcggttctgagaaaccaaggccctgcgattctgtcactctggtggtggcccccatctctaaaagggagcttcccatgttgttttattcaatttcggtgattttattttgagataaatacagatttacatgtagttgtgaaaaaaaatacagagctattctgtgactttataaaattcacgagtttactttgtgggaaagagaatgagttttgactaagcattttcagtgcaaatatatcagatatctgttatgagcagaattcttaccccaaggggtttatagagataggtgaagaaacatgctaagaatggaggagatgaagtgctgtgtgggtctgggtcacacactaatactttaactgatacagacattgatacaggagttgcttttggccttctgcttgtttgatccagagatttcatacaaatatcctgtaatattcaaatctattgggcttcctagttaacattgtgaattcagattgcaaaggaggccaagttcttgaagtatttatttatggttcttgagtatcaagagtttggatagtgagaatcatcagccttatataagtattttcaaagcagtttggctcctggtattggttaggaagaaattttgtgtgttttaccttatcttttcactgctttgtccccaggtcccagcatttgagggtgatgatggattctgtgtgtttgagagcaacgccattgcctactatggtaatttgcaggggtatatgggaatgggagaatttggaggtgagggtgtaggagaggataagtgtgagcgggggtggatatgaaggaattctccaggacctggactggtgttggcattcccccagagttctgaccttcgtgttctgcctctgcagtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggtgagccttggaactttgagagaagccaggggcaggggtggcatcagctcctgggtgttgggagtaagaaataaaataggttgaaaaaaagatgccaaggatatgtaggcaatgagaagacgtaatctctagggtacgagtttgaagcagtgggcagttgatggaggaagtgtctgtcatgagtgatcagaagagggattgctgctgtgaagagattataccaaatggtaagggggtggctggaccagaggacctctgaagttcattgtttgtaatacatttagaatgaccctaggatctgcctccattgaaagagagtgagggtgagctcagacttctaggtgaaaatagccctcttagttctattaatgggggaggtgagggaaagggattggtacccactgatgagttttatcatgttgaatcactaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggtgaagtttatggaaaatccatttggcagtgggtagatggggattagaaacaaagtgacgaggtatctaggttaccctgtattctgctgaggacttggaaaacagctagaggtgggtgcagtggctcatgcctgtaatccgagcacactggggggccgaggtaggcagatcacctgaggtcaggagtttgagaccagcctggccaacatggtaaaaccctgtctctactaaaaatacaaaaaattagccaggtgtggtggcgcacacctatagccccagctacttgggaggctgaggcacaagaatcacttgaatctgggaggtggaggttgcagtgagcagcgatcgccccactgcactccagcctgggtgagagtgagacttcgtgtcaaaacaaacaaaaaacagccaggaatcccaggactgagtaccatcacttgctttccattctcttaagaagctgggtaatgtcttgcctttagtttctgtttggcagctaagatgtttagtttgttgccatatttcctgggaagattggttattcttagttgtgaagacagaggtgatgatggtagcttcagcattaagatctttttggaggcaggccaggcactgtgtctaacacctataatcccagcactttgggaggcctaggcgggtggatcacttgaggtcaggagttcgagaccatcctggccagcatggcgaaaccctgtctctattaaaaatacgaaaattagccgggcgtggtggtaggagcctgtaatcccagctacttgggaggctgaggcaggagaatggcttgaacccaggaggtggaggtagcagtgagccaagatccagctactgtgctccagcctgggggacaagagcgagactccatctcaaaaaaaaaaaaaaagctctttaagctcttttggagacagata

SEQ ID NO: 65613 - DNA, 1010 bp, Homo sapiens
gagaatggatcaggacagacttggggctgagttggtctcaggacaaaggcagggattcagggagagaagggaggtcagaatgggcaccggggttgagaaaactgccagtgaggggattagaagcacctctgatctaaccggaattattgcttatttacccagggagtggcccccttctcagtaactacgccctgaccttgctggtgatctattttcttcagaccagggaccctcctgtgttgcccactgtgtcccagctcacccagaaagcaggtactcggcctagcctccaccctctccatcttgttagtttcctctctcttcttcatcacacttagatacaccaagcagctctgtgaatgagatctctctacccccaccctcaatctccttgcttccagactgactctcaccttatttactttcacaggagagggggaacaggtggaagtcgatggctgggactgcagtttccccagggatgcctcaagactggagcccagcataaatgtggagcccctcagtgagtttggggagcctggtagaggactagtaatgatgttcatcaacagtaggtaacatatatcacactaactgtgtgccaggcatggttctcacagaaagcctgtgagatacctaatattattactgccattttacagatgaagaaaccatgtttgggagcaattaagtgacttgcccaaggttacactggctagcaaggagcagcagcatctgggcaaggacatcatgtgggggcagggagagaggtttgacctcttgtttatagggatcagagaagcctagcttcctgggactctgctgagccccttggaagggaaaaagtcctgctaaggaaatggctctggtgcaggacctgtatcagttctggcctctaagtgacccccctttccccactcttcctcctcctccaggttccctgctagcccagttcttctcctgtgtatcttgttgggatcttcgtggctccctgctgtccctgcgggagg

SEQ ID NO: 65614 - DNA, 1082 bp, Homo sapiens
ttctagtgtaaaggtattctagtgtataaccacagtaccattatcaagttgaggaaatgttacattgacacagatgtaaacctttacagactttacagtccatactctaatttggtcagctgtcctgtcaatggactgttacagtttctctttcgtctgtaatagttcctctgtttttgtctttcacgacaatgacattttttgcagaggtagaccttttattttatagaattaaaaggttatctttaaaaaaaaaaagggttcctgtgaagattaaatgagttaatatgtataaagaccttagaatagagctgaataagctggaagtaatattatcttgagagatccctgcttagggaacagcagaaacatttcactcagttcatttctgtccacagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggtacctttcttttttttgagacgacatttcactcgttgcccaggctggagtacagtggtgccatcttggctctctgcaacctctgcctcccaggttgaagtgattctcctgcctcagcctcccaagtagctgggattacaggcatgcgccaccacgcctggctaattttgtatttttagtagagacggggtttctccatgttggtcaggctggt

SEQ ID NO: 65615 - DNA, 1075 bp, Homo sapiens
gagatggaagtaacaaaggggaactgcgtgggaagaaaaggtgcgaaagttttctgtttttttccagtggcccaggcacccctgaaaccaaaaacacctcggggtaccaagacaccgatcaacagaaaccagctgtcccagaaccggggactggggggcattatggtgaaacgggcctatgagactgtgagttgacagaaaggggtgggccagattgagttgggtgggcttttgtctctcataggagtctgagagggtcccttccctcattgtgccatcctaccccttttccagatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccaggtaaggcgtctaccatgggaggggctgagagggacagtccaggctggtgagtgtggggagtaggagtatcagagcaagagctccaggaaagttgtggatgcagggtggggatgccagaaaagaatgggccagaaggcataattgcagtgtggggcttcacctggaggtcttaatgttctctaagccttttctgtttcccacttgctctttctggccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttgg

SEQ ID NO: 65616 - DNA, 1034 bp, Homo sapiens
gagtcttgctctgtcgcccaggctggagtgcagtggcgcaatctcagctcactgcaagctccgcctcccgggttcacaccactctcctgcctcagcctcccgaatagctgggactacaggcacccgccaccacgcctggctaattttttgtatttttagtagagacggggtttcaccgttttagccaggatgatctcgatctcctgacctcgtgatctgcccgcctccgcttcccaaagtgctgggattatgggtgtgagccaccgcgcccggccgggagtgggagtgttttaaggagcaggaagggagtggtgccaaaagtttcaggtcctcagttgctctccatcttccccatagtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttgtaagtggatggcactaggaggagaagtgggagagatgacaggtgagggaaccaggacctggggccagatgccagctcattcttcctccctctgccccccttagctaccctggaagtcacttgccagcatagtccagttttattacatgtggaaaaccacagaccggtatattcagcaggtattatctgggctggggagggtggaccataggctacctgctgacctctgcctttgaagttgatgacattctccctgctatgaggctctgatccttctctttctttttaccttcttacagaaaaggttgaaagctgctgaagcagacagcaaactgaaacaggtctacattcccacctagtaagtgtggtgggtaggggagaccagagtgttttccttcccttcccctaacttgtgccttcctcagtgattgggggtgggcaggaggtaggggcacactgagagtggaaattgattcttttccttgacc

SEQ ID NO: 65617 - DNA, 3112 bp, Homo sapiens
gagaggttagcaggaactttactattctgtctcttgggggcaaaggaaagggatttggaagtctatccttgaatgtaagtctttactcatattttcttgggctttttaatttaggtccctctgaaacttactgttatttgtctctttgtgcatttctgttcccagatgatcaatttccactgctacgttgttttgtttttgtttttttcctccccttagactgcaaatggaaatgtggaggcaaaggttgtctgtcttttccggcgcagggacatttctagtagcctcaacagcctggctgatagtaatgccagtgagtatcttcctccctttctttttctcctacccatgatctgaggcctgggcatgtccctgcaggtatttcccctggtagcatgcccaaggcagaggtgtgagtttgggggtgggaaatgcctggcctgaggagggaggcctgtttttacatgttggggttggaagcagggtggagagattgtgataaggaaagcgataatatggtttgtatatgagagtaagagagagatgataacatttagagtatgaggacgagctttagagaaacaatggttttctaaaggggggcagtttggggtacattgagacagtaggtgatgactgaaggtcaacgtgaagaggaagacattgtactgagaagcctgcgtaacagagaagcaggcttattttgtaatcacaaggtgatgagagtacctggaagttagaagatggctggaagttttcttgcgctttttaatttctcacctcgcccatttccccgcccgcccccctccattttacatctttcccttttcattttgccctatcttcattctctttaaggtctcatcttctttttttaaaaaacatattttccttagcttctttttcctttcctgctttggttttctttttccttccttttgttccacctttctaaattattttcctttttcagactgctctgggtgagaaggggttaaagaggagcccagcttaccaagttccttggccctttagggtttccagccccatctggcaggggctgaccttggccttgtccaatcagaaggggtgttgggggtgtggtcccccttgcctcagcacagggtttccggagcacacaagcgaggggtggagcctactgcacaaccccccccttctccctgaggttgggaacaatacaccaatgagcctggggctgaggttcttctgctccctcccactttggttggcgcctagccaggttaaccccttccgctaggtttcagggcaagctgcagctccttggggaggaaggtgttggcactggcttgagaggtgttgtccttggaaaccccaggaactattattagccaagtagaaaatgagggatagttagggctgcatgtgatgttttagagcaaagagtctcctgaaattgaaaagaactggtaaacacagtcttgtgtgatattttttcatcttgagttcctggacctcaggctggtttagcaagcaagagacaagtgtgatgttcttgctggcccgttgtggactttggtgtctgagtactggcagctgggtagcgatgtatttctagagcattcttcgtactctcagcagttcttctctaaaagcattactgatagagttgggagcatctatgatggggcatagagctaagaaggaaagctggtgggataagggtatagaaggcagacgcctgggaaatgtgagaaaaaaacagccaagataggaaatattttccctgagttagagtttccagggtggtgttttgctggatccatttctgacttggtttcttcctctttaatctcccaggggagtttgaagaggaatcaaagcagccaggggtgtctgagcagcagcgccatcaactgaagcaccgggaactttttctttctcggcaatttgaatcattaccagccacccacatacggtacaggacaactggggccagcatagcctgcgtgcacttacgtagaagatggagagaaggaggtggtattgagagatgctgtggggagggagagtggggctcaccggggttttccaatctctctcctatagggggaaatgcagtgtgaccctcttgaatgagacagatatcttgagccagtacctggaaaaggaggtgagaaagagatgttgagagaagagcgaggggaatgggtattgcccgcaaaagagagggggaaaggagcacaatgatgaggtacagggttgccagactgccggtcatggaaactcagatacacctccctccccgccgcctatgtggattgctgccttgcttaccttgtctctccccaattccaggactgctttttttactcactggtgtttgaccccgtgcagaagacacttctcgctgatcagggcgagattagagttggttgcaaataccaagctgagatcccagatcgcctagtagagggtaagcaacaggacaagactgtacggctaccaggttgtctaattccaaggggcactttaacattatagtctctgtgaatggcgtcacctggggttgtgcagtgcactgtctgcagggctctctgccatgaccctgacagaatgggcctgtaggaacctgaaaagggaaaatgggaacagttgggaagagaagtcggagagttgatagaatccaagcagaagaagagaaggaggaggtgctattgtgaatgaaaagacaccaactgttcccccctgccctctccctgttgatgccattgttcttttccccaggagaatctgataatcggaaccagcagaagatggagatgaaggtctgggacccagacaaccctctcacagaccggcagatcgaccagtttcttgtggtggcccggtgaggggtgggtggatagggaagatgggctgggggaggtgtggacattgttctgagtcccatggttcttagagatggactttatttctttcattgccatggatgttttccttctttctcctttggcttaatttcccagcccacttgggcttttgacttttctttcgcttttgacttctcaatttctcccttagagctgtgggaacctttgcaagagccctagattgtagcagctccattcgg

SEQ ID NO: 65618 - DNA, 1064 bp, Homo sapiens
gggcccgggttggtggccctccaggaggctgaggtgagggctgggctggggtcaagggagtgagggagaagagcaatagtcagtgggctcttgacattctgctaccactctgcagattcccgagcacttcggggccgtgcgagccattgctgaagggcttggctctgagctgctggtgggaaccacgaagaatgcattgctgaggggagacctggcccagggcttctcccctgtaatccaggttgggggttaagggctcaggggaggaagggacaaaggggtgtgagagaggggcaggagtgacagtcatgctgtgctgcagggccacactgatgagctctgggggctctgcacacacccctcccagaaccgcttcctcacctgcggccacgaccggcagctctgcctgtgggatggggagagccatgcactggcctggagcatcgacctcaaggtagagccctgtgcccctggatcccccatgccacacccaccaggacacctgtggccaccacgccttccccagcaccttgccttctgcctcccagaggtggccagtttgtactggtatggctgcactggctactcaaatattaatttttctgtactgactggtaaaagctgatgcttctagtaccacctgggcactccctgccgcccccagaacccctcagacttcctcttgatccagcacctaaatggttaatctccagcacagctattggcatcagttctgtggttaaatattttggtatcactccctgttcaggctccagtgatacccgggtatcccttccctctcttcccatcttctccttgggagtaagtggctttgaagttaggaggacaaggggttcactctggttccctcactagaaagacatcatcttgaattcaccttctcccctctcccaggagactggtctctgtgctgacttccacccgagtggggcagttgtggccgtaggactgaacacggggaggtgagagagagccaggactcccaggagggaaagcagggaggactgggaagggttcctggtactgggggagtgggcgagagt

SEQ ID NO: 65619 - DNA, 2017 bp, Homo sapiens
tccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgagtacggggcggggcgggcggcgtgccccttcccggagcgcccggctcgtcgggttatgccagagctggacggctgtctggaggcgtccccgcgtgctcctccgccccaggggctccgagcatcctccacagttcctccggtcgccctccctagttgcttgggtcttgctgtcacttcgggcttccccagcgtcattctacgccccacgtaactccgggcccctcgatgtttccctgccccctgcgttactccgggcctcttctcgtggtatttcaggtctttttccttctgatccccactgccccctgagaccttcactgtgactctgctcaccactcacactctctcctgtcactctggatctcttttcttgtactctgggtcctcagtatgactccattcccgcaccccgttctctctcctggtgttcccccggctcagttactcagctttcgctggagacctgagcttgctgggggcgcgtggggagggctgcggtccctgccctcaccagtgcggcgcctctctctgtggctcccacgttcctcggcagtactccatatttcccccccggtactccatggtactcccagtctttgcggaggctgagacggcagcaggaagggagctttgccaggtttctcgcctgccctgccagaaggaggcccttgatcctttaccaccgtctcctcccctctggacgagcattcaagcctggggctgcctgaaaggggcagtcctaccggacacatgtaaagttgtggggagacagaatcccctctacgctttcttcaggtgatgggtacattctgagtacctcttgcccttttcccaggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacaggtatgcatgtcatcacaccccatttttcctcctccttggggcctctggggcttcaggttaattcaacatctctccagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgtaggtgtcctgtggccctgtggcggaagctgggaggggtggtaggattgcagagtacagttggagggaatgaccttcactatgcccccaccaggccgcgaagaaattcttcctcctcctcatccccctcagagcggcctcggcagaagctctccaggaaggcaatctcctccgccaacctgttagtgcggtccgggagcacagagaggtgggtgaggcttcccctcaacccaccccgccccaggcgcaggctctcgactttccatatccctcacctcacatccctggttggggtggggggacctgattgcccaacaggaataaagaaacaaacacttctggggcgc

SEQ ID NO: 65620 - DNA, 1024 bp, Homo sapiens
tcatgtggtgggccttagatttcattcgtgtaataagtattgagcaacagctattgggtggcgtgactgactggatggatgaataaggtgaagatctgggcgccaggactggctttctcaggcaattccgtgatgagggggcgggtctcgaggtaggtaccacgtgcacctactcgagattctgcacctacccggggttttgactgccggccacgcgagtttggcacgccggatgtgacgtcaccacccggtggttcccggaacctggcggtgggaccggaaatcaagtctacaaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggtgagcggggcggggcgggggtgcggcgggctggcccgagggcgcccgccgccgtgcatcccgccctggggatgaacccccggcaaacaccattcatccgctcggccctccggacagctctgcggcctcaggcgcactgccctctatagaacgcaccgcggctacccgccgcacctcggatgaaatccagactccttcccagagcctgcaaggccccgcatgatcctgctgccgtccgcctctcccaaccccatttccacccctctccctcgctctgctgcagccagactggcttgctgacagtttctcgaaaaccccacgctcattactctctcaagcacttaacttgttccctctgcttggggtgctttgcttccagcgtttcccgggctgcctctttctcatccttcaggtcttagctcaaatgtcacctcctcagaga

SEQ ID NO: 65621 - DNA, 3279 bp, Homo sapiens
aatttttgtatttttagtagagacggggtttcaccatgttgttcaggctgatctcgaactcctgacctcaggtgatcttcccgcctcggcctcccaaagtgttgggattacaggtgtgagccaccacacccggcctatgctgttcttttcttattgccagttcctggaggagcatttctgacttgtgccaaaattgaaaagttttcctttattgtctttcttccttcctaggcccctgtgggtgcagtaccctcaggatgtgactaccttcaatatagatgatcagtacttgcttggtgagaaatgaggatagttggtggtgggttggctttgggccaagcagcactgcggatgcccagggagggactagtgaagctggtggtgcagagggcaggcactttggtgttccctgttctgggaactaatccccctattcagagttgattctggcatattttaggggatgcgttgctggttcaccctgtatcagactctggagcccatggtgtccaggtctatctgcctggccaaggggaggtgagttaaggaagggcatggtggggaaagatggtggaagccaaaggaggcaaacaggacgggacccctgtgcactgagtgatccggtatcttacctcttttgtcactcacaggtgtggtatgacattcaaagctaccagaagcatcatggtccccagaccctgtacctgcctgtaactctaagcagtgtgagtaagcctggtctggctgccggttccatctccctgtaaatttccagaaggggagggaatgtgtgccttagggtccagtacctatgtgggcatacatgagtaagcaaaacatgctgtggggcccaaggttggacaagggggcaacttcatcctggcattgctcttgccctagatccctgtgttccagcgtggagggacaatcgtgcctcgatggatgcgagtgcggcggtcttcagaatgtatgaaggatgaccccatcactctctttgttgcacttagccctcaggtaagtgcataggcagcgagtctcctcagccatttgcctgccttcctaggactcagttctctggggttgtgcccctcactccctcttgggctcaggcgctcacctatcccacttcttgctcagggtacagctcaaggagagctctttctggatgatgggcacacgttcaactatcagactcgccaagagttcctgctgcgtcgattctcattctctggcaacacccttgtctccaggtaatgggtcacccactcttccttggctgcctttgctggggcctgatccttgtgggggctcccagttcactgtgctcttttctcacattctgaccttgctttgggtctcctccttccttctgttctgttatttttccccctgatggacatctgcttttaccatctccagctcagcagaccctgaaggacactttgagacaccaatctggattgagcgggtggtgataataggggctggaaagccagcagctgtggtactccagacaaaaggtgagtgaccaatctggcccctaggatgggggaaggaggggaagccggggcaggtttagggatgcccttgcctgtaggaacgttgttgttatgctatagcccattggtatgactatggcactcttttattcctcctccaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaataactggtggtagtctggattctagttctagcctgagccacagaccctagaagcctagagaccttacatttgctttcctttttttttcttttttgagactgagtctcactctgttgcccaggctggaatgcaatggcatgatctgggctcattgcaacctctgcctcccaggttcaagcagttctcgtgcctcaacctcccgagtcgctgggactacaggcatgcgccaccatgcccagctaatttttgtatttttattagagatggggtttcaccatgttggccaggctggtctggaactcctgacctcaggtgatccgcctgcctcggcctcccaaagtgctggaattaaaggagtgagccactgcgccctgggtctttttttttttttttttttttttgagacagagtgtcgccaggctggagtacagtgtgtgatcctggctcgttgcaacctctgcctcctgggttcaggcagttctcccacctcagcctccttaatagctgggattacgggcacctg

SEQ ID NO: 65622 - DNA, 1877 bp, Homo sapiens
cttggggttggaaaatgggagggcaggaggtgtctgacccctttgtggtcacctatacagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggtacatggttttccctgcctcattcttctgctcttttcttgtcgggtgattctatgtgttttcagagatcctgtgccccagcttgttttctaggtttatacccctcagcctgcctctagttcacaagcctccctcagtttctgggtgttgggcctgatcctcgttgtgacccccatccctcatgaacctgcaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaaggtaaggggttgcagtcacgcttggtcttctcagggtagggctgaagcatagtttagccttaaagagacctgaacacccctgttccttgcccccagctggtggccatcgtagacccccacatcaaggtggactccggctaccgagttcacgaggagctgcggaacctggggctgtatgttaaaacccgggatggctctgactatgagggctggtgctggccaggtaagcagacccagaattgagggagagttgattggccagcggggtagaatggtggctcttttgccccttaggggattgagagccacccttaacttctcccaggctcagctggttaccctgacttcactaatcccacgatgagggcctggtgggctaacatgttcagctatgacaattatgaggtagggaaggcctctccccatgacctgcgtctgtctgttccacctgcctccctgaatctctctcggcttgccaacccttctatggttgattgcctgcaacatatcagggggccttgatgatccggggagggccctgaaaaatgcatctttttagattcctaggagctctcttctctgacactgtttgtcttcttcctcccctctgtccttctgtccccattttctgcccacgttcccagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtggtaagggcctgagagaggagagttggtggaaagagggaaaacagcccagagactgagggcctagggaacttgcaccagatgacagctggcttttgctcctcactacccgtctcttctctcctcacccagcacatggcgactgctgatgggctgagacagcgctctgggggcatggaacgcccctttgtcctggccagggccttcttcgctggctcccagcgctttggtaaggtttagagaatggagctgtggcagaagggtgtgaaggccagatctcaggagccatggacctggacctgcctctctgaggaatgggagccacacactgcatctgtttcctctcagctatgcgctttgaaggaagtcagggtgtgggaggtccactccttgttcaaatgttcttgtgaactgcatcttcagcagggttctggggacccagagcggatg

SEQ ID NO: 65623 - DNA, 1380 bp, Homo sapiens
ccctccttccactagcccctcgtccctgccccctctggattggagcagacagctctcctaccttccaggcaaggatcaaaagacccagctgagggcgatggggcccagcctgaggaaacacccagggatggcgacaaggcaagttggagcgggtgggtggttggaggatagggctggctgggagggtggaggggagaggcccatgagaaacttgaacttagtctccccatcagggatgggatttagttgatgggagcggggaaagagagaactggtatgattggagagtggtcctcttttcttcttaacagccagaggagactcaggggaaggcagagaaagatgagccaggagcctgggaggagacattcaaaactcactctgacagcaagccgtatggtgaggggctcgggttccttgggctggggtgcagggctcctttccaagcagaagctctgaagcttgtttgtttttcttccaggccccatgtctgtgggtttggacttctctctgccaggcatggagcatgtctatgggatccctgagcatgcagacaacctgaggctgaaggtcactgagtgagtcctatggtgacatcaggaagatggaggtgggcaggaaggagtcaggcctttagggagatgggtgtgcatattggatactctaggcaagcatgggtcatttcttgtgtccagaatcacctttggtgatagaaaattttttgagaaaggacaagaggagcctttgcttatctctcacctgtgtctgtggagtggtgttagcatataacgcagcctggggccagttagcagcccaagtctgtctgtttgcctgcaggggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaaggtgagagcacaggcacggggaaaaaggagggagtgaagcttccaggccttgaggcaaataggtatactaggggcattagctatttggggactgggtttaagaaggggctgtgggcctggtgggcagcatttgagttccctaatcactcccaggtgacacgctcactcacattcttagggaaggcattgcctattctgggctgacggaatgcacttattatcagtgtgttacgtgctaggtactcttctgggtgctggggatatagtgttaactgaggttgaaaaggttctgggctgggtgtggtggctcatgcctgtaatcccagcactttgggaggctgaggtgggcggatcacctgaggt

SEQ ID NO: 65624 - DNA, 1839 bp, Homo sapiens
cacgcctgtaatcccagcactttgcgaggccgaggtgggtggatcacctgaggtcaggagtttgagaccagcctcaacatgaagaaaccccatctctactaaaaatacaaaattagccaggtgtggtggtgcatgcctgtaatcccagctatttggaggctgaggcaggagaattgcttgaacctgggagacggaggttgcggtgagccgagattgcgccattgcactccagcctgggcaacaagagtgaaactccgtctcaaaaaaaaaaaagaaaaaagtaataaatatgcttgggtctgtttctgggccctttggttctgtttattaacttgtctatccctgctctgttaccacactgcctatttctcttaacaggtagatttcccccggtcttctaaagtgtcattactcctcttggccctttgtacttccttatatttcttttgatatgtttcccaggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgtgagtacaggggttgggactgcagggaacctagtgtgaaagagcataggggtgttgtgaggtctggcacggggaggagacggtggtgggacagccaggtagggcctgggggctgggagaagctctctgtcagggagggtaggaaccagacccgggtgcggttttttccatttcctgtacagaccaggaggcagtcacttttgtccctgagctgtaccctgggcatctctgggaggcctgcctgggtctgtgtctccttcttccccttctcacatcatcacatttcccagatttattttcttcgtttttatttatttattttttttggtttctttttccccccatctctggaagtttgtcgactgaaactcacttttatgtttctgtttttgtgttggttttgtgcctctttttccccttccctacccatctcctcctgccccagtttctcggataaggttaatctcacgcttggtagcatatgggataagatcaagaaccttttctctaggtaaatccatggccaccggtactgtatctgttcctctgcccttacccattcctcactctagcctttggggggaggtgccccagacccttccagcctttcactcaccccactttcccctgctgtgtgatgtctggtcctgttacctgttaccctggctgggagcccccagaagaaggaaggtgagatactgaaagtcaggtccttcgggaatgtagggagcttattgctttgccaggggatggagagatgctgcctattgctggggttcctgactctcagctgaggggcacctgaggttctgggcagagctacttgcccttgaaagcattttttggcagaatctcttgaagtccctatgtatgtctgtagaggcttggtatagtatgacccacatgcctttgcaaagccattgtgtcaggccaggaggctgaggcccagggagagcacttggggccagaatctctcagtagaggcaacagagccaggattggcattcataacccaggcccctgaatcattctgcctttctcttctgggatgttgacagaggctggtgttcaggcctgtgcctcctggtggcacttattcctcattttcctttctcatttctctccccatcctttgcaaacttatctgctcattgtgggttccctctccaagctttaacatttagtcccttcctccaa

SEQ ID NO: 65625 - DNA, 1871 bp, Homo sapiens
gagtgcagtggcacgatcttggctcactgtaagctccgcctcctgggttcacgccattctcctgcctcagcctcccgagtagctgggacttcaggtggccgccaccacgcccagctaattttttttgtatttttagtagagacagggtttcaccgtgttagccaggatggtcttgatctcctgacctcgtgatccgcccgccgcagcctcccaaagtgctgggattacaggagtgagccaccacgcccagcctactctgcctttcaaagggaaggtgtgagtgagccaacttctcaggcctgatccttaaccctgtgtccactctgccttgttttgtatttgatgtgactacatctttctcccctctttcctcaactatcttctagtgctatgacaggaagaagcttttccttttgaagggggccccttctgacctccatgctgattgctctgtctttgtccttttctccttaggtcttgggcgtctttggtactggcttttttaggggtctgcctggggattacccttgctgtggatagaagcaactttaagacctgtgaagagagttctttctgcaagtatgatatttctgggggagagggatggaatgtagggttgtagggtaatgtgggagatatctgtggcagatggagtgcctaaggacactgcaggtgatagactgacttagggacattgcaggtggcctttaccttacttcccaacccttcacttggcaggcgacagagaagcatacggccaggcctctctccataccgagccttgctggactctctacagcttggtcctgattccctcacggtccatctgatccatgaggtcaccaaggtcaggagagacaaggaagagtctggtgggggtggggcaatggctgtggggtaatttggaaagggggaaattgtggccaacatcttgtcccagcctaatctttggacttttactttatgaagaaatgtgatcttggcctttaggcaaagggctcaaaggaagaaaccccttaggagagaatgggttcaaagagcattccatggtgtatcccatttcctttctccagatccaaacctctgtccccgcaggtgttgctggtgctagagcttcaggggcttcaaaagaacatgactcggttcaggattgatgagctggagcctcggcgaccccgataccgtgtaccagatgttttggtggctgatccaccaatagcccggtaaatttttcctgagaaacatccatttctgtggcccctttctccttcctgatgaacctttttttggttgctgatattctttcccaaaataaggtagtagttaactagcatagcaccttgccatactcctcaacctttccccacctcttcttctgtttcacttttctctttatccctttatcctcattcattcattcagcaaacaattattgctttttcctccctgacaggcctgggctggatgctggttatataagcagaaataaacaaggccctgtttatttacagatctcgttctccaggaatacaatgtctacctgcttgcttgtttgcttgcttccttccttccttccttccttccttccttccttccttccttccttccttccttccttccttcctcctttccttttccttagatattcagaataggattactcagattcttgtgtcatgatactctgtcaccagtgttccatgcatccatccatgactttctcttaaatacataattcagaaaataacatagtggccgggcatggtggctcaacgcctgtaatcccagcactttgggaggtcgaggtgggcagatcacgaggtcaggagttggagaccagcttggccaacatggtgaaaccccatctctac

SEQ ID NO: 65626 - DNA, 1033 bp, Homo sapiens
ccaacaggtcatatctgaaagatgctttaggaatcctatctccattggcatctttccgaaccaattttacagactgtgcaaatagggccccagagggtatttaactcactgtacgtcttttttttttttttttgagagacagagtctcgctctgttgcccaggctggagtgcagtggcgagatctcggctcactgcaagctccgcctcctgggttcacgccattctcctgcctcagcctcccgagtagctgggactacaggcacccgccaccacgcctggctatttttttgtatttttagtagagacggggtttcactatgttggtgaggatgatctcgatctcttgacctcgtgatccacccgcctcggcctcccaaagtgctgggattacaggcgtgagccaccgcgcccggcctcaactcactgtacttctatttactgctgcttttggcaggtggacgtgggtcagtggccaagagtgcctgttgcagtcactcaggtcactcactgcaggacctgtgccgcatgccttgctatggagttttgtggtagcatttattctgcttggcctattaaaccacagtgcctagtgttttcttcatttttctgtctggcctgctgtggaacagttgtttcgtacattcctctggagctggaggagagtcctgtgatgagatcatagtacactctgtgatctcatttctggtaattttcttttagctttcaagcagatgctgaagctaatgctagataactagatacaatgtgtataatagaccctgtctttagttaccttattataggttgtcaaattttatttatttatttatttgtttgtttacttattgaaacagggtctcgctctgttgcctaggatggagtgcaggggtgcaatctcggcttactccagcttccacctcccgagttcaagcgattctcctgcctcatcctcccgagtcctgggattacagacgtgtgccaccgtgcccagctaatttttgtatttttagtagacaccccattgaccagtct

SEQ ID NO: 65627 - DNA, 1904 bp, Homo sapiens
tgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagacaccgtgcgtgaggcttgtgaccggctaatccagctgctgctgctgcacctgcaaaaactggttcatcaccggggagggtctcctggggaaggggtgctaggcccgcccccacctccccgcttggtgccctttttagatgcgctcaaaaaccatgttggagagctgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggt

SEQ ID NO: 65628 - DNA, 1042 bp, Homo sapiens
agaaaaggagggtcctgagaccccgcccagagccttccacccggcacccccaccactcccggccgcccaatctggctactacagctaaaaccacacttactagctcaccaccctccgaaaggcctcccgcaccgcggagctcctttatatagcccgaggacccgcccccgagttgcgattggcccgcggaaggccggggcggagccccgcggatccggcgctgagcggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtaagtactagaccctcttcctgttggtcgtccccaccgagtcttccttcctccctgcagagctccggagcagcttcacctctcagctcaccttgtgcactgacgcttatgcggggaatgtctgtcggctgttagttcctaagctctgatagcctctcacaatacctgtagcagacaacctttctttgggttttggattctgttaagaatctcaggaaagccggggatggtggctcatacctgtaatcccagcactttggggggctgaggtgggcggatcacctgaggtcgggagttcgagaccagcctgaccaacatggtgaaaccccgtttttgctaaaaatacaaaaattagccaggcgttgtggccggcacctgtagtcccagctacacgggaggctgaggcaggagaattgcttgaacctgggaggcggaggttgcagtgagccgagatcacg

SEQ ID NO: 65629 - DNA, 2477 bp, Homo sapiens
acgaccaacaggaagagggtctagtacttacgcccgcttcttgaggtggtgccgcgtgatcagcccttggtctatcacagccccgaccacccggtgcctcagacgccgctcccgattcaacacccgccggcgtttgaacagcttcttcttcagctcctgccggggagaaagatgcgaatcagatggagtgggctcgccgcgacccggggcccctccaccaggcagccccggcccctcactgatcccatctcgtgcgagataaaagggctcaggaacgcttgaggaaacaaagtcgcggcccccacacagtcaccgttcggggccggttgatctttccccccggagctcccatagtcgcgattccactccagttcacggtccgtacttccgctcagcgccggatccgcggggctccgccccggccttccgcgggccaatcgcaactcgggggcgggtcctcgggctatataaaggagctccgcggtgcgggaggcctttcggagggtggtgagctagtaagtgtggttttagctgtagtagccagattgggcggccgggagtggtgggggtgccgggtggaaggctctgggcggggtctcaggaccctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccgggaatctcggagaaggacaaccgagatccagctggctcctccatcggggtgctcacactttctcatttgatttcaggtctgcggacgctgtataccctcctccacttcccgctgcagccaataaaggccgttcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagatggccgcgctgcgtcgaatgctccacttgccgagcctgatgatggggacgtgccgcccctttgcgggtagggaggtgggggcagagtggagagggcaaggtgggggcagagtggggagggtaaggtgggttcctcgtgagtcaggagtgtagtccctgaaattgtgattctcaaaccctacggtgggccgtgcgtggtggctcacggctgtaatgctaacactttgccaggccgaggcgggcagatcgcttggcccaggagttcgagaccaacctagggcaacatagcgagaccctgtctacaaaaaaaattaaccgggcacgatggcgcctatagtcctagctactcaggaggctgaggtggaggcttcagtgagccatcattgtgctactgtactcaaccctgggtcacagagtgagaccctgtctcaaaaaaaaaaaagacgccagtgtgtatatacgacgtttttgcagtggcgacatagaccaagtgacaccctccaaccgtgcccacaggctcactggctgatagttgcctggcggaccgctgtctctgggatcggctgcatgcccagcctcgtttgggcactgtccccaccttcgactggttctttggatacgacgaagtccaggggctcctactgccattgctgcaggaggcacaggctgccagtcctctgcgagtgctggatgtgggctgtgggacttccagcctatgtacaggcctctacaccaaatctccacacccagtggatgtgctgggggtggacttttctcctgtggctgtggcccacatgaatagcctcctggagggtggcccaggccaaacacctctatgccctggacaccctgcctcaagcctccacttcatgcacgccgatgctcagaacctgggggctgtggcttcttcaggctctttccaactactgctggacaaaggcacatgggatgctgttgcccggggaggtctgcctagggcttaccagcttctatcagaatgcttgagggttctaaaccctcaggggaccctgattcagttctcagatgaggaccctgatgtgcgactgccctgcctggaacaagggtcctatggctggactgtgactgtgcaggagctaggcccgttcaggggcatcacctactttgcttacttgattcaaggctctcattaaagacattttagtagtcctgaccctagtatttctgtgggcaaggagagggctgaagaactgtctttgcaagctatctggctgcaaagtgagaatttgagtcctggcttccacatttactagctgggtgccatattgctgaatgtttctgttccccagtttactcatctgcagagtgagaataacttggagttacggagattacatacaatgatgtgcgcaatatttagcacaaaatgaatgctg

SEQ ID NO: 65630 - DNA, 1017 bp, Homo sapiens
gttgtatttaaacccatacctctctcttactcagcagttacccttttacttgttcatgtttttatttggtttattatgtagctatctggtgatgtggtatttatccagattcttttgtataatcttatccttgtctttcttaggttgtgagggagctgggagtctctcatccgcacttagtaaagcggagcctaagtggctgttcatttggtgctttaaatagtagttgtgctggttcaatctaagaagaagggggcccagctttagctcttttccttacttgggcacctcattcagttttgatgcccacaatactgagtatctcccttgccctttaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgtacatgcctgactccttcctgaatggctgggagggacaaaactaaggcagaggaagaggctaaaacggaacagtagaccctcttcctcatctttagtttccaacaaagacacttgtttgtaatctctgggtctgattaactgctggggaagttgcggaggagaggtgctaaaagg

SEQ ID NO: 65631 - DNA, 1124 bp, Homo sapiens
cgagcctttagagactccccttggacatatcctgggacgggagcccacttcctcagagcaaggcggccttgaaggtcctgactgagggtccacggtgtgattattcaggagggtccgaggagaatctgaagggataataataccgattgtttgtttgtaggatctggttctgctgccggagaaggcaaacccgctttgagtgaagaggaaagacaggaacaaactaagaggtacagtaacaacaatctcacgtgtctgagggtcgtcttccatctctccccagtacacgtctggtcaaagaaccttgacctttccacatttcctctttcttggcattttcttttcctttaatctactttgggatatatgtcgcctaattttgtttattgtaaactttacaccttcccactctgtccatttctcttgaactgttttccctcggcaacacaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccaggtctgggcaggggaaatgatggatagcagatgagaaagaaatcaagatttgctttgttgatgtctgacctaatttcttcttgtctacatttcagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtactgattctaattcttatcttcctcttgggacccctttgttccgtgttaaggtgcccagctcagagctttt

SEQ ID NO: 65632 - DNA, 1042 bp, Homo sapiens
ctctttggaggtgcagggcctgaaggccaggaggagtcaactccgcaatcagatgttacagaggatggtgagagccctgaagatccctcagggacaggtatggcgcagccaccacactctctccttcctgactccttggctttctccttcagtgtctgggtctgacccctgcattccccttttggctgcagagggtcagctgtccgaggaggagaaaccagatcagcagcccctgagcggagaagaggagctagagcctgaggccagtgatggtgaggggcatcctgcagcgtgacctgggtggggcccccggttaatctaatatcccatttgagattttgtttttccctttcctggcccaggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcttccttgactctgaaatgggttcagggccatttgaacaccctgtgtcccccatgcatctctcactttccgccattagaggggaggtcttcttgtccaggggaaggcctccagacctgggctattttaagcacagatgtttccattcataagcctaggaagtccaaggagggagaagctatcctggcccctagcaagctttcccactccctgcatgtgactttcatctcccccagaggagggggatggtgtagggcaggtctgcagagctgggagacatcattctggccccctctacacccctcccttcctcccttcctccctttctctgtccattgggaggcagaagacaggaaatgactgccatggatgtggtaggatttttaccaaaacagcattttgcggctcaggcccgtgctgttcgcagctgttttc

SEQ ID NO: 65633 - DNA, 1056 bp, Homo sapiens
ttaataatgtaagagaggacaggctgggccctggggacagcctcaccggcccataggccagagtcacagatggcccagttggcaacatgatggttcacttttggaaaagaaacgtgacacagcctttctgggaacagggtagccagtctgattcaggagagccaacaggatacccaagaactggacgtgagaggctctagccaccagaagggggcagcaccttcttgggatgacagattgaaaggcccgttaggctacccaagagggttgtggctgagtatttgggggcgttgcgggggctaagagggaggtggaatagagacagtacattttcaacaaaaaaatttttttaaagaaatgggggctacctttggcaggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtaagtgttggtggcctgtctgagaaggtgtggaggaagatggcaggatcagaatgggtagggggctgggtgtggtggctcaggcctataatcccagcagtttgggaggccgaggcaggcagatcgcttgagcccaggagttcaagactggcctgggcaacatggcgaaacccatctctacaaaaaaagtttaaaaattagctgggcatggtggctcacggctgtagtcccagctactctagaggctgaggtgggaggatcgcttaaacctgggaggttgagtctgcagtgagccaagattgcaccactattctccctcctgggcaacagagcaagaccgtctcaaaaaaaaaaaaaaaaaaaaaaaaaaaagaatgtctgggtagggattcctcaggagaaaacacccttggctttgaggtcacagacacatcaggataaagaagggaatcaaggccgggcgcagtggctcatgcctgtaatcccaacactctgggaggccgaggcgggtagatcacctgaggtccagagttcg

SEQ ID NO: 65634 - DNA, 1077 bp, Homo sapiens
ggtgtctccatgttggtcaggctggtcttaaactcctgacctcaggtgatccgccctcctcggcctccaaaagtgctgggattacaggcgtgagccgctgctgcttggccctggaatttacatttttatcaagctccttaagtctttagaaacactgaagtatgcaactatttaagtatctctagattcccatctaagaacatctgttgtaatgagaggacatacattgaagtcataggaagagaatgaaataatcctggtatcttgaatctcctggccacatttgttctccatctttgtaacagagagaagggtgcctgttctgagagaagggaggagggcaggagggagccctagggggcaaagaaggtgtatggatggactagtaagactaacttagcagagtatcctcctccaatctcatttaggaccgactgtgattcctccaccacctcactctgctccttccctgttgccaatgtctcgctgactaagggtggacgtgatcgggtgagtatgggaactagagagaggtttcattagagctttgatgactcaaaataggaagacttgagaaaggcctagagagaaggaattgagtaataagagactggccgggcacggtggctcacgcctgtaatcccagtactttgggaggctgaggtgggcagatcacctgaggttgggagttcgagaccagcctgaccaacgcggagaaaccccgtctctactaaaaatacaaaattagctgggcgtggtggtgcatgcctgtaatcccagctacttgggaggctgaggcaggagaatcacttgaatccgggaggaggaggtttcggtgagccgagatcacgccattgcactccagcctgggcaacaagaatgaagctctgtcttaaaaaaaaaaaggagactaagaggaaggctttgaaggaaaagaaattaaaattaattgtgtgtattgatggatctttctgcagcaggtgttagaaatgttctttctcaacatagtccctgacttacggtaattcaacttaagaatttttcaacttactgtggtgcaaaagcgacatacattcc

SEQ ID NO: 65635 - DNA, 1027 bp, Homo sapiens
tactacaggtgagaggggccttctatcaaaatagaggactcctatgggaattgtaaggcccttggagttcattcagttcaatcccctcatttacagataaggaaaactggagccaggtgtgcttccagggcctctcaactttcacagcccaaggctagatttgggttgccagggctagggttctagttctacctctgattactgaattctggttaaaaaaaaaaaaaaaaaaaggaaaaatatccacttctatcattatgaggatcaattctattttggttggatcacccctctctcagggccaatgtagaattttgagccaactcaaccctttagtgcagaaccaacctggctttcagtagaggagctattaggaaagcagcagtttgctttttacattactgcctctcagtccctgaaagtcggctacacaatagagattatggaaacataagatgagtaggcgcataaacttgcttcccagagagtcttgcgtcttgactggccccttaggttccttctcattttacaaaccctgccaagtgccaaattctctcttttttgaggtggagtctctctctgttgcccaggctggagtgcagtggtgcagtgtctgctcactgcaacctcccaggttcaagcaattctcgtgcctcagcctcccaagtagctgggattacaggtgtgtgccaccacatctggctaatttttgtatttttagtagagatgggtttttttttgttttgttattgtttttgtttttgagatggagtcttgctctgtcgcccaggctggagtgcagtggtgccatgtcggctcactgcaagctccgcctcctgggctcacgccattctcctgcctcagcctcctgagtagctggtactacaggcacctgccaccatacccagctaatttttttttttttttttttttttttttagtagagatggggtttcaccttgttagccaggatggtctcaatctcctgaccttgtgatccacctgccttggcctcccaaagtgctgg

SEQ ID NO: 65636 - DNA, 1642 bp, Homo sapiens
agcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggtaggggcccttgtggggacagtcagcagaaatatactggaaataggtgggctggcgtgaagggggcggggggatggattggttttaagaatttcattcattttgaatagattacttcccacgcccgcagcagtgtgcaaagatgtacacaacactggccttgcctctgaaggactttatctggggtgattagacgtctacaaaatagaagactgccaaaagctagtctagataatgtgctgtggggactctgagggagagtgtatccagttagggtcagaggaggtccacaatgctaccacgctgggaacagggcactaatctgcctgcgcaacaacgcaagaggcccaggttgccgcaaactgcaacatgctctaggcgaatgcccccgccttagatgcctacaggtcctaggagctgtgggcgataaaaatcagcgccagctggatgaccgcctcactcggccgcttcgcgggtgaaatggcctgtggtgaaggtgtgcacggagggctgtgattgcagtctcaagggagagccgagcggaggctgcagtcagcgcatcccctggggcacatcttggggcctgcagggaggcaggcgtctttcccctttggtcacggtaaccggagggaaacctgccgcagagagagccagtggcgagcgcaaggagacagcgacctcgcagctcgggaaggctccgccccgtcccgccccgccccgccgtgctggaccccgccctgggctgaagccccgcctcccacggctacaaaagcggccggcggagaggggcgggacttccccgggagccggaagtcccgtctcacggttgccctggcagcgcgcgaggctggtgagtcggcagccctgtggcagccggcgggctggtttccatggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggcaagtcgcacattc

SEQ ID NO: 65637 - DNA, 1028 bp, Homo sapiens
aagtggcgatccagacgctgatacctgtggcgcatcacattttcctggatatggaaaatggagggtccctgggagagaaacgaagattcaggtgctaagtgctgtgtcagagtagagggaggaaaggaggaggggggcgactgcccagctgatgtcagattttcaaatgagcagggtcccccgcagccagtacagactccactgcaggggccgtcataggcccagaccacgccatttgagagggggagtcggccttggcctcagctctgttggggaggtctctagcccagagtcaggatgcctgcaatgggggaggggcaggcagtgaactagcgacagtgggggtgtgcgcagggatgcaggcagctaggctcccccactggccaggcagttggtatgctccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggtaagtaatggcctgtttttctcctgttggggctcactggagcagacaggggtgatgtgccctcctcatcagggttggttgaggtcttcagagctgggaacacacatggtttgaagggctgaaaagccttaaatcatttgtgtaaggtttaatgatctgtggcccaggccatgagggagtttggggagcacctcatcccaccctatttttttccatgaggaatacagggatgagacagtccactggaggaggaggaggaggataggaggggaacaaaatattggggtatgaccacagccttgtaaaggttggtgtggagtgagcatggaggggggcctccagctgagactgtgctctgagaggtccctc

SEQ ID NO: 65638 - DNA, 1019 bp, Homo sapiens
ttggttagggcaggggcagccattttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttaggtataaaatcggctccagtcgcggtaactgaagccaagctccgcccctaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccaggtgagactgagagcaagaacctggcccatccctctccattgtctgagcaggtcaccgagggaagcgggcaggacgcgctggcagagtctgacggggccctgctgtgggtggagcaaagggtgcctcatatctctggggtgcttggggtcggccacaaaggtggtaggaaatggggtcgacagataggtgagggtgggccttgtgcttcagataacctcacatggtcaggcaagggttagggatgggatgcaaggagcctaaggggctcacaacaattactgacctaaggaagggcccaggagagggaaaagggaggagttgtgagaagggacaggggagctcagaggagagcacagaagaacttcttctcccggaaggggttctccgaagtgggcacaggggtgatgagggga

SEQ ID NO: 65639 - DNA, 2037 bp, Homo sapiens
ctattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcaccctatctcctgtggctgcactgactggggcggagggtgtcactgggttatttattcattttttaatgcctctttctcaggtcgcatgggctccaaccaaggaggactctcctcttgcatggtggctgccgttccctccctattctaccatgccttcacttgggagccagccatgcagtcagttgacatgggtgggtagttattagtctatttagtgcttgcttaggccaagagtcgagccattgaagtataggaaaataaattataactcacgacctctgtatttggcctatgcaaaaactagttggatgcttgaagttaaatgtacattgtggagccaaataagtatattcatgaataattactgctagggggaaagcccactcattcaacagaagtttgatgggggttattttccagtgaatctggagaacga

SEQ ID NO: 65640 - DNA, 1050 bp, Homo sapiens
atgcccggccatctctgagtctctttttaaaatgttatttcttagcatcttatctgaccaacaccagaactttctcagttacttttagcctctggttacctgcttctgtcctgatgagaaactttaacccagttcactcctaatttattatagatcacttaagaacttgtaaatctacatagccctttgcctgggtctgttacaatttagggaaaacttagagtagaaaaagttaatgtcattatttagatgcgagtgggtataaacgtagcacatttttgtgcagtaatagatgaggcatagaaagtcatatgcttcttgtagagttttcataatgagttcttacccatctatgcacttttcaggcccacaagcttctctcttactcttatagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatggtgagtcttggggacctgccagccccctacttcagtccattctttgtgcttagtacagcaagatgtgcaagggaaggccaaggaaaccaagtcaggtcattaacaatacggaagtgccttcttcatggagcttatttcttcctgtgttctttatccctgcctttttcttgtgctttttccataattcttcaacaacaacaaaaatcctcttttttaaaaaagagttacttttcacaaaagtatttgtttctttgaaaagcaatgcttgggctttctcatctatctagttttcattttaacatatgggttcccagtgtcactgttcctgtcttatctgaaggatttgtgcagtgaaatcaaattctcatcttcagttttcttgcttctgtgtcatttcgattaacaagaaagcgaatgctttattcagtgttttttgtggggggaagaacttaacc

SEQ ID NO: 65641 - DNA, 1876 bp, Homo sapiens
ggctttaacttgcaatataacttgtgttttgtttttttttttcacttcctctcaaactaatcagatgaagggtctcgaggagccagagatggaccccaaaagccgagaccttttagttcagcaagcctcccagtgccttagtaagctggtccagattgcttcccggacaaagaggaactttattcttgatcaggtattaatctgataaaattgcctagagtcaaggtgggatgtgtatataaagagagactgaattaaggagcagagtcagcttacctaattatgaccatctggttgtgtgttatggttgcaatgttttttgaactcagaggtacccctaattagtgtttttacttgaaaatatatggacccaggctataaaacatgtaataaagacaatggaaagagttggaactcatttgaattcctggctccaccacattctggtttgtgatcttggataagtcccttatcctttctgaacctcagtttccctgatgagcaaaacaggataatacctgtcatgtagtttgaaaagttaaagaagatcatgtgtattgaccctttatctcgtgtctaagttgtcaaagatactgagtcttttttttttttttttttttttttgagaccgagtctcgctctgtcgcccaggctggagtgcagtggcgctatctcggctcactgcaagctcagcctcgtaggttcatgctattttcctgcctcagcctcccgagtagctgggactacaggtgcccgccaccatgcctggctaattttttgtatttttagtagagacagggtttcatcgtgttagccaggatgctcttgatctcctgacctcatgatctacctgcctcagcctcccaaagtgctgggataacaggattataggcgtgagctgtcacgcccggccttttttttttttttttttttttttttttgagatggaatcttgctcagccgccacccaggctggagtacagtggcgtgatctcagcccactgcaaccaccatctcctgggttcaagcgattcttccgtctcagcctcccaaatagctgggattacagcacccaccatcatgccgagttaatttttgtattttagtatagatgaggtttcaccatgttggccaggctggtcttgaactcctgacctgagatgatctgcccacctcggcctcccaaagtgctaggattacaggcgtgagccaccgtgcccagctgatactgattcttttggttaaatctgagtgataattttcttcctaaacatcagttattcctcctgttcttagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaaggtgggtgtcttagtccattttctgctgctataacagaataccatagacttcataatttgtaagtaatagaggtttatttccctcattctggaggctaggaagtccaagagcatagcattagcatctggtgaggtccttcttgctgcatcattccatgtcaggagggcaaaaggcaagagggcacatgtgagagaacttgcttttataacaaagccactttcacaataatggcattaatctattcatgaggatggaatcctcatgaccaaatcacattaaaagtcccaccctctcaatactgctcattggggattaagtattcaacacttgtactttggtgggacataactcaaaccatagcagtgggctaaaattgtacaagttaaagagatcttatccctggtcagtgca

SEQ ID NO: 65642 - DNA, 1661 bp, Homo sapiens
gcctcccgaggagctgggattacaggcatgcgccaccacacctggctaattttgtattcttagtagagatggggtttctccatgttggtcgggctggtcttgaactcccgacctcaggtgatccgcccgtcttggcctcccaaagtgctgggattacaggcatgagctaccgcacctggctggggaagaaatatttttttaaaaagaccgttcatttattcattaagctactacctatgtatactggacttctgtccaatcaggcttttattagtgcaggtaggtaaaagcactgtgctttaacaagaaccttagtttcagtaaccaagaaattgatccctgtggctttaagttcagtgattgttattctgatgttgagttgaggtaaatgtcgttttcagtttgtataaaaatcttgtccttcgaactcagagtttgctactcagttggtcacaatatctaatagttccctttctgacttggccaggtaacccagaatctcccaatgaaagaaggctgcacagaggtctctctccttcgagttgggtggtctgttgatttttcccgtccacagcttggtaaagttatttctttaagttcctcattagtgtttactaccatattgcttactctatgggaagtccggttgtaggtaactaatttgttgactgttctaggtgaagatgaattctcttacggtttcgatggacgaggactcaaggcagaaaatggacaatttgaggaatttggccagacttttggggagaatgatgttattggctgctttgctgtaagtgctcctgaaagttgtgggttataacaaggagcggatagagggcactgggaattcacttgtgcttcccatcaactgctggcttttatgcatgtgatgtgtgtggctcgcttagttactttgtgcagcagtctgtgtgaaaaaagaataaattgtaaagtttaatcaacccaaagcctcgtcagccaataagtgctcttgtcccttgtcattgtagaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtatgccaaacagtatacgaacactgaggttgtatgctttgcagaggtgggtgcgtatgctctccagggtctcagagcgttaccaaacaggaatgggaggatgttcttaaattggttttgataaacatgaccctcatttatttttcattatatttctggttctgttttttgcaggtgattctgatggtgggactacccggatctggaaagacccagtgggcactgaaatatgcaaaagaaaaccctgagaaaagatacaatgtcctgggagctgagactgtgctcaatcaaatgagggtaagttgctgttggggatttgtcggatacagtatttggagactcttataacctatctttaatggagaattagtctcaagtgtctgagaa

SEQ ID NO: 65643 - DNA, 1774 bp, Homo sapiens
gggcctctgttgctgggtagaagttgaggcgttgaggaaaaaggagggcccggattacagtatttcttcgttctggggagcccttttgcttcctagccagaaaaacaattgctactaggcttacatgttgcaacacattctctaatgactttttttttgtcgttactgctgcaagcacagacagtagggaaaagaggctagcgacccctaaaacgccacagcaaatggaagtcagacggaagtaagggtggtgggaggggcatggcatcggggagctccgggcggctgcgcagaactccccggctggaagtactgaaagaccggcgcgcacacgcttccgtgctacgaggcacttgagctgcagccagccttgcccgtcttggactccactgcggctgcgcgataaaagcaccggcggcgattggcccgggggcgccagagggcgggaggaagcgggaggaactccgtcgtcctccgcgcgcgcctgcccgcggctggggaaccaagggcctggaggggaaacagctccctgctgcgttgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggtgaggagctggcagccgagcccggctccaacctgccggctgcgcccctgatctagcaccccgccctgcaccgcagggtccgagtccttgttctcgcttgcctcaaagtgccatttgatggaactcctttcattctctacccacctttctgaggggttaggccgcctctcgtggccctactctttgcaggaggaaggttcctgcctaacttggttccttggtgatagtggatggcagtgagtgattttgcatgcgaactacttgtgagctacctgtggaacagtctcccacggtgcttgttatatttttcttagctgagaaagtgctaagcaattggggattacacggagaactaggcccacagttagagggtcaggtctttgggctacctgacctaactttttcgccgtaaaaatgttaagcaaaaatcgaagtccgtcaaagtccgttccattaaaagcatgttacc

SEQ ID NO: 65644 - DNA, 1098 bp, Homo sapiens
ataaaataaataaataaataaataaataaaaattagcagccgggacagagattgttttttttcaattccaaatgttattaattaatgagatttactattgcatagaatggttgcgatatattcagatcttggagagattttaaaatgggagcatgttaacattctctcctgccacaaggtatgattatggtcttaactgactctaactgtttctaattgcttctccatcatcttccaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacatacatcagttgtgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggccagcggatcacctgaggtcaggagttcaagaccagcctgaccaacagggtaaaaccctgtctctactaaaaatacaaaaattagcctggcaagatgacacacgcctgtggtctcaggtactggaaactagacaattataaatgagccaggctgggcatggtggctcacgcctgtaatcccagcactttggaaggcagaggtagacagatagatagcttgagtccaggagttcaagaccagcctggggaacacagtgaaaccctgtctctataaaagatgcaaaga

SEQ ID NO: 65645 - DNA, 1025 bp, Homo sapiens
gttcaagtgattctcgtgtctgagccacccaagcagctgggattacaggcatgtgccaccacgcccggctaatttttttgtatttcctttttagtagagacatggttttgccatgttggccagggtgctcttgaactcctggcctcaagtgatccacccactcgggctcccaaagtgctgggattacaggtgtgagccactatgcctggccaaaagtaaccattttgtttaattttttctttttcttttaattttaagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggagtaaagcatttaagtatttatttaataaacccttcagacctcatgctaaagaaaacacctaagtgaacattttaaattttaataggtgcttatctatagtatcctcatttctcttaaaaaaaaaaaaaaaaaaaaaaaaaaaaaaaaagaccatcctggctaacacggtgaaactccgtctctactaaaaatacaaaaaaaaaaaattagctgggcttggtagcgtgtgcctgtagtcccagctactcgggaggctgaggcaggagaatggcgtgaactcaggaggtggagcttgcagtgagccgagatcacgccactgcactccagcctgggtgacagagagagactccatctcaaaaaaaagaaaagattatcacatcttctaaaaacatacatactagccgggtacggtggctcatgcctgtaatcccaacacattgggagtctgaggcgggtg

SEQ ID NO: 65646 - DNA, 1376 bp, Homo sapiens
aacctagaagccggaggttgcggtgatctgagattgcgccactgcactccagcctgcggcagtgagactgtctcaaaaaaaaaaaaaagaaacatacataatagagcagaataaaaacaaacctgtcctttacctgtcatctcatattttgcaagggctgaggtcctcacagagaagagaaataggctgggcgctgtggctcatgcttgtaatcccagcactttgggaggctggatcacctgaggtcaggagtttgagaccagcctggtcaacatggtgaaaccccatctctactaaaaatagaaaaaaataaccaggtgtggtggtgtgcactctgtaaccccagctactcaggaggctgagacaggagaatcgcttgaaacgcaggaggcggaggttgcagtaagcagagattgcatgccactgcactccagcctgggcaacaagagtgaaactccatctcaaaaaacaaaacaaaaaaaaaatgaggaagggcatttcttgcttagtgccttttaaacacctgatagaactctctggaagctgtgttggacatgggtgcaagttgcagtatggtgcagtcctggctcagtaggaggttccatcaaccaggagcccctttgttattctgtttctgttttttcatggtggataatgtctatgatgttgtgggtactacataggtgagactatatagcacagcctctacctttataagtggtggcaataagcatgtgattaactgtcatacaaccacagagcaaacagatttcagggaaaaaaaaacacactttagtcctttatcaataacgccccctttctcaatgggctagactcctctttgttcttccctatacctttaaagaatacaactatcagcttacaagaaaaacttttcctaagtccaaggacaggagaggcgcagtggctcacccctgcaattccagcaatttgggaggccaaggtgggtggatcacctgaggtcaggagttcgagaccagcctgactgacataatgaaaccccatcgctactaaaaaaaatacaaaattagccaggtgtagtggcacgtgcctgtaatcccagctactcaggaggctgaggcaggagaattgtttgagcccaggaggtggaggatgcagtgagccaaggtcatgccattacacgccagcctggtcaaccagagcaaaaccgtctcaatcaatcaatcaatcaatcaagtccaaggacagaacaaacaaaagtaaaataccttattcctcttctaagcttcttaaattgctaggccttggtttattgacaaaatattgtcatgattgcatgttttatttgctttacaatggtttcgtggtcttattttatttcaaacacttgatgt

SEQ ID NO: 65647 - DNA, 2022 bp, Homo sapiens
cattttttttctaggttggactcttcacagaaattgggcccatgtcttgcttcatctctcgacatgtaagtctgggcacactgggtggggctgaggaagacagatactcattcatcaccatctattgaagcatccatttaaagtgctaacctagatctcactttcctttcagtccatcccttcagagatggagtttgatcctaactccaacccaccatgttacaagacaatggatgaggtgagtggacagaaagaagtcagggagacaaggagagaatcagccatcctgagggagaatattggcctggggatggctgagtacagatggtccccgaattaccatggcttgattcatgattttatgactttacgatggtgtgaaagtgatgtgcattcaatatgcccccgggcttacagtgaagtgattgtgatgtaacttctcataaactgaggagcatctgtacactgttccctcctctcctcaggatattgtgattcagcaggacgatgagatccgcttaaagattgtggggacccgtgtggacaagaatgacattgtgagtcttttccccacctctctacctataccaggttgagctgagaactgtcgatttcttttttcttttttttttttttttgagacggagtcttgctctgtcacccaggctggagtgcagtggcgcgatctcggctcactgcaagctctgcctcccgggttcatgccattctcctgcctcagcctcccgagtagctgggactacaggcgcccgccaccacacctggctaattttttatatttttagtacagacagggtttcaccatgttagccaggatggtctcgatctcctgacctaatgatccacccgactcggcctcccaaagtgctgggattacaggtgtgagccaccgcgcctggccgagagctgtcgatttcttaccacccacagtttcagggggttctgtgctcttctgccaggaagaagggatggatgggcagaaggcctggggctgcagggtggaggttggttctgtgctcatcttggcttcactttctttttaccatctttcttgcagtttgctattggctccctgatggacgattacttgggtgagtgcctgatcataggtgctggggttattgcctggagaagggatgtgtgggggtggggagtaatataggattcaatgcccaaatcagagagacagaagaaactttcatgctgtctgcttgaaagatccaggacatttgccttgggatgaggagtacatggttgtggctaccctaaattccggttctaactgatatgctttttctggtttcgcagggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaagtgttatcttctttttttttttttagcaggaacaataactctttaaagaggctgtggagttggctgcttactagcccctctttttcttagactgatgcctctactagcctcagccacccaggggaactgactaacccatttgtccaggtttaaaggtgacctcactgaagtcaaggctctgatgttgggtctttggcttccagcaaatgataccatcattagtggcattctgggtcctgatctagttccagagtgtttgctcttctcctgcccttaaaagtaaccaagagcatagctgggaaagaagggagaggagacagcagacagggagagatgaataagaggctagtaatgacacagactgtaggatctcaacacagcctttcctaagttgggtatataaacaatagtatatcactatactaaactgaactgaagatgtaaaagggctcacaatctagttagggtgacaaa

SEQ ID NO: 65648 - DNA, 1001 bp, Homo sapiens
tgtctagcttcaccgttcttgacccactggccagtctgtttccttctctgagcctcactttcctcatctgggtactcagagctccttgtttagaaactccagagcacgagcagcaaggctggtgtggagggtgttggatcacactcctgggctctccgggaggctgggcagcttttccagtcttcattctccactcccagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcaggtacactcccctcaccccctgatacctccaactttccttgtttctgcctttttactaacctccaccctcgctgatttattcaagtgtacactgggtgcctgctccatacaacagagacagtccatgcctttacagaactctacttgtagctgtctgggcttccagcagacaaagcgcttgccaggcatcttcccatgtgctcctcacaacagccctgttgggcaggcagagcgggtagatactcacattctgcatgtgagaaactgaggtgttgacagaagatgtgacacccggggggtgtttttgtacaggagcagagacggaatctaggcttctgatccctaagcgtggtctcctgtttgccttctctccagtctggcccacttcatttggggtttcccatgccccctgcttcacatcctttgactctggcttttgttccctccctcccagaatagctctcagttcatgaagcacaccaaacgccggaagctgacggttgaggacttcaacagggccctcagatggagcagcgtggaggtgagtggggtgcaggctacagagggctcaggtggcatgaggccacttccatgtccagttcagggctggcgatgtggtgagacattaagaccaaacgctgc

SEQ ID NO: 65649 - DNA, 1042 bp, Homo sapiens
ttggagtaaaactgcagagcagttccagggggtgtccatggaattttctgggcttcagaacagctgtgaggtcaaagagacagttgtgagaaagcgtgatagtttatatccgaggcacacctgtgcccagtgccctgtgagttgagagcaactgatggggataaaaggaaattataggaccccgctgcagagggaaggtagtcagccccagccaggcttccctccctctcccattacctaattgtagtgttcaaggagatgatggagttgcagagagacctggtgccaaatcgaaggatacaggcagacaccaagaccaggaagacggctatagctgagatggccagtgcaatgcgcagccctatagcacctctgaaagggagagaacaagccttgtggtggaggtgaggctcatcctacctcagcccctggccctcagggttaggcagtcacctgtgggagtcctcgatgcagctgctgtagatccagaagagcaaaagcaggaggcagtagagggccaagaggccagaggccccagctacaaagtagcacagggatggtgctgagggacgggataaggccagggaggagccattcagggtggccacaccatacaggggacatctaccactgaaggagccctgtggagagaagctgctgagtcctagatttcaggttaatgtctctagatacagtctcttggtagggtgttagtgataacttaggaatggtcctgcattccaggaagttatttgtgcaccgtcaattcctatttctgggacagggatattgatggagagggcctgctggggaatcacaccggcagtggccagaaggatcagaaaataggcaatgaatatagaatgcaatgagcttcagagaagcctcacaagttatggtctctgtgcagaaaccttagagtaaacccaggccttgtatatccttcaacaaataactatctgtgaggtgctttttttttttttttttgctggagtgcagtggcgccatctcggctcactgcacgctctgccttctgggttca

SEQ ID NO: 65650 - DNA, 1105 bp, Homo sapiens
tgggtttactctaaggtttctgcacagagaccataacttgtgaggcttctctgaagctcattgcattctatattcattgcctattttctgatccttctggccactgccggtgtgattccccagcaggccctctccatcaatatccctgtcccagaaataggaattgacggtgcacaaataacttcctggaatgcaggaccattcctaagttatcactaacaccctaccaagagactgtatctagagacattaacctgaaatctaggactcagcagcttctctccacagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacaggtgactgcctaaccctgagggccaggggctgaggtaggatgagcctcacctccaccacaaggcttgttctctccctttcagaggtgctatagggctgcgcattgcactggccatctcagctatagccgtcttcctggtcttggtgtctgcctgtatccttcgatttggcaccaggtctctctgcaactccatcatctccttgaacactacaattaggtaatgggagagggagggaagcctggctggggctgactaccttccctctgcagcggggtcctataatttccttttatccccatcagttgctctcaactcacagggcactgggcacaggtgtgcctcggatataaactatcacgctttctcacaactgtctctttgacctcacagctgttctgaagcccagaaaattccatggacaccccctggaactgctctgcagttttactccaacctacacaatgctgaagtgagacccaaggataggaggaaaaactgacataaatatctgtagctgtgtgggtgctcaccagtgtattgtgagcttggcctaccagtgagaggagctgaaggggttgtcagcttaaaattcagcagttcagagtggtgtgtgggtgggaaggactgga

SEQ ID NO: 65651 - DNA, 2421 bp, Homo sapiens
cagctggcatttacgagtcagagttcttacagagctgcctgttcttccactccaggtgccttcaggacaacaactgggactacaccagatctgcccaggccttcactcatctcaaggtaaggtctggaaatacagtggcaaaaagactaggatctctgggcctccaggaggtcaggttagctgagtggggttgctgagtggcgagggtaggcctacctctactgaccttcatttttctccaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggtaagacgtgggctggcttcccactgtgacaacgtggggtggcgggacacgaccttccctatacaggcagggagagtcagggactccctatccgagagtggcgggcgggctttaccccacagaaatgtgaaacactggccgggcgcggcggctcaaatgctgggaggccggaggcgggcggatcactaggtcaggacatccagaccatcctggctaacaccgtcaaaccctgtgtctactaaaaatacaaaaaattagctgggcgtggtagcaagcgcctgtagtcccagctactcgggaggctgaggcaggagaatcaattgaacctgggaggcggaggttgcagtgagccgagatgacgccactgcactccagcctaagcgaccgagcgagactcccctctcaaaaaaaaaaattgggaaacagtgatgtctccgagcgccgtgccctgtcatagcctaggctgagggctgcccttcactctgcgaccttgagcaaggtccttaaagctctccatcttcccattaaaatggaaacggacatctattaaggttgttgggaggaataacaagattactgggtataacaggagctcagtactgcactccagcctggccggcagagtgagactcagtctcaaaaaaaaaagcgctcagtaaatactactttcatcccacaaatttcttattcagagggcactggaaaggtcggtacttagatgcccagtgaaaacccctcaccccaatctctgccctgcctgcaggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaaacaaaaaaaaacgccaatcttagaatggagtaacaaccagggtcacacaaggaggtcaagattcattaacaacaaataaaggagcagtcatccctagggcagctgcc

SEQ ID NO: 65652 - DNA, 2543 bp, Homo sapiens
ctggtttgcaactctaatcctaacactttgggaggccaaggcaggaggatcacttaaggctaggagtttgcacgcctctagtccaagctgccccagggggctgaggtgggaggattgcttgagctcaggagttcaaggctgcagtgagttatgattgtgccgttgcattctagcctgagcaacctgtctcaaaaaaatttttttaatttaaaaaataaattagtcgagcatgatgtcacatgcctgtagtcctagctacccaggagtctgaggtgggaggatctcttgagtccaggagtttgaggctgcagtgaactatgatcatgccacggcactgaacttgggtgacagagtgagaccctgtcccaaaaaaaaaaaaaaaagaaaaaattttaaaagattagaaaagatctcagagctaagcgtagggactgggggtatggggagccagctggctgtcttcaccagggtctcctccctttgttccttccaccctttgcagttgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctgaaccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggtaagtccataattttttcattctaacaagcacagcatctctcactcacaaggattcctggataggtttctttttctttttctttttcttttt

SEQ ID NO: 65653 - DNA, 1179 bp, Homo sapiens
agccttacttatcattcccttcttttctctttctctcatttctagattccttatggcagaaagtatgacaaggcatggctcctgagcatgattcagagcaagtgcagtgtgcccttcacccctattgaggtaagacaaggcctgagtggctggctggccaggcaccagggatggtgaaggggcaagctggactcccagcgtaatgcccctccccaagggctctggactcccagtgtaatgctcctgtttcctcttgtagtttcactatgagaatacacgggcccagttcttcgttgaagacgccagtactgcctctgcattgaaggctgtcaactataagattttggatcgggagaaccgaagggtgtgtttaaagggcctggcttggctggaggtggaggttggtgctcagagcagggactgggtcttgttcttgcggcttaggcttccctagagttttctgtgccctctgtgtcttccctccagatatctatcatcatcaactcttctgctccaccccacactatactgaatgaactgaagccagaacaagtagaacagctaaaggtgaggcaggctcaaattagatgtttccaacccagtcttactacttctcacacccccaccccccacacacaaacccagtgaccactaaacccttctttttcctctagctgatcatgagcaaacgatacgatggctcccaacaagcccttgacctcaaaggcctccgttcagacccaggtatggttgacagcagtagttctcagataggtggtgataaggtgggatctgtcagggagggaaagtttgaggatgttttactgctaatgctggcatgggcaaaccctctcagtcttccctttccttcccttctgcttcctgaagatttggtggcccagaacattgacgttgtcctgaatcgcagaagctgtatggcagctaccctgaggatcattgaagagaacatccctgaggtaaggcctttggcccagtattaggcatgaggaagcagggtgtgttagataggaagtggctggagggcagattcgtctctgatccacttgctggtggtgcctcctctaaactcttctctcctcacagctattgtccttgaacttgagcaacaacaggctgtacaggctggatgacatgtctagcattgttcagaaggcaccc

SEQ ID NO: 65654 - DNA, 1035 bp, Homo sapiens
taattagtcaacgttcgagctcacattctaattctcaacttcgtgatttgttaatccatcttataggcgaagaaagcgaggtatagacaaggagccgagctgaaacactggctagattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaact

SEQ ID NO: 65655 - DNA, 1094 bp, Homo sapiens
caaggacaaggacacatcctctgacccagtgaggctcccctgccctgatggttgggggaggtgggctggggtaggtgcctaatgatcacgctggggaagggaggattaaggactctggaacggactcttatctcctattctttacagctcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgagtgacaagagtgtgaaggagctgttcctgaagtcgagggaggctgaggccactgacgatgcattagagactagatggacttagggggcgaaggagggctgaaaacaggggcacatcgagccccccatagccctgtcctccatctgcccaccccaccaggtgcggaatgactggctggacttgcgggttcccatctgggaccaggacatacagtttctcccaggatcacagaagcttgtcacctgcacagggtaccaccaggtaaggtgtcacctcacacctgccttctcctgggataaagcagcctcctggagaaatggcccccacggtttgacacaactgctcttctcaccattctgagttcagaggagcaagcgcttccccgtctgttccaaccctgtccctgagcccatgaccttcctctactgtattctagggtggagtttcctgaactatgcctgttttcctcccacctggaagagaggaaaggagagtggatccccttcactgtgggaattatagggtgcaggtgtcagaggacattgggctgggtgttaagagaactgggttctggtcctgatgcagcctctctgatttgctttgggacccaggcctgagcctcccatctctggcctcagctcctcagctttacaggaagggcccgaatggggaatctttatggtttgtctcatttgaggtcttgagacacgggcggggctgggtcactgtatttgtcctattttctttgcttctgcacattgaagtctgatcttggtcatatgcctctgctcaaaaca

SEQ ID NO: 65656 - DNA, 1322 bp, Homo sapiens
cctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggtgggtggcaggctcgggcgtcgggaagtgcaggggtgcactcgcgcccctggcgtgactgacgccttcgtctctcaggggtaaatcttcagcgaaaacaggcggcgaacttcacggccggaggacagccgcggcgcgaggaggcagtgagcgccctgtgttggggcaccggcggcgagacccaggtgagtggcccctggtcgggccggagctgggggcctggggcgcagcagcctcgctctcctcgccatcttgcccttctttgccgcagatgctggtgggctgcgcggacaggacggtgaagcacttcagcaccgaggatggcatattccagggtcagagacactgcccgggcggggagggcatgttccgtggcctcgcccaggccgacgggtaagaccaatcccctcgctaaactcagggccgaagggagagcgttgatgctccctgaggatactggaatgatggcgacaggcaaactcttagtgacacggctttgaatgggtgacagggacctgggtttctgccttatgtagttcatacctgtaacacacatttattgaacacctactgaattccaggcactgggagaagtacaggggctgccggtaaaatttctgccttcaaaaagttctcatcctctaaggtttttcacctgactccattataatcctctaagtaaccatgggcaagtcatttaatagttttgtgtgtgtgtgtgtttgttttttgttttttttttttttggagacggagttttcgctcttgttgcccaggctggagtgcagtggcgcgatctcggctcactgcaacctccgcctcccgggttcaagcgatactcctgcctcagcctcccaagtacctgggattacaggcgtctgccaccacgcgcggctatttttgtatctttagtagagacggggtttcaccgtattggctaggctggtctcgaactcctgacctcaggtgatccacctgcctcggactcccaaagtgctgggattacaggcgtgagccactgtgcctgcttgtcatttaatagttttaagcaaggctgggtgtggtggctcatgcctgtcatcccagcactttggaaggccg

SEQ ID NO: 65657 - DNA, 3938 bp, Homo sapiens
ggcaactggcgcggaatcgacacgacggcgatcgaggcttcaggaggctgtagctccatggaggcggatcctgcacacaggtttggggtgtgtgggcaaggggcagctcagaacagggttagagggtaggcagtcgtgaccgtcagtccaggatcgccgtgaggcagtgatctcaccgctcctgccacatgcactgggtgagaaaaccaagccgcaatgcggtcggtgagccagcacgctcccgtaggacgcatgcgcgcctttttcgcgccgcaagttcaggtggcgctttgtctacgccctccttccctggaactctctacccacaactccccggggtcgcatgcggtcaacgtatgcgcgtgcgctcgccgtagccccgcccccaaatcccgtgggcctctgcggcatggtatttaatcgtctccccggggagattcgttctcatttttctactgctcgtggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtggagaaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccaggtaggtgtacatggtttatgctcttacagaggagaccttgtagataaccactccatgatgaacacaaaatgacaagcatatggctgaactttcaagtgatgtcatcttactactgagaagtgagagagaggtcttaaggggtctttgaatgactatttttaggtacataaaatgctttcctctgttgtctacagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatag

SEQ ID NO: 65658 - DNA, 1027 bp, Homo sapiens
cacaatcgctcaaaagaaaataaaagaaaaagacaaagtacaaaagagtaacagctataaagaccacgaagccacttaccacgagcagtagaaaaatgagaacgaatctccccggggagacgattaaataccatgccgcagaggcccacgggatttgggggcggggctacggcgagcgcacgcgcatacgttgaccgcatgcgaccccggggagttgtgggtagagagttccagggaaggagggcgtagacaaagcgccacctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggtactggatcccgggctaagctcgggaggaggtcccctttggtggggccatttcgggaaagtatgtcaggacgtaagtgcttcactgaagacaggatctgattttttcctaactggttccctatgtcctgccttctggtgcgttttctttagatcttggactactacgggccaacattagctaacatttatggagcaccgttttaagcacactatatgaatcgattaatccaccaaaatcccaagagctaggtaggatgacaacccccattttattgatggggaaccctaaagagctccggcggtgctgcctgctgcaactcctgcctgatcaatatggttgcagtcagctatagactgttttactgagaccggacaacattagttcagtcgtttgtggtaaacatctacgtgtacaagcacactttataa

SEQ ID NO: 65659 - DNA, 1134 bp, Homo sapiens
tctgtgcctccgcgcagtttcggctactgcatctgctcagcagcaggcgcggcctctgggaaggggcagcggagccccgccccggcccgccccttaaggtggaacctcggggactgccccagccgtgggcggctcagggtagtaaagtcaggaacacgcctccgacagtacttcctgcatggtccaatttctcatctccaacctgtctaaccctaaagttcttttcaacctgattctgggaaggcctggcacggagccacctttaagtggactaggcctgtgatcctgccccaaatcccgaggcccctccagtgtcctttaggccttaccgcccccaaacgcccctcttcttccattccggcaggctagtgactaccccaacaccatcctccatttgcccctggttcacggctccggccgccgtctggttttcccaactttgcatggctacttgcactctcagaggcagccagtcacaacttctgccttttcccccaccaaggcttgccctctcaggcctctgggacttggcgctagacctctgctagacctctgcttccgtgcacggcttactcccactcgtttttcaagactcatcttgaattcatttcaagaaattcctcatgcagcaactatttattgtgtactcactacaatactttgctttgttaactttattgaatttaacactaatccagccttcttcacagtactttaaaatgaatggtttgggcaggaaggttgaggtagacaccccccttcttatcctaccccacccccagctgctagcacctggatgtttggcagctaggaatcagacatccagaagagactgatagggctgtaatgaacataacagagctaggtctcagaggcatccaccttttttgtggaatagaccagaagatgccatggccagactcttacccaccttgcaggaactcccacagttatccccaaactcccccaaggtcctgtctccctatcacttcactatgttaggccttggaggcagctggtactgcagaggctttgaagaagcctagaattccctccacagggtccttggattgaagtggggcagagacagggttcacagcagggaactaccggacatcaacaccgtggggtgcc

SEQ ID NO: 65660 - DNA, 5710 bp, Homo sapiens
cccagaggcctgagagggcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaa

SEQ ID NO: 65661 - DNA, 2658 bp, Homo sapiens
agagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaatttctctccttcctcccctcccatgcgtctcctccaactccttcattatttatgtagggtcccagggccagaggagagggggcctcccaaagtcaacagcatggaggtgtcagggctgggaaagcacccatgcctcacccatgctgggccacggggctctctggacatcttgggtcttgccgactcttaacttcatccccttcagcaaagggctctagccaaacatagttagttttcctgtttttgcagacttggcctttcacggagagtaggggtgggatggtctggtttttaaaaggtatttctaaaggatactagaggtcatgcattcaagaatttgttgaacactcagcacataccagaaactgtccctgttctggggtcacagcagggaacacagtacaaaaattcctgcctccttggggctcataccctttggggagcaaagaaaaaagacacagctgttgtagtgcagaggatatggtgacagtgtttttatggaggaaaaagtaaagcaggaaaggtgtttcagggtagagggggccaaaggaggcctcaccacggaggtgacctgtgagtaaaggcctaataagtgagggagttcacctggtgagtatctggggaaggggcttcctgggactgaggggtgggagcctggctgatatgaatgaggaaaggagtaagggatgaagtctcatcggcaaggagtgggcagatcatgacagttgtaataaggtggtcacgtagggtgcagagagtttggcagcctacgtggttggagggcatggtccccacaagtctgttttcacttcaataccagctgcaagttcaggggtccccatgaccaccttcaggtaggtaatagactagagtgactcagaactcaggaaggtattgggattatggttttattacagcaaaagcatacccagagccagccaaaagatgagaggcctggggcggggtctgggagggagctaaataagaagcttcctgctatcttgcaatggagtcctggtacttcttcccggccatgacggagatataaccagagaagctcacttgatccttgggtgtgccgagtttcccctggtgtttaatcacatagtgccctgtggctgacctttaatcttcagcccctgtgagagctttgggctaaggcctttagttgtctccatttcccccagaggttgcctgttccaaagctcagatcgtaaatcacatttatcactgacactcctgttggtcaggacattccatgggtctagagggcacttaccagtagccgagggtaaaggccagacttccaagtaagaattcttcactacacatagagtctgagggagtggaatgggagttgttggagggttttgagcagagtgacatggtctcgcttggaatt

SEQ ID NO: 65662 - DNA, 1023 bp, Homo sapiens
aagtgctgggattacaggcgtgagccacgtgcctggctggtcctgcgtttattgtgcaagcagatctgcagtatttgctgttgggatcctgttgcagtactagtgatctgcgcaggcctcatggcccttggagttagttcggctctcttagttttcttacagaaaagaatgctggctgggtgcggtggctcgtgcctgtaatcccagcactttgggaggccgaggcagttggatcacctgaggtcaggaggtcgagaacagcctgaccaatatggcaaaaccccgtctctactgaaaatacaaaaattagccgggcatggtggtgggcgcctgtaatcccagctactcgggaggctgagaaaggagaattgcttgaacctgggaggcggaggttgcagtgagcaagatcacaccactgcactccagcctgggcaaaagagcaagactcagtctcggaaaaaaaaaaacaaaacaaaaaacgcgggtcactggtgcaggcttcacttcccatgggctgtgtcctggagtgggcctgggcctctgagggtttcctggtgtaggggagagatcaagacattaaaagacccaaattaaggcccaggatcctgaggctgtcagcacagttcctgagaagacactcagcctgctgggccttggcttccctctgcctagggtttcccttctctctcagcaaccacccccacacccgccccaccttctggctgttgcctgctctgggcctcttcctgaggctccccacccttccctgtccatgtcctttcccagggtcccagctccagccctccccctttcctccttcctctgcctcctggactcccctcttaacacagtttttatcttagtgctattatggatggagcctcattatggttatgtgcttatttaattttcatcttttcccccgtcctaaccactagaccaccagggagattttcacttaagaaaagtatagtaaggccaactggtggctcatgcttgtaatcctagcactttgggaggctg

SEQ ID NO: 65663 - DNA, 1032 bp, Homo sapiens
gggtgatgctatctggtctgaagctctgcaagggcaagaattacatccctagcatcttccaataaggtctatcagaaatgtccagtggcccaaccaaagcccatgtcctctcttttcaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagagg

SEQ ID NO: 65664 - DNA, 1058 bp, Homo sapiens
actgggactacaggtgtgcatgaccacacctggctaattttggattttgtatatagacaggagctcactatgttgcccaggctggtctctaactcctggcctcaagtgatctgcctgtcttggcctcccaaaatactggaattacagatgtgagtcaccacatccagcctcttttttatttttatttaaaaaaaattatatcatttttaattggcaaatcataattatattacatatatgaaaacaatgtggtgttttgatatatgtatgcaatgtgaagtgattaaatcaagctaattaacatcacttcatttacttgacattttttgtggtgatacttttgaaagtcacccttctagttatggtgaaataaacaatacatcattattcttgactgtagccatcatgctgtgaaacagatctcaaaacgtattccacccatctagctgaaactttgtaccctttgatcagtaactccccattcctttccccagccccttccccccgagcttttggtaaccatcattctactctctacttctgtgaattggacttttttttaaagataccatatataaatgagatcatgctgataaccctcttgattccttcctccctctcctactccacaatcacttgatcttcaagattctagctttttgatatttcttgaatctggattcttctatttccaatactactgccttagtgtaggcctcatcatcttgcacttagattaataatgacaactgatatttattgagggtgttctaggtactgggcactgttctaagctctttccatgttttaactttaatcttcacaataaccttattatgtaggtgctaatatcatgctattttacagataaagaacctgaggcccagatgaggctgctgcagcaacctcttgacaggtctactggacttcggcctcatcccttcctagccattctttccctgataacctgaagggctaaaacgccactcaaatcaggtgcctgtcttgcctaaagtgctcactggcttctccttgccctttcggtaaagataatgccc

SEQ ID NO: 65665 - DNA, 1113 bp, Homo sapiens
gcttcctttctcagcattacctgacctttgttattcaggtctcaacttaaacataactttctcttggaagactttcctaaacctataggtttttatttcatactaaatggttctcaaacatgaccacatggtgcaatcacttgaagacctttaaaaacttttagaaacctaaatttccctcttagaccttctcatatgattgttttagggtatactctgggcatggaggcttttctcaatttcccagatatttctaatttgcaatgacaggctgagcatcactgacctagcagaacattttaacatattatatataaatgcttgtttaaactttggtctccctgtgacttaaagcattataatagcaggatgccttctactttggaattcattactcaaaatgtgtaggtgtcagacatttaataaagaagcaattagtatttgctgaaagaatgaagactaaggacctacatgtgactgaaggctggaagcatgattattacttgtgttattctaaacacccaggtcacatactcatgagacgagaacagagcctcttacctcagtcacgatggtggatgagaaggagattctgtcatacacccagccatccacacagggctccatgtctgcgtcacttgtgttggggaaggtcccattcaggtgaaggagctgccactgaggatgaacaaagcgacgacacttctctggcctcatgtttgagtccagtgggatggagattctcaagagtgcatcttggctgagggccccagtgtcattgtcagagacagtgtcattgtccaggatgtggacccagcagcgatggccaggtatgaatgcagtgaagttctccagcataaaatgaaggtatgtagcaacagcaaagattgagagaaaaacagtctgaaggatctggaatctccacaggtcaccagcgtgacccaggaggtcctgaaaggccattgaggttgaacagttgatcctcaagtagaggcaaaatgactgtatccagagaggttcaaagagggaaaatgttttctttccctaagtcacactaaatgtgttttgatcctgaccccactctcttcttgacgactgtgcttcccctctgca

SEQ ID NO: 65666 - DNA, 1121 bp, Homo sapiens
aggttcttacatggctgttgatgcaaaagaatacatatttttttcagtgaatgattagcttaagatccatcaggctgttcacttttattattattttttttgagatccaatttcttcttccctggtcagtgtggtggttaagagcctgggctcctggagtcaggccaacgtgggctggacctggtctctgccttttgccggctgtctgacctcaggagagttagtccagctccctacactttggtaaagtacgaatgataatactcatcttggaggattaccttgtgaattaaataagagcatgtttattcttagcacactgaatacattgtagtagtaaaaatagtcatgattatcctcattttttttttttaaattatcctcctctttttttttttttttttttttgcttggctcatccattgcctggtcccctggcctctgtgggccacagccacttgaatgggaagacactgactaacaccacctataggaatcactcttactctcttcatactgctgataaccagctgtgcttactacaccaaccctcatgtttgttaggcggttcctatacctgtctacagtgggatattagttacctttgaatgggtatcctcttatttttttcttcgatcagttgggttattcatgttcaacaactatttatatatgaatgttaaaggtgatcaacttagaaattgagtaggtggtacatagctaactaggtaaagaaagggcaatattgccaatgtttgtgaagattgcagtctgttggtcatggtctggcttcaacttccctgagagttgataagagctttcttctggggaatcagtgggcagggccatgagaagaacttcattagtgcctgaatattgtcaggttaaaaaggtgatgcagtgaaagaaagcaggagaccaggggatggtggcacttactacatctatctcttggggataacagccttcaaaacatttgtgtcttgtttttcttttcttaaaacaattttattttaggccgggcacagtggctcgcacctgtaatcccagcactttgggagactaaggcgggcagaccacttgcggtcaggagtttgagaccagcctggccaacatggtga

SEQ ID NO: 65667 - DNA, 1589 bp, Homo sapiens
tgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttatctgtgttttctttctctgtgtttttaatatgggaggttctgtgaaatagtttggcttggcaaagtgaataagacttctgacgggatagtggcaatgtggtttgagttagctttctctgtcctacaaaacgacactga

SEQ ID NO: 65668 - DNA, 1081 bp, Homo sapiens
agataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtcctaaattcgcagcatattgtttcatatttatatgccatcttgcaaatagttcttgctattttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataattt

SEQ ID NO: 65669 - DNA, 2825 bp, Homo sapiens
ccagcccaaaaatagccctttaatgcaaaaacattccaacttagacatactgattgtgttcccctttggcaacttttttttttttttttttttttgagacagatttttacgcttttgcccaggctggagtgaagtggtgtgatcttggctcactgcaacctctgcccactgggttcaagtgattctcttgcctcagcctcccaagagtagctgggattataggtgcctgacaccatgcccagttaatttctgtatttttttttttttttttagtagagacagtgttttgccatgttagctaggctggtcttgaactcctgacctcaggtgatccacccacctcggcctcccaaagtgctaggattataggcatgagctattgcgcctggtcggcaacttctaattacatgctcttcagacataatttttatgtgattctcacttctcaccccctctagattaatttacttcattgaaaagcaagaactttgaaaaaattatgaacttaacgaaaaatgttcggttttgagtcctactggattaggaaagggatggtatcttttttatttaaaaatcttccaaaagccagtggcttggttatttatttattgggttgcttatttatttatttataaaattttttttggagacgaggtcttgctttgtcacccaggctggtatcttagctcattgtaacttaaaactcctgggctcaagtgatcctcccacctcagcctcccaagcagccggtgttacaggcgagtgccaccacacctgactaacccagtagctcttggacattgacatggtcacaagttttgtagatctttgagatgatacatttgtttttctgagtaacatgaacaggtgagttgggttagcagcttgtgaagccacaggagctgcctatcctaccctagccacagagcagatgttcccctggctctcttgggagttagctgctgccacagcctctctgtatccctgcattttcattcaactgctttctgtaacatgccgatgatggagacaggtttttgaaagtttaaggacttactttcttgttgctgtgttgtattttattaacttatatgttgaataaatggacttttgcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtg

SEQ ID NO: 65670 - DNA, 1008 bp, Homo sapiens
ctcagccttctgagtagctgggattacaggtgcctgccatcacgcccggctaattttttttgtgttagtagagacggagtttcaccatgtttaccaggctgatttcaaactcctgacctcaagtgatctgcccgccctggcctccgaaagtgctgggattacaggcgtgagccaccgcacccgtcccagtgtcactgctctttccaattgatattatcaccctggttttttaagtgtgcttttcagaggaagtgaaactagactttattggtcttagtcatcttttaaaagttaacttattaatacattgttaacatcttaaaacattctaatcctttcattatcttttcatgttttatttggcacttgtttttgaagagatcttttaacatattgtttctttgttctttttaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggtaagtggtgctgctgaagagcctgagggttgataatgggcagatatttgtgcttctgttgtaaaatatctcagtttggaagaatttcatagtgaagacatgagacagtggccactccgttggctgttgttttctgatagactgtatgttttattatccttt

SEQ ID NO: 65671 - DNA, 1028 bp, Homo sapiens
cactttttttttttttttcttgagatggagtttcactcttgtttcccagcctggagtgcaatggtgcaatcttggctcactgcaacctcctcctcctgggttcaagagattctcctgcctcagcctcctgagtagctaggattacaggcacctgccaccacgcctggctagtttttctatttttagtagagacggggtttcaccatgttggtcaggctggtctcgaactcctgaccttaggcaatccacctgcctcggcctcccaaagtgctaggattataggcgtgagccaccgtgcccggcttctctctcacttttaacaaccaatgttaaaagcactagactgggaagactgcattgtgtgttcaccttggttgaataaggctgtttggcttatttttcccttctttgtcgtcctgtgaacagatattgctggtgaattcaaagagcagttacaggcactgataccgtatgtattaaacccatctaagttaatggaaaaggagatcaatggctcaaaggtcacctgtcggggactactggagtattttaaggtaaatatgggttttagttattaaaatgtttgatttttggtaaagctgatctcactcgtaaatcaacttgaatttaaatattttgaaacttaaaaattttctgggggagatggtgagaggcattttcagagaccttggtgtccttccaggagtgggccattgggtggcagtatcggtctaagaaccaaatggatgttctttgcactctcttagaggagcaattagctgtgactaaaggaagattgttcctcaaggaagatggtgtggacaggaggtggttaggaagttgctgtgagtaggaggagacggcacctagatgtgacacgactacctcaaggcggatggtcactctgcccacaggtagtggtgaggccagcgtgcatggggagctggatgggaatcctagcctctgtaggcttgtgctgcttgagaacatttttagttaactaaaaatgctaacatgcactcaaaggt

SEQ ID NO: 65672 - DNA, 1054 bp, Homo sapiens
tagctagaatagctgctgagtttttttttttttgttttgttttgttttttgagacaaagtcttgtctacactctgttgcccaggctggagtgcagtggtgcgatctcagctcactgccacctccgcctcccgggctcaagcgattcttgtgccacatcctcccgagtagctgggattacaggagtgcgctaccatgcctgggtaatttttgtgtttttagtagaaacggggtttcaccatgttggccaggctggtcttgaactcctggcctcaagcaatctgcccaccttggcctcccaaggtgctgggattacaggtgcgggccaccacgctaggcctagaatagctgctttttgagaatacttttcatcagatgcaagatgactgtgttgtcagcataaagaaaattgttatcttcctacttactgtcacagggagacctaatacagtaactactgagttgtttagttggaaattaacacaggaggctttgtagggcacagtcttctttgacaccactaaagattgagtttgtttctgttatgagatagttcttgtctattctaattttaaaactattattttggtgtagccttcatagaaacatgagtagcatatagggtctgtacagcttgttaaagtgacaagtgtagcatctggatcctgctgctacttgtgtgaggtattttttgaaacactccatctttcagtgtgatggaaattgaaaccatacaaaaaggttttttggatatgtaatacattcacatgtttaaaattttaaaaaggattaaaaagtactcagtgaaaagtctctcttccatttttgtagtctttcagagtttctttagtatatgaaagcaaatgtgaatgtgtacagaatggcctgttatgtatacttttatactttttcactgcaaggttataaagtatttttcccatgctttcttgaaattttagtttcatttttcatattatagtctggttggtggagtattaaagagttcttatttgatgtgggctcctacctgctttttttcagtgtatagctgggaac

SEQ ID NO: 65673 - DNA, 1025 bp, Homo sapiens
gcttggcaagcagtggacctagaaccttttacctgaaaagcagtttcaagggagttttcagagctgagtagggagagaaagttaagtgtgtatgtgtatgtctctaggtaatatattgtttaggattataatgctccattattggttgtacttttcccaacctgaactcagatttgttcatcactgatagggaatgtgtccagtggaattcttaaatggaggtgttaggagagggtgaattagagtgactcctagtgattatccagtataaacacacacacatggcattcttccatagtttcagttttagtattccaatgcattgctttaaagttcattttcatttttatcattcagggagtaggcagagttttttaaagttcagtaaccctggcttttgaaatttgtgtcacttttggttgtattaatttcctgtggctgcctttaaccaattaccacaaactaggtggcttaagacaacggaaatttattcccccgcaagtcagggagccagaagtccaaaatgatggttggttccgcccggagactctgaaggagaacctgtcccacactctctcctagcatctggaagttgccagcagtccttggcattctttgacttgtacctttagttgcctccaggttctttgttgtcacatgaccgccttctttgtgtgttctgtctttttcttgtgagcacaccagtctttggatttagggcccaccttaatccagtatgacctcctttcagctaattacatttgcaagactgtttccaaataagattttctgaagttccaggtggacatgcattttgttggggagggggatgctgttcaactcactatacatatatgtagattatgaatggtttaatcactaaatattaagcgtgtcaagtttcatatataacatttataaaatagggaacaaattctgtatgagcaatctttagtctcataattatgtactatttggtttcctcatcaagatagagctatataaaatgcactggtaagtcttaa

SEQ ID NO: 65674 - DNA, 1030 bp, Homo sapiens
aaacttctaagacattacagaatagataaatctggccgggtgtggtggctcacacctgtaatcccagcactttgggaggccaaggccacaggattgcttgaggcctagagttcaagaccagcctgggcaacagagcaagaccttgtctatataaaaaaattaaaaaataagccaggagtagtggcatgtgcttgtagtcccggctacttgggaggctgaggtgaaaggatcacttgagcccaggaattctaggctacagtgagctatgatcatgccactgcactctagccttagtgacggagcaaggcccaatctctttaaaaaaaaaaaaaaaaaaaaaaggtaaatccttctactttaccccctttgtagaagctggcattatgcaaagatgtattgcagttgttctcttgaaaatgtgtttatgcatgttaaaatatgttccgctcttttcttaaatagacactgatgtttttggttagagattggagtttcccttatgaatatagctatggactccaaggaggaatggcatttttggataagcgtttacaggtaagtgggactataatcttctgatgaattatctcaaagtagtgatagctttctcatttgcttttggctattgtgtttaaagcaattattgaaaatgatattgaatacattaactatatatgaatcttaacacaagctaatatttattcttgacaagattaaagaacctgtatatacagtacacaggaactgtagaagaaaactctgggccagtgcccaagctttgattataatttccattttacattttaaaccaagttctatatgtgtctttagaaatcatactcagaattttagttatgttattcttcaaaatttttacttattttgggatagatataaacaggcctaacctgttcccccaaaccaaaacacaggaatcctttgtctgtcactactaattggttagatcctccttcatccccacaaaccatctcttgtgtaatactcattttaatgaaactcttatgcacct

SEQ ID NO: 65675 - DNA, 1975 bp, Homo sapiens
gtgggcctactctacactctggttttcagtttttattggagtcacaggtgggaatgcatcaaacaaaagatataggctctggaatgtacgggaaagagagtttccataatggaagcccaaagacatttctaccgttaaaatacataatctgccgaccctaaaacattcacataaagaggcaggagggaatactatcccgcagctccacgattagccgcagtcgtgggcggggattggggcttggatacgccttttgcgtctggtccccaagggacgctccccaaccctcggcgcgcgaggcgccgcgtgaggccggctttgcccctccttccctgcaagagcgcagaggagcggttcttgcgcctgcgccctgcgccgctgcgcgctttggcacccgcttggggccctttgtgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcgggtaaggcgcgcggggagcccccgccctgggaaagagggcgagcgggagcctgggggctggggggattaggaggcgaggcgggaggaggacgaattaccctcgactactgacggcttcagccccccggggacgagcgtttggaaaatgggcaaaggggaaggggaacgtaaggttgtgcaggcggtgaggaaatagcggggtgtgaggaaaacaggttgggggcggggagatagtccagtgggcgttaacgccaagactgggcaggtggggaaaaataccagctcgtgggataaaatggagagttgctcgatgcatatggtgaacctgggtgatttagtgaggattagagagattgaaaggatacgggcaggtgggtggtgggagaaacaatttgttactatttttgaggggatggtggtgaaagggttgcattgcaggtttgcagacaggtgttgacataatcaagcattcatgatagtcctccaaaatatttttggctgcccatgggaaggatgaggaagtttaatggaagcattgtagcctgttttttttgtttgtttgttttgtttttactgttttcggctagactccatgaatgccggatttttctgaggctccgaggtagaaggaggcgtgatgagaatagctcagggaagatttgggagggagctgctaatggtccaagatggatccgtggctgcatctgcaacagcctgctcttccctggcgctgcgtgggggtggggacacgcaatcagtcgcttatattctagaaaatagagtcatgctaagctatcaacatgttttgatttcatgttttctgtgggctactattgatcgaagtataacaaaggggggtgtttattgcagaaagggggagggggagaacattcagacaaagcaagggctggttgagtccccttctcccatctctgtgaaagactaagaacgaagctgcagacctcctttagtttgcattgtatacgcgtctgcctgctggtaagagctgcctggcaagctccccttatgcagaaatctgcagtgcagatgccttcttaaggggggaaaaaaaaaccaccatgggcaggtggtagttctcaaaggaacggagtctttgaagggaaaaaaaatgccttttgtcaaaggcagggccgtaaattcgggagagtagagataattttgctctctatttagttatgttaaaggattttgatcatttttttttaatgcttc

SEQ ID NO: 65676 - DNA, 1043 bp, Homo sapiens
ttgttgttatgaaagttggctgagtctggtggctcacacctgtaatcccagcactttgggaggctgaggtgggtggcttgcttgagctcacgagtttgagaccagcctggacaatagtggtgaaaccccatctctacaaaaagacaaaaaagcaagaattagctgagcatggtgatgtgcgcctgtggtcccagccacttaggagactgaggtaggaggatggcttgagctgggggcagaggttgcagtgagctgagattgtgccattgcactccagcctgggtgactgagccagaacttgtcttaaaaaaaagaaaagaaaaggaaaaaagaaaatcatgatgccaaaataaaactacattttatatgtttgttcatggaaattagctcaaagcaaaaacagcttgggcaattttttgaaaaaggttttgctttaaatatttctttcctcactcatgaaacttagttgttctgtgtactttttatggcttcattttcacactttgttctaccatattaatcaaatgtgaatatgtaatttgtgttttgagttaacccttaaataaaaaggaatgtggcccccgtccaacactgacatcatctgagtgttacattcgtgtcagattatcagtggcagtgtaatgtgttaaaacacagacttgagctccaggaatgcctagatttcaatcctggccctgtctcttaataattatgtgatcttgtgcaagtcctgagcctcagtttccttaacttgaaaattgggataatagtatctatcttggagttggtatgaaaattaaacacaatttggctgggcacggtggcccacgcctgtaatcacagcactttgggaggccaaggcgggtggatcatctgaggtcaagagttcgagaccagcctggccaacatggtgaaaccctgcctctattaaagatacaaaaaattagctgggtgtaatcctgtaatcccagctactcaggaggctgaggcaggagaatcacttgaacccaggaggtggaggttgcagtgagccaagatagcgc

SEQ ID NO: 65677 - DNA, 1112 bp, Homo sapiens
ctgggactacaggtgcccaccaccacgcctggctaattttttgtgtttttagtagagacagggtttcaccatgttagccaggatggtcttgatctcctgacctcatgatccgccagccttggcttcccaaagtgctgggattacaggcgtgagccaccacgcccggccaagaagtttttttttaatgctgtttttgtttattgtcaaattcacaagtaatggaaccactctgatcaaattaaacaaccaatctacatacatttagtaggtgcacccttaccctaaattgtcatttctaaggggttgttcattaagtggctggtaagaacctcagtgtttttattcttggtgttttaaagatgggctgaaaataaaaaccaatattactgcttttatcaaattatcctgtgaggaaataatatatttatcctgatataggagttacctgtctagtcctgtgcatgtttcaagccttgtaaaatgaagtttggtcatgaaggaattggtgacgtctggttgaagggaaaagggaaagttgagctttccaattttgtttgagtcaagagtatattttgcagaaagacacttctctttacccataatcctagaatttaccatttttgtaattctgaacagaattacaaaggcttcattaagtaagtaggttttctaatataaatgtgcatatttgttgtgtgcacttagcttatagtttgtgttaactttattgttgatgatgaatttagcctcctaaagtatacaaacttgtgaaaaattcatcaattttgtagtataactttttctcttaatttagctaatactctttgtattgttctaattttggtatatgtgctgctgaagtaagcactcatagtaaaactttttagacaaaaattagcaggtcgatattttgttcttataattgacttattcagaagttgcccagaaaactgacttaaccttctattctgttcatttatgacagctactagttgtagagttattttggatcatagggtatggtgttgatgttttgaaagaagtgtgtgtgttaaataagtttagctgtaatcagtattgcttgtgattgcatcattgaagtcttctgggca

SEQ ID NO: 65678 - DNA, 1045 bp, Homo sapiens
tcagccccctgagtaggtgggattgcaggcttgtgccaccatgcccagctaatttttgtatttttagtagagatggggtttcaccatgttggtcaggctggtcccgaactcctgacctcaagtgaactgcccccgcctcggcctcccacagtgctgggattacagatgtgagccaccacacccagtctcaaagaactattcttacctgttttctccaatcaactgatttattatctcctgtaaccatatcatcataacttaaccagagggaacggtgagctttttgacctgttcctcattggtagctcgcccttcaagatatatggaaggacattctggaaaaccttttgttatgaaaattgtgtcctgttatttgaacatatttcagtggagggcattgtctttattttacgtatgagatagaagtacttgattttcacgatatcttacatttgtgtactgctttatgatttaagttgtgcccatatgttaccttaattcaacaactgagcatacatgaaggctctttgccaggtgctgtggaagacagaaaggtaaataaaatatagatcattcctctagaggccatattctatagaggaaagacttgtattatgtttatctgtgaggtagacaggtagcgatataacccccttcttacagatggggactcaggcacagagagtttaatgcccacgctttaagatttgaagcaacatgtagtaaaagtggctcagttacccttttgaattcagtgatcagtttaatttaaaagtcttaatttctggctccacggttcttaagccaggtgcctttttatttcactgctctacagaaactttctagtcaagttcaccagatattttccacattgttaaattcagtggtcacttcatcctcctcttaacatgctttcacaacagcttttgacataattgattattctctccttgaaatgcttttttaatttgtcttctgtgacaccacatactcactctcactggcttttcatcctctgtctccataaaattcaccattttaaggt

SEQ ID NO: 65679 - DNA, 1001 bp, Homo sapiens
tccagcctgggcgggcgacagagctgagactccttctcaaaaaaaaaaaaaagaattccttctgtgttcccaaccatggcatttcatttagtccctcagtgatcttttacttctccagtctttaacatccaggcagatggtctcaagacctgtcttctctcttgtcagcagtcctctcattcccatcctcactgccttagtgcgagcccttatctcttgccaagattatgcagtagcttttcagttccgtccatgctctaccctgctgccagagttctttctaaaacacgtgatattgtcacacccttacttaaaaaccttcagtgattccttattacacaaaggatataatccagattacatggcatttaaagccatttggaatctggccaattgttccttctccccagaatgcctttcccttccttgttcacctcatgaacttaaatctttaaaaccaagcttaccacctcttctgaaacattcttaatttaccatagtggctgtctctgctgcattcccacaactcatacagttttactggtgcatatttgattttcagctacttgtgggcactgtattaccagtactaacacaggtcctggacttcgctacttaatgaaaatggtttcattaatggcatttgaggattaagatcattctggggttcagttccctgtgacacaaatacagaatatgaatacaatgtggttttgtaagttagaaacctcatggaatattgtaccagccattaccagttatctgtgttctgcatctgcataacaatttgcatgttgaaattttccattaggagggagtggtgttaggtgaaggtgaaaaggcaaacagctggcatgctcataggctcttctttggcattgggcttgaagtatttggtttttcaggtttgttgggatttaaacgcatcattggcagagatttaatgttgatagtaaatgcatgtagaaatggatccatctggaaacatagagataggaaaa

SEQ ID NO: 65680 - DNA, 1350 bp, Homo sapiens
gggattacaggcgtgcactgccacgcctggctaatttttgtatttttagtagagacggggtttcaccatgttggccaggctggtttcgaactcctgacctcaggtgatccacctgcctcagcttcccaaagtgctggtattacagatgtgagccaccatgcccagcctagaggagtataattttagaagatagatttctcatgtagtcctgtcttccccatggattaattgtgatttttaaaaaaatatttagggtcaactttgcatatttgccaattagatattttcaaatgcttatattagtgacttacctcctcaaaatgcatccaggaatggttaaaagcaaatattaattagtattcagatacttattttccccttcccacacagagtagcagagcagcagcatctgttcttgaggttgtgcttaatgtaaaatgctaggggttcctcttttctttttttgaaggtgagaatgtttgactaaaaaaaaaaaaatgaatggattaacttttagaaatgcatcttgaaaataaaataaggttttgctaccaggtgagtgaaaacaataattggaaataaagatttgagttttcctccttgttaaacccaatgaaattatgatgcttggctcttcctccccatcaaaaagaaagttaaagttaaaattcctgtgtgaggttgtcatattctcatgctgtatattttctttcagattcctttgtttcttcctcttcctctcagcctgtatctctattttcgacctcacaaggcaagtctgtaatttttttgtgtgcattggtaaaagaaaaatgttgagaaagaggctgtaactggggatacgaggcacaagtcttctattgccccaaatcccctaaaataaaaactaattacaagctgattctttctatttagcagtttccagtgggtttcgtgtaatggttaataaagtaaaatgaggctgggtggaccctgtaacatagcataaacttcaggagtagttttgagtatttctttaaaattaaaaacttgcccaccagaatttggagcagatagaattgtggctcagaggccaggtgcagttgctcacacctgtaatctcagcactttgggaggcaaaggcgggcagatcacttgaactcatgagtttgagaccagtctgggcaacatggtgaaaccctgtgtctacagaaaatatccgggcataggtggtgcatgcctgtagtcccagctactcaggaggctgaggtgggaggattgcttgagcccaggggctggaggttgcagtgagcgatgatcgtgccactgcactccccgctgggtgagagagcaagaccctgtgtcaccatc

SEQ ID NO: 65681 - DNA, 2002 bp, Homo sapiens
caagacagcatacacttattcttcctttttgcctacaaaaaaaattttttgaccaatgtagattgagaatagtcttattgtagaaaggtaattaagaatgccctatccgactgtgcgcggtggctcacacctgtaatcctagcactttaggaggctgaggcaggcggatcacctgacgtcaggagttcgagaccagcctagccaacatggcaaaatcccgtctctactaaaaatacaaaaattagccaggtgtggtggcaggcacctgtaatcccagctactcgggaggctgaggcaggagaatcacttgaacccgggggacagaggttgcagtgagccgagatcacgctattcattgcactccagcttgggcgaaagagcaaaactccgtctcaaaaacaaaacaaaagaatgccctatcctcgaatgggtttcatttaacctatattagtagcattttctcctgcaacaaacaaataaacaaaacacatgatggaaaagtagcccagtggggccctacgtcattggcagtctagaggttagcctgttcagttgtttgaaggaacaccttggcagatgattagttgttttctagggtagccaagactggtagcttccagtctgccttagtaaaaataagggaagaggaagctgttgatacatagttggttaactgtattaaaaccctgaatggagatgagggctctgggaacagtccacttccacacaggcctttgaaagtgactgctgccacctgcatgcactttgagtccgtcactgacactaacccaactaatttctttggcttcatataccttagctatctagccttagggaaattgtgtctatttttatataccccaatcatattaagcaatatgtagtaataataggacttaaaaaaaaaatagagacaaggtctcactagattgcccaggctgaactcctgagcacaagcggtcctcctaccttggcttcccaaagtgctgggattacaggcatgagccaccatacctggcctaaataggacatgttaagatttaagtgactttttttttatcctgaaatacatatttatcattattgggtttcaggtagatgcatgtataaaaaatgtcattgattcagactgagttaaaggcagttaaagtttttaaaagtaaattttgtgatatttactaagttgtactgctttgagaatacagctacataagctaggaagttaaacttctgatatgaatagatttctagttagaatgtcagtggaataatcagttccttcttcaataagttgtacccctgagtagtccttgtccttgcagtcttttgcttatggtttcctttttccatcaagcaacaattatatttcagcctaatccctgagagtttcaaaatagtggattacattttaatgatgttttcctgtacttcataaaacatacaaagatattgacagaagtatagatgtagtatgtggctaatttttattgaacttttactatgcccagtaaacttcacatgaatcatctcatttaatcttcataagcagttctatgaagggaagggactagctcttttaccaattgaaatgacttgaaaatggtgaaatcacttgctcaaggtaacacagcaagtaagtgatagagggaggatgccaaagccgtggtcataactgctgtacctataataaagatgatcaaataaactagctgtattttagggtttagacttctttttagagatggcattttgaagttaatattaaaatcatgacagcagaagaggcagataccattgttttgaccatattatcactattagtgatataatttagtatcatctggggtatatgctccctccaacaaaatcaaaatcaaactgaaattttgttttacttttcaaaacccttgagagtggaagctagaaaatactgtttctttagaaaacattggaagaaaagtaggtgaaaatgagattggaaagaggatccatccaccatgcc

SEQ ID NO: 65682 - DNA, 1017 bp, Homo sapiens
aactcctggactcaagcaatcttcccgcctcagcctcctgagtagctgggactacaggcgggcaccactgtgcccagtcttagacattgtagtttttttgtttttttttttatcatgttactttaaactccccatcttgctctgaaagataaaatactctaggcataaaagagagaaatttcttcctcaattcccataccagattttctagtcagatgtgtttttttccttattccaataaaaatgcagaattactgtactttagaattagtatatggaagtgtttaaagtaggcacgggaagaccgctcctgctgtatgccttggtactcttaagttgtgcaagcccatctatgtgaggagaagccgtgacagtggctcctcctgtgggatttttatgggactagagctctgaagtatggcccttatctttctgctctccaacacataccaaatgtattaaggctgtggttctgaaaccagtttcgttgcctgggaaacttgtaatacagattcctgagctctgtcctccttaggaagttctgaggcagtaaatcagagataaagcccatgaagaactagtagttgctcttaagtttgagagggattgtgaaaaattgtgccaaaggctgtctttgtgctcggttattaaattgttcagctggttgtacattgaactaaaatatgctttgaccctgctggtggtaaagatcatttgtgaaacattttgttgaggaaaatttactggctgggtgtggtggctcacatctgtaatcccagcacttgtgggaggccgaggcgggtggatcacttgaggtcgggaatttgagacaagcctggctgacatggcaaaaccccatctccgctaaaaatacaaaaattagctgggtatggtggtgcacgcttctagtcccagctactcaggaggctggggcatgagaatcacttgaaccggggaggtggaggttgcagtgagctgacatcaggccactgcactccagcctggtcgacagagtga

SEQ ID NO: 65683 - DNA, 1050 bp, Homo sapiens
ctcctgggctcaagcagtcctcccacttcagcctcccaagtagtcaggaccacaggtgtatgccaccatgactggctaattgtttaatttttttgtagagatggggtcgcactgtgttgcccaggctggtctcgaactcctgggctcaagctgtctccctgccttggcttctcaaagtgctaggattacaggcatgagccaccacactcagctgattccctttttagtaaatctactagatctatgactttatttgttaataattagagtagcaccatgtttttaagtgattagaactcttgaaaatgaatatccacactaaattccattatagcaaagaactaatttagaaaatgttcataatgagagttttgatggcgatttgttttgagtagtgttgaaaggctcttagagtgcatgtgaagggatgaatcttttgagaaaagaaagatagtagacattttctgagacataaaataatccagatttattccaccagacagctttacagtgtatagtattttaagagctaactgccttcagattcactggacttttctgtccttttgccaggtactgacttgggcaacagcagtgactacaagtgccatactgaccaattggaagagtctttgcttatcggagctgttctaaaaggcttattagtttttggtcttcattctatttaatgttttcatgcctttataaactttttacttccagcccaatttttcccattgtcttggtacaggtcagctgtgtccaagtttgttagggtttcagctagccaaaaatggtattttcatttgctgaaattctaaacaaaataattaaagttaaagcacagatgatgatgctaccttatttttctacatgtgggaaagcttgattgatagtaatgattagcgcctgcatctcacaatcactgagaaatgaatgcagcactgagctctgtttgccctctaagcttgtccccagaaaaaacaagatataccctaaatagtaagttataatatttttattagggaacattattagagttttttttta

SEQ ID NO: 65684 - DNA, 1148 bp, Homo sapiens
ggatctcagcatgttgcccaggctgatcttgacctcttggactcaagcaattttccctcctgtgcctcccaaagttctaagatacaggcatgagccaccacacccagcctagagaatccttaatgtttgaagtctgtcaggctatcatggtgctcagcagaggatgtgttagtattctgagaataggacttctaactttagttttacctgagattattctacacctaacttgaaacttttggagtattaaaggttcaaagaagttaagagaaaagcaaagcttgataaactgaccagtttgtgtcctgctaaagcatagacagttttaccatgctcttcccagtgacatgaatattctttggttagcattcaatttggttgctttcttttttgtttaatcaggcactgtcaccactgtattattgtcatcattttgcttattgattttgcttattgtctgccttcccctctgtgttgtaagctccataaaggcaagaaattttttctgttttattcactgctttaagcccagtttctaaaacagtgtctgacacgtggtaggcactcaataaatacctgttgaattattactaattcattttgtagactttcatctgtaagatgacagatctgaatcatctgaaatctccatctccataaaacatataagctggctgggtgcagtggctcatgcctgtaatcctagtactttgtgaggctgaggcgagcagattgcttgagctcaggagttcgagaccagcctgcgcaacgtggtgaaaccagctctctactaaaaatacaaaaaattagccaggtgcggtggtgcacgcctgtaatcccagctacttcggaggctgagtcaggaaaatcgcttcaatctggggggcggaggttgcagtgagccgagattgcaccactgcactccagcctgggcaacagaactagactctgtctaaaaaaaacacacaaaaaacacacaaaaaaacatataagctgaacctcccctgtggggtggagtcagtttgactcacctcagagttgtttgaagagagaggttcccaaacagttttaccataaccttagttcactgaatgttttgtggtagaaacactgactagtaagttcagtaacaatgcatggctcagatt

SEQ ID NO: 65685 - DNA, 2078 bp, Homo sapiens
aaaaaagattttggagggggtccacctttttcagtaccctttagtttagaacatcacagctatttatttgtacatgggacagattctccctgtggatagaatagaataattctagtctcatttttcagattcaggaagggcccattgcatctcctaaaaatcaaaaaagtctggccactagtttttttccttttcagattgtgagactaacagatttatagaggcagtctgtgctctgaattgttcagcttacagattgaagtctatcaaccctttatagtatcaggttatttgttttgtataaattattttgcttttgttgattagctctatcaaagaataaaaaacctcccaagatttctcaatcttaccgcccttctttatgctttctctgtacaatggaaaagtagaccaaaagtatttgtcatgaaaattttttatcatttgcagtttgtggcatgatatggcttttctgtttcactgttggcagttttatgcatgtcctgtaggataacttgatcgttttgttacatatttatgtgtgtatatatacatcctgtgtgtgtatatatatatttatgtaatttaaaaaataaaaagcatgctgcttggcttggctagctaatgtgtaattgtacctggtaaacaatttttttctttgaaattctgatcatagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaac

SEQ ID NO: 65686 - DNA, 1024 bp, Homo sapiens
gttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcaggtaaccatttatattagaatactgcatgtggttaattctgtgattgattacttatcagcgtgccatttatgttagtctgatttatacctacaaaattatggctaaaatacaaaaacaatatgctgtatgatgggaaaggcagattcttctcctgtctttttttaaatgattgcttgatttggtttccttaatatcaatatttcccaaagcagtagaccactttgtaacattaatcttcccctaaatattttttctatgctcgctgggtacggtggctcacgcctataatcccagcactttgggaggccgagacgggcggatcacaaggtcaggagattgagaccatcctggctaacacggtgaaaccccgtctctactaaaaatacagaaaaattagctggacgtggtggcgggcgcctgtagtcccagctgcttgggaggctgaggcaggagaatggcgtaaacccgggaggcagagcttgcagtgagatgagatcgcgccagtacactccagcctgggtgacagagcaagactctgtctcaaaaaaaaaaaaaaaaagaaaattttttttctatgctccagttatatttcaaggtacttcttttcttataggttgcccctaaggtgatattaggtgagaatctaatatcatcaggttcttactt

SEQ ID NO: 65687 - DNA, 1022 bp, Homo sapiens
atagctcttatactctagcatttgaagctcactgaatttggattaaagagtactaggttctaattcttgctgtgctgtgtctagaagtatgactttgaacaagtaacttacataacctttcgggggcctcagttttaatatctgtaaagtgaggatgtaaagtgaagtagatggtcttcaattatcatttaaataatatgattctctggctctggtacattctagatttcttcctcagttgtcataattcttacaggtagtaacttttgggcaataaggcatataggaattatgctacaagaactccagtgtctaattctggcaaattcctgttttagcatgaccttagatgactagtctaattggttcagcatcttcctttgttaatgtgatgatcattattttgccctgctttgtatgttgcagtaaataaagtgctgtgtaaatgctaattattagtgattatcaactgaattatttaatctagcgtgagagatgtaaagggctatggaagttcaggatatttgtcactgaccaaagtctatgattagtgtatgtttttagattgtaattaaagaagaccggtatagttagaccaagaagtttaaaggcctttcttgcagctttcaaaagtgaaaaccttttaaaattgtcttatttatgaataaatctttaaaaatataatccatttcattgcagtgaaataaataaataaaaacataaaccatttcagtaaaatgcatcagtgtctagttttatttatttatctttttttttttttttttaattttttgagacagagtctcactctgttgcccaggctggagtgcagtggcgcgatctcggctcactgcaacctccacctccagggttcaagcgactctcctgcctcagccttccgagtagctgggattacaggcgtgtgccaccacgcccagctaattttttgtatttttactagagatggggtttcaccatgttggccaggctggtctctcaaactcctggcttcaagtgatccg

SEQ ID NO: 65688 - DNA, 1022 bp, Homo sapiens
acccggctgttaaggaaatttaacagtaatttaggaaattaaacattgataaacagtacttttgtcaattatatagtacacatttaaattttgtcagttgtaccaatgatgtctttatagctgtgtttaccccttttccagagtccagtctaggatcacactttgtgcctcatcctgtctccttactctcctttaatctgagaattaagattaaaagaagtaagttcctcagcctttctctttcacaccactgacatttttgaagactataggccagttgttttgtagaatatttctcaatctgggttggtctggtgttttctgattagatgcaggttacatgttttgggcgggaataccatagaagtgatgttgtgtctttctcagtgcatgcactatgtctggaggcatatggtatctgtttgttctactactgatgacgtcggccctctaagccttctgtgttgaaactgttccttgtagttatatgaattctaacatgtatatgcttgaactctgactataggaattctcctacttacaggaattcactcttaagtaggcagtattctattaagttcttctgttcaatctcttagttcatcaagtgagcctgagttccctcccaattctttctctcctttgcagcatcactatctgggactctcgggttcccatcaggagtcataataccttctctttctcctagtaagttgcatcccttagccagactctttgaaccagtgattacttcttatatacaatcagcatatttttagtgttttattgaatcaagttaaggttctttggctctaggaaggttagtcttcaaagaaatggtttcagaagagagctgtatagctgaatgtggggaagaactaggtaccctcaagacaacttgaatcacacccagttcattttatcgcaaataagtcttttccgctaaccttatttgaattactgcatgtcatttacactgtcttagcctctttattccttaaactctaggaggtagatttcat

SEQ ID NO: 65689 - DNA, 1017 bp, Homo sapiens
ccatagctgaaataagctcttaaatttttataatcctatcctgaaacctaatcggtgtagcagaagaacgttttgcctcgtgagttatcacccctgacataatttgattttcatttataagattctcttagaaccaagtacagtggcacacacctgtagtctggctactcaggaagtgaaggcaggaggatcacttgagccaagagttccaggccagcctgggcaacatagtgagaccccatctctttaaaaaaacaaaaccagattatcttaaagtggggcatacctgtatttgtgtgctaatgtgaggctccacaggtatgcaagacatagtagctgtggatgtttcttataacttatattcccttttcttttgtcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaagtgagttgaagtcttaaaagcaacattctacattttagtggaagggttcactgaagctgataggtctaaaactcagacctgactaaaaatcaagaattatggggcctaatgcagctgattggtggcatgaagcatcccctagagaccttgaaatcaccttaagaagtggccaagttagaagccaagaactttttgacaaattagaggctcatacttgaagttcaaagagggagtccttcaaagaagactctaaattctttttttttttttttgagacggatattgctcttgttgcccaggctggagtacagtggcgcgatctcagcttatcgcaacctctgcctcccaggtgaaagcgattctcctgcctcagcctcctgagtagctgggattacaggcatgcgccactatgcccagctaattttgtat

SEQ ID NO: 65690 - DNA, 1034 bp, Homo sapiens
acatcaacagggccctgaaactcattattcgtctctttctggtagaagatctggttgactccttgaaggttagttgtttctgcagctcttggtggtaaaacagaaaaagcagggactgggttataatttggaggaaaaacagtacataggattttatcagacaaaaatgaacgtatgcttagctcagtcattctataatgggataggtgtcactagagaaaggtatagccttctgctggggaacaaatatcagaagagaggtgatataattggaagcagtgcagtttcagtctttggacctcagaaaactacagacttcactcacataccttcaaatgtataacacaagtagggaaccttcatttggaaattgtccatgtcacacatcactaaatttatgcagacttaattagctggaggagaatgacatcagttaatgtgaattttgccttacggttattcctgcttaacttttgatatggccttcacagctggctgtcttcatgtggctgatgacctatgttggtgctgtttttaacggaatcacccttctaattcttggtaaggtggcaaggagaatgtgcccatgctctttgaagtagtttgtaagaataagagtgaagagaaagcccagcatggctctactcattcttcattgcccagtcttgacccatagagacctgggagtagaggcactggaggaaccggagtttgtggtcacaggtttatgaaatggtctcagttataaattaagaaatatcaaaacagctggaagtaaaggacagttgtctagatttggtttacgtatggggatcttatttacagaaaccattttggtaatttggaaattgttatttgtggtacaaagaaggtagcctgtatacctgaagaggttttttttgttttgttttaacactaccttaaattagctgtcttaattgggagtgctaaccaggatttctcattttgaggaatgcctgtgttttcctgtattttttgaggaaaaatgtatatgttactctgagtcttaagat

SEQ ID NO: 65691 - DNA, 1061 bp, Homo sapiens
aggccgaggtgggtggatcacgaggtcaggaggtcgagaccatcctggctaacacggtgaaaccccgtctctactaaaaatataaaaaattagccaggcgtggtggcgggcgcccgtagtcccagctactcgggaggctgaggcaggagaatggcgtgaacccgggaggtggagcttgcagtgagccaagatagcgccactgcactccaccctgggcgagagcgaggctccgtctcaaaaaaaaaaaaaacttttaaaaactgggtgttttcattttctacactggtcagtcgtgtttaaaaaatggttaaactagacaaaagagccgtgccttcaggaaaattggtgatctgtatgttaccacaactgaatttattttccttccttaaagacccagattgatcactatgttggcatcgcccgagatcagaccaagtcaattgttgaaaagtaagtacatttagagaccacatcatcatgaggtatgcttccttccccccaattatctttagtcccttgtacaaaatgcagatgccaaggaaagtaattttcattttgataaaaaccttagttaatagtttcattttactaaaaattattatagctgcttctataaaaaggaaaaaaaatcctttatatctttttctggccctgccttctggacctttgtaggccaggcattttgactcacatctgtaatgccagtgctttgggaggccgagacaggaggattgcttgatcccaggagttcaagaccagcctgggcaacatagctaggccttgtctctactaagaataaaaaattagctgtgcatggtaacacgtgcctttagtcccagctactggagaggctgagacaagaggatcaatgggaaaaaaaagatcagtggaattttttggagacagggtcttgctttgtcacccaggctgaagtgcagtctcgacctcctgggctcaggtgatcctcccacctcagcttctccagtagcaaggaccataggctactctgcctttttgaactggcttttaaatgttcttcattacaggctgggcacggtggc

SEQ ID NO: 65692 - DNA, 1846 bp, Homo sapiens
acttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaatgactgtggcatcattctgctaactttattctttatacacagtttgggtaaagtaagaaccaaacactgcttccactccccctatcctcactccactttggggactttaaaaagtgactaatagttggtactcgtaaggattcccaagactgcagaatttagttgtacagcataactgtgcatttgatctctgaaagaaaataagagaccctctaag

SEQ ID NO: 65693 - DNA, 1072 bp, Homo sapiens
gcgctactaccacgaccactggcggctggagtacctgatggacttcaaccctgcccggcacggcatggtgtgcatggtgtgcggcagctccctggccaccctcaagctcagcaccatcaagcgccacatccgccaaaagcacccctactccttgcattggagtccccgggagaaggaagtcatcagcaacagctgggatgcacacctggggctgggggcctgcggagaggccgagggcctgggggtccagggggctgaggaggaggaggaggaggaagaagaggaggaggaggagggggccggtgtcccagcttgcccgcccaagggcccaggtaatgcaaatgcagattctgtacaggcaggggcctgggtggccagtggggcacagtgggccagctgctctgccaaggagctggtgttcttgagcaaggcactgctcctcctctgggtggggtctgtttattgcccttattatacaaaggtgggggaaggacagtggggtgagagggtctccgatgtccatgacagcttgtacattctgtggtttttgaagtatcaaggagagaagttgggtgacaggcagtggaaaggcttggagcagggaggcctggctggggtgggtgagggaaggggagggtgctggagaggtgtggctgacggtgaaggccagggacagggctagattccagtctgggggaggtgtgggtggtgcttgaaatgctagcagaggagggtttagggagttaggatttcaggagagaggaagagaagggcaaaggttaggcctggggcccaagtgagtgagaggcttgtgggagacctggctgtagtgggtatgctcccgtggggccagcgtctcagttccttccctccaaccctttcaggcaaagccccagctggtgggggctgccggcgccagcggcgagggggcccagtggcaccccgggctcggcgtctgcgcctctcagcctcccggagggccgggggcagcagggggctgggggcccggcgcctggagaggaggctgaaggagtccctgcagaactggttccgggccgagtgtctcatggac

SEQ ID NO: 65694 - DNA, 1436 bp, Homo sapiens
cgacctccaggagaattttaagggctctccgagcataacgcttccctgcccaccaccccgcttcattcccattcccgggccttccacttgcaggagccacaggtgtcaagttctggagagaagggatgaatgggactgcatacaacagctagtttggaaaagcagtgcagtgctagaacgagattagctttgggaggggatgggaggaacaatctcagaacactcgctctcccctcccccttcaccgatttctagtcctcaggagcttgcaaaccgtaagaaaacaaagagccatctttgtgggagacttaatatgcatgaaaatgcaaatatatttccattctcccaccccgcttttcttaggcgggatagtacccaaaagaggttgagagcagcaatgccattcattgaacttcagccgaacagaatgatgtctgcctgcactgcctgtcatcctttttggaactggaagggttataaaattcatgagggaaataaaggtcacctcccttctcggagcatttagtccaaaagataggttgttttcctacttctgctaatatttgttgagtgttcattgggcattgtcagaggctgtctcagttaatcctctcaaccctgcaagggtggccttatccccactgttagggcaggaatagacaggtgaattcattcaaccaatattcactggacgtctactttaggctgtttaggctagtgtttttaggctgggaagtagtagtaaacagagcaaccgaaaccctgctcttgaagaacatatatataccaatggctaaagacagagaaataggttcatgtatagtatgttgggtggcaataaatggttcagagatcactaaagcaggaaaaggagaaagaggaggaatgggtatttaattgaatatatcgagtggttcagaaagggttttctaataaggtgaattttgagcacagacccgaaggaagtgaggatgccaaccttgcagatatctgcaggaagagcatttcaggccgaatagcaagtgcaaaggtccggcagcacaagcttctggaaagatttcggtggagagaggaagaaagattgaattcaaggtttttggcctgagcaactggaggaagagccttcccattttccgagatggggaaggctgcggtgctcttgggagactgggagtgaaagtttgaatatgattacgtttgagatgcctatttatgacatattcaggtggagaggtcaactaagcagtcagatacatgggcctagatttcctggaagtatctagctagtggcgtaaacagaaattgccagcaggcagacagtgggaagagaaggaagtagagaagtgtctaaggactgagtcctgggaaactccagtgatggcaggttggagaccgagtcagtccctcatcacacattactaaatgccactgcatgc

SEQ ID NO: 65695 - DNA, 3118 bp, Homo sapiens
aaagtgtagaagtcagatttggatgaaatctattgtcagggattggggttctggaaagcttcgcagggatgatgttgcccagcccaattagggtggtctggacagatgtgcaaaggctggagacctgcaagaatgcagcctgttgggaaagtatgtgtagttagtcctaaggtccaagactagatcaagaggaagtatagacgcgagagtcgtgggatcccgggcacatcggctgtgttgagtgtggcgtgtgcctcatgggctccaggggaaggaagaagaacactttggccagaaatgctctcctcccccatcccactcaaaccactgagtctggagacgtgctaagtgttgttggttgtgggcacctttagtgataacaccctccccctctcccctcgcagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcaggtagttggtcctggggctggcgaagggagaagtcggacttgttggggcactagaagctcattgtgctcttgctccctgcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctggttagtcaacagagaagccagtgagccccggtggaggtgggggtttggggacagggtgaaatacaggccctgtgttctgggcaggtatcttcaggagccctggggtggcagggttcggggatggcctctttaaaagggtatgaggtcttttctttttgcagctgtccctgccacagagccaggaaataagaagccccgtggtcagagatggaaggaacccccaggggaagagccagtcagaaagaaaagaggcagacctatgaccaaaaacctggaccctgacccaggtgaaggggaggcccgggggaggcgtgggctctggccgcagtgctctgaggaaatccgcatcagtgaggatggagcagggcctgggcgcagggcgcctgcagctcctgaggctttttcactcacagttccatcccgtcctcccttccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccaggtgagccctcctgagagggaagcacagtagggacctcgcaggcagcgctcctgggccaggcctcagagaggctgctctatggcagagcccacagtaggggtgggtggggtgggtggggtgggtggtgctcaggtttcctggtacacggggccggggcaggggatctgaatgatgaggaaggctggcctgaaagctgagcttttctttttctgtttgtttgttttttgagacggaatcttgctctgttgcccaggctggcatgtagtagcacaagcccggctcactacaacctctgcctcccaggttcaagcaattctcctgcctcaccctccctagtagctgggattacaggcgtgcgccaccatacccggctaatttttgtatttttagtagagacagggttttcccatgttggccaggttggtctcaaactcttgacctcaggtgatccaactgccttggcctcgcaaagtacaccacgcctggcctatttttttattttttattttttgagacaagagtcttgctctgtcgcccaggctggagtgcagtggcgcgatctcggttcagtgcatcctctgcttcccaggttcaagcgattctcctgcctcaccctcctgagtagctgggattacaggcgtgtgccaccatgcccagctaatttttgtatttttagtagagacagggtttcgccatgttggccaggctggtctcgaactcctgacctcaggtgatccacctgcctcagcctcccaaactgctaggattacaggcgtgagccaccgcacctgaccaggtgggcttttcttagtgtttccttgtttcctggaattggtcactgggtccgggtaggccagtgtttcccagaagcctgatactgatttccacacatgcagtttgttctagctagagcctgaggggtgcccaccttaccctggtggagctgaggcccagatggggccactcagcaattcagttaggtgtccagagaatagataagatgagcagtggacagacacctccaggggacaccagctcagtaaattgcctcataacagcagtaagtgcttgtgttgtttgggctcctactgagtttaagaagcttacatacaaggcaagtcgtggtggctcacgcctgtaatcccagcactttggcaggctgaggcgggcagatcacctgaggtcgggagtttgagaccaacctggccgatatggcgaaacctcatctctactaaaaatataaaaattagccaggtgtggtggcaggcgcctgtaatcccagctacttgggaggctgaggcaggagaattgcttgaacctgggaggtggaagttgcagtgagccgagattgcgccactgcactccagcctgggcaacagagtgaaactctgtctccaaaaaaaaaaaaaaaaaagaagcttacatacagtttatttggcccttacaaaaataacttgtatagaagggcagatgtccattcctttttccaaaagggaaaaccatttctcaaagaaat

SEQ ID NO: 65696 - DNA, 1158 bp, Homo sapiens
aggttcacgcgactctcccgcctcagcctcctgagtagctgggattagaggggtgcaccactatgcctgcctaatttctttgtattttagtaaaggggttctccatgttagccaggctggtctcaaactcctgacctcaagtgatctgctcaccctggcctcccaaagtgctgggattacaggcatgagccatcatgcccagccctaatgtaacgtaacctttgcacacgtccctgttgcgtgctcgttttttatggctgcacgcagccacggcagtcctcagtcctctttcctctgcctcgaggcccagctttgcccattatgagtgccttctccatactggtaaggtggacacctggtcttggtgatgtaggtgttgacactcaggagataaagagcctggtggaagttcgccaggggtcttttctgtcccccacgtagtccctcatgagctccttggtgggcacagctatgccttagactgcttctgggtgttcccaccccatcacctctgccccactcaggcagaacccgttaggctaggatgcccagtaagtttgagataaaatggagttggctgcaggtaggagttacaggaagaggcacgagcaccaggcgtccctgtgccaaaatacacacaggaggaaggctgcctggcttcagctggcttgtccctagggaggctgtgcgcctcattttctagctggcagcagtcctcgatcacccaggagtggagctccctgccatccttgggcttcccctcatgccaggcactgggctgtggacataatgaaagccctggaaatgtgggtacagtttgcggagcttccagggggcatcctcgtggtggggtgtctggggggctctgactgctctctgctctcatccctgcccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagt

SEQ ID NO: 65697 - DNA, 1038 bp, Homo sapiens
ctgtgtttttctattttgttaccccctggccctctgtcacctgggcagttaggaactaaagagaagttctaggcagagtttttctctgcagggttgacccttttattacttgtggattatttgcttctgggggtgaaataggggttgagagggagggatggttgatttccatttcatcactgggtttggcagctggttctgcatgggacaggggtctttggagacagaggagcatgttctgtgtctcgcagtctttctctcccttgcctaccggctgtttctctctccttactgggaattgctttctctgggccctcttgaggttgcttattccacccattttcctctcacaacctttgttttagcaggtaaaccctgcttaaccagagaactttcccagactgttgatcgtgagctggtaggaggaggccaagtgactgactggcaccctcaggcatttggggagtggcgatggagtgcctactctcagtgaggctggtggggggcattgtgttcagcagagcagagtaacagactgcctcagtgtggtttctttgtgctgcttactacatgtaaatgtattattgccatggtatttttcctgtgatgtgtgtgttgatttcctttcttccttacatgcctagcatactgctgagcatatagtaggaattccaccgtagtgtgcatccactgattccatgatagcagcaatcagtgaccatttgggaatgtaagtaagctctttgctctttgataactttgcccagagcagtagctgcatacattgtcatcctgttaggattattaattacccatcctatttctactctttatggacttagattctccttagccccttcataccttctactgttgttctcagggtagccagtcactgtatcgatttaatattaagtctcattccagtaaaagcagggactttggaaaaccttggatgcacctattccagacagattcctgtattcttttttttttttttttttgagatagagtctcgttctgtcgccaggctggagt

SEQ ID NO: 65698 - DNA, 1003 bp, Homo sapiens
cgtttcaccatgttgtccaggatggtctcagtctcctgtcctcgtgatccggcctcccaaagtgctgggattacaggtgtgagccactgcgccgggcctgattcctgtattctttaaaacgggaaaaaagacaagcagcagctcctcaggtcacaaggccaggtatatcaaacactggcctccgagaatagatcatgccaccaagtgaaagaaacctcttcttggtcctgttgtgattttagataaagtagtcatggaagcttggtcattactatagtcttaatgttattttttttaaaaaggggatttagttgggctgatttcctcccctaaaggtcctctgtcaccttatttaaatttaaaactggttttaccagaaaataggtaaacaaacaccactggttgtctccagtctcttttcttgctcttcctctccctcttctttaaaaatgtggctgatgagaacctgtttccaggagccctttaatcactctgaaacacacagacactgaaaatgttgaagcataaaaataaaccttgcgttacagggagattgcctgtgtgctgtccacttcgcttataacagtgaaagtaggagattaaaaaaaaaaaaaagttaagccctgtctttaagatggtttttgtgacacctgattccagatgtgctttttcacagccatagacttcctgcttttgcagaaggagggttctaatctggggctcgtagcttgggggattcttagtttgtgagctgagctttttgttcacttcttttccaaatgactctgctggcctgaagcttggcagttgtgaaagcaatcagcaagatgactgtttgtcttccagccagcagcagcagtcacaggcaagcctggagaaaggtccagcttccagagttcacctgctagagttttccataacacctgggggagaggctactccatctgggacctgccccacctctgggcctcagaaactatgagagagggattgagagaaaact

SEQ ID NO: 65699 - DNA, 1972 bp, Homo sapiens
aggggagtttagaagtactggtgaagaaaacaaagttacaagatcctataaggaacagctgaactactccaaacactctcactggacccccattgttgattctggataaaaatatatatatatataaaactctttttttttttgacacagagtcttgctctgtcgcccaggctggagtgtagcgatgcgatctcggctcactgcaacctccgcctcccgggtcaagcgattctcctgcctcagcctcctgggagtagctgggactacaggcgcccaccaccatgctggctaatttttgtatttttagtagagacggggttttgccatattggccaagctggtctcgatctcctgacctcaggtgatctgctggataaatattttttttttgcttttggtgtaacttaggtagattggatcggctagctagcatctcagtccacactctgagctgtgcagcagtgtgccctggtgctaattctcactctgtcctttgattctggccagggggtccttggtggtgctgccttctggtcaggaatgtgggtgaatgtcagaccaaatagtgtcactttcggcttggccctagagatcaggaaggaagtgttgttagagcaagggctttgggagtccttggagttcgtaacctttgaatctgaaaagtaactgtacctagtaaattagaataatttctctctggtcaggcaccatggctcatgcctgtagtcctagcactttgggaagccaaggcaggaggattgcttgaggccaggagttcaagaccagcctgatcaataaagtgagactccatctctacaaaaaaatttttttaaatttagctgggcatggtggcacatgcctgtggttgcagctacacagaaggctgaggcaggaggatggcttgagctggggaggtcgagactgcattgagctgtgtttgtgccactgcacttcagcctgggtgacagagcaagacactatctcagaaaaaaaaaattacttttctccaatttatggacttcggaaagtagctaaacagatggatataagacagttgttgaaactcggcctgctgcagattaaaataaagtttgcacaaggataacttaatctttcagaccaaccaaagtttgggctggagatttttctcagcataaatgtcctaagcagagttggtgcctatgaggtaggaaaagattgagactttgcttgcctaagaggtttgcagggttcgagcttttgggagtcagaacttctcagactagattgtttcccctttggacagaacaacccaattctcagtgggcatttgatcaggactaacccaggccttcatgaactctttcccattgagcacttagccacctggctggcatttctcttctcccaggagcttccatgaggttcctacttatgtattatgtcgacttgaatgaatattttatgtctagagtgcagccaagcctcagactttgtggcccattatcgacaaatggggtagggggtgggcgccacctttggccccgtgatagcttctctgctaaatggactccccccagcagcactttgaagcccattaatggattggaatgaagtaacctcagcagatggaaagggtgaggagggtggtcatcttccttccctgagactgcctgatgaggctttcctacagtaaccaggacaagcccctattccctctgcttggttaagctgtggactggagctactaggcctctgctttgagaggaagtatagaaaggatttgattctcttttagccatggtggggccgccagtttccccactttcccatcaaagcaaaaattgagaaggatgtggaaagggtgggtggagtttaaagctggcccttcctccttcagtggaagttcagcaaaatgacaaaccagataggtggctaaatttccttctcttgatgggagattccagtatttgtacgttttgtgcttgtagct

SEQ ID NO: 65700 - DNA, 1010 bp, Homo sapiens
gaagtcaccctcttcccactgctggagagccaggctatccccaggttaaccctgaaagtgctaactcctgagcagaatgttactgccacccgcccccttcctttttgttataggccattgaaggtcattgctcgtctttttttttgagacagtcttgctctggtcacccaggctggagtgcagtggcaggatctcagctcactgcaacctccacctactgggttcaagcgattctcatgcctcagtcttccaaataaccaggattacaggtgcgcacctccatgcctggccactttttgtatttttagtagagatagggtttcaccatgttggccaggctggtcttgaactcctggactcaagtgatccgcctgccgtggcctctcaaagtactgggattacaggagtgagccaccgcgcccggcatcattgcttatcttttagactgagatagtacagctgattctaaacagcacccagagagaatctggcctcttgatttccagttgtgtctcagaggaggaggcatcccagttcctcctcttgccctctagacatctcctcctctgataagtataaataggctagatccctttatcttcatatctgtttttgtctggaatgtttcaagtttctcaagctaggtgtggtggctcatatctgtaatcccagcacttcgggaggccacggcaggaggatcacttgagcccaggagttcaagaccagcctgagcaacatagtgagacctcatttctacaaaaaaaaaattttttttttgagacggagtcttgctctgttgcccaggctggagtgcagtggtgcgatctcagctcactgcaacctccgcctcccggattcaagtgattctcctgtctcagcctcttgaatagctgagattacaggtgtacgccactgtaccccgctaatttttgtatttttagtagagatggggtttcaccatgttggtcaggctggccttgaactcatgacctcgtgatctgcctcagcct

SEQ ID NO: 65701 - DNA, 1144 bp, Homo sapiens
accccatctcaagataaataaggtttgtcagtccctgtggtggttctttccgcagatgtctgtctttgggttggcacttatttccccctacttgcagttattccttacatttctcattagaaaatggcaaaaagggcaaaagtaaattcatttcctttttacaccaaatcattaattttaggcttataaaactaaatgaacagaagatttggtaggagaggaggggagatggacactgatactggtggctaggtgatcctgagggacaactggtgcctggcagaaagagaggagggctgtgttcagtgactggctcccagccacctttttggcctttttctttttaacatgaggaaggcggagcagaccaggggcttctctgtagaaccagtcaagctggttttgggcagccttggcctattttcttgtgtgctctttgggaagttggcaatacaaaggtctgcctcctttggggctgtgttcgttgaggcgaaagtttggaagacaactatctgtcaacaacccccttctccccaaacactgaatgggtctctgagctggtccttcactccagggaggaggctttctctccaccctatgctgaacctgaaggcagctttgctttatacacctttcactgaaagctctaagacattaactccttttttggactcccttcccaattcacaacttggtgaaagaccctcagcctagccaggaggaagggactgggtctgcctttggctcctcatttatgggtctgggaggggatcaggactccttactgctatgatctggctgctaaattcagtgacatcccaggccttttttcgtccacgcaatgggactgtctgtccaggcctgctgggaaagaaaagagagaaaaaatagtttttgctctttggcagcttacagggacttcagccataggaaacaacctgtaggaaaggtgggagcttccggtcaccatgtgtgctgacacttcctgcaatagcactaggaagtctttctcagggagcaaggccagccaggtaggattatttcccagtctcccagctaagcaggaaatgccaaaatatgaacgtttagtaattagtgagtgtaactacctgctgacagagctccagcctagaccttgtccttg

SEQ ID NO: 65702 - DNA, 1892 bp, Homo sapiens
tgcctgcctatatttctgggttgcaaatgatggcggtggatgtgcagcctcatccgtggctagaaggccaaatccaaagtcaccagagcttgagttttttgagagttgagatctgtgtgtcaaaggggaagccctagggtggttctctgcagcaccaagagcagggattcataccatcatgttcctttcttttttcttttctcgtcttttctttcttcctttctttttgttctcatgagttctcactgtgttgcccaggctggtcttgaatatttggcctcaagtgatcctcccgcattggcctccccaagtgctgggattacacactcagccatgttcctttcttcaagtacggtattgaccctttggccacaggagaacgtgcccagtttttcttaaagaccacgtgggaactcagcagcccatgattgtaggttcctttttccctcatagagtggccttcaagggcaggttcttgttatctgcgtttcagagacccaaagggacacaggcatttctgctcctgggaatttgcggactttgaatcttgagctcagattttggtctctgttggttgcttgtttatcttcatctcttgtcatttctggagcctgcatgccttctcagagcagcaggtaagttgcttagttttttcacattgaagctgtggctgggggaaggtaacagtgtcccctcagaactcatggagatgccaggcatagtggaggctgaggcaggagggtcacttgaggctggaggattgcttgaggccagcctgggcaacatggtgagagctcatctctaaaaaatttttttaaaaataactcatcaggggctatttctttcattgtattttcctcttccttttgaacccctctgctgacttgtttcactttctttttttctgtttggtttctttgaactccctttcttcattatcatgtcctcattcccgtccatcttaggtttttcatttccttgttccactctccctaacctgtttctgtgccctgtttatggcatggctcaggatatgaattttgatctccgtctgagatctccttcaggtatagaatcccagaccacctggtccttttgttctctcattcctctgatttctgtacatttaaggattcactgctttagaaaactttttttttttttcttgtttctggagccacctctctcagtaaagccaggcttggcaacttattagggacagcattctggtttccctggtgacagggtttaagctgattctaggctgttgcctctaacccatcaggaatgccataagtatagaccctgtcttgggagagatctggagagatacttgagaattttggacactgtaatattgaatttggttctaattgtgatctagagaccctcagactctttcaggtgatgcacgaagtcaaaattctgttcatagtaacgttaacacagtgttgctttttcactctcattccctcaccagtatacagtggcattttccagaggctaaatgatgtgtggtaacatcacattcttctggctaatgaaatgtgtaattctgtattcttgtgttttctataatttttaaggtagtactttaaggtaaaaatatggaagttttcattgatggactcagtttgttcttagtacttctgtgctcttactaggtttcttcagttataactgctatcatctttttgtacacttcattactgtctaataaatccttattttgaaatcccagcattttcctggaacctttgagaaaatataagaagtaagtactacttgtaaaacttgcttgtaaaaacttttgggaaaactcctaattttaaaaattttattgacaacttattttagcactttattctaaaatagaaaaaaatttatattat

SEQ ID NO: 65703 - DNA, 1032 bp, Homo sapiens
ctaggtttgactatcctgctttgtggcacccatgaaatgttgggattctagaactctttctttgtaagcaccccactccccaccaaaaaaaaccccactaaacataagaagcttttgtctgtggatcttaactgtgtatattttgtctctaggaagcaaactcagattctctcttacaaccgtctgtgtgccacttgcacacacacaggcacagagctacttgcttgtagccttgactgccagcagccctgaacaccgtagctggtggtgccaggccttgtgtgtgtttaggacttgccagttcagtcctgggagctgaactctggacatcctgctgtgtgtctctttatcccatcgctggtgtaatttatgccactacttcctgtttgcatttgctcagtctctcctttggtttgcttctctctgctgaagccggtccccatagctgtgcacatggctagctatggggactaggcatctagatattctagacatctgcagttgtttcttagtgggaatggttgctttatgtctctctacagaattttagttgaacttgagtgtatgatttaatttacttgcttgtctaacttcggcaagggtgccttttattttaagatgccagcatggggtgagagtaaaggggtgaactattgccctcccccacccccccaccccccacccccccactttttttttgagacagggtttctctctgccacccaggctggagtgcagtggcgcaatctcagctcactgcaacctctgcctcctgggttcaagtgattcttgtgtctcagcctgctgattaactgggactacaggcgcctgccaccatacctggttaattttgtatatttagtagacacagggtttcaccatgtgggccaggctggtcttgaactcctgacctcaagtgatctgcctgcctttgcctcccaaagtgctgggattacaggtgtgaaccactgtgcccccccgccccacaccaccaccactttttttttgaaacaggatcttgttctgtcaccc

SEQ ID NO: 65704 - DNA, 1005 bp, Homo sapiens
gcaaatgttttgcgttttttgtagagacagggtttccccatgttgcctttgctggtcttgaactcctgggctcaagtgatccgcctgcctcagcctcctgaagtgctgggataccaggtgtgagctaccacagttggccaaggtatagttttatgagctgagctatagaactggttgaatgggaattagggaaaacagacaaccaataattgggaagtaaaggaaaaatatataagtgtgcctccttggtcacagctagccttgtgacattggggttttggatatagaacttcaggaatcccttccacctccttcccaagagaatttcttctgttggtgttgtaaggggctttttccaacttcatttccattaccaagagtcttgagtggctttattttcaacttgggttttttaagcgcttctcatgtcacctttgtttgtgtactgggcctgtctcaagtttccagagggagatgaaagacaagaaaagctaaatgactggttcttcagtgagtttcccagagtggcttcttctcattccagcactgcctaactctcaccatggctgacgccgtgggcaggcatccgcattcatggaaagccaggtcctagctggaagtgacacagggatcttcagatctctcttagcccactgttcctctgaaaaaaaaacaaaagccatagacagtaaattgggggaataggctgaccataacttcagttcgtggatttgggtcccacactggattgtgtgatttgtgcttatctcctactagattgttaccttctttgaaggctggactgtatcttatccttctctgtatcacttcggacacccagaaactgttggagtactttgcacatggtcacctcttaatgaattatttgtgaaacaaaaatttttttaaattgtaacatgaggctgggtgtggttgcttaggcctgtaatccccgcactttgggaggtagaagtgggcagattgcttgagtccaggagtttgaga

SEQ ID NO: 65705 - DNA, 1059 bp, Homo sapiens
gaggaaatcgtctggcttcctggagtggggaccagagccagagagccaagccctcctggctttgctgagttctgtccttgcccctgacaccaacgtgtctgcctgcgttgttgctcctggttacagtgggctcagtcttgcctcttttttgatgggtgggcagaggaacactagtgttgggaatattgtccagcgttggagagatcatgtggtctgtcagaaggctggagttatttatagtgggagaaaagcccaggagcatggcacgggaagaactgatttcacaccagctcagcgcctgatgatggtgaggacccagattttcctttgagcatctcagagcagatcagtcgcttttcctgattgacccatgaactgtgagactagggaccatgttttccgaggccactgtgagtgagggaagagtgagaaggatgaccattttcttcttccttgattctggtctttgtgatgtgtggtatgaaagtgtcatctgacttttgaatctccttttattgaactggtgaagaaggcaccagctgtgtggggtggtggaaataaggacctgttaaactggtctgcctgtatctgcctccctgctcccccctcaccccacccacccccaccctgggcagggaggctgaaactgctgcttgctaggctttgccaactcagtttctcttcatggattacctgctcgcggcaggcaggcaggcagctccccacctggaagcctgcagactcgccgagctgagagaatcatgctgcaggtgggggcaagtgctaggaactaggtgtgccacttaccttaacaggagctgtgcctagtccgggctgctcaaactaaggctgcagagccctggggcctgttggaaatagactgtgcctttccctgcgccttgtggccacatttttatggtatgtggagagtctgggaggggccgggagcttgtaaattgtgagtaaatgaagtctagggagggagatgatccttcttgagggcaccctgagttcagggttgtcatgtttctgaggtgtgctactgcttagtaccctgat

SEQ ID NO: 65706 - DNA, 1039 bp, Homo sapiens
gagttgtgaaggaggccgttcagcaagcaatgaagtgctagtgcaggaaggcccgagctgggaaatgtccggagagaccctgtgaagtgatgcagggatcaggaaagcttcctggtggaagcaatgtctgagctgaggctcaccacaaagaggaatgggagtgactgctagagggaaagtgttccaggcagtggaaagctgtggccaagacctgggggggtctgagaggccattgtacatttgaagacaggtggctggaacccagagtgagactctaggaagggaagagagttagtctggagctgcaggcagggaaggggagacagccagctcataatacagtgtgggcaaaaatccagaaaccatgtggatctaatttgatatcaattttacatgtatatgtgtatatacctacacacacatacataaaatcagttatgtttgtgtgtgtgtatatgcatatttgtgtgtgtgtgtacgtgcgtgcatacagaaagttgtttttttaaggcatgctttaaatacgaagccatcacttccttttcccagtcctgggtgccttttgagatgagtgttggtgctccccccaccgccatgtgccatcttctggagtaagagggagtgctttcactgtgtgcaggtgtggctaaagagtattcactgtgtgcaggtgtgggtgaagagtattcaccgtgtgcaggtgtggctgaagagtattcaccgtgtgcaggtgtggctgaagagtattcaccgtgtgcaggtgtggctgaagagtattcaccgtgtgcaggtgtgggtgaagagtattcaccgtgtgcaggtgtggctgaagagtattcactgtgtgcaggtgtggctgaagagtattcactgtgtgcaggtgtgggtgaagagtattcactgtgtgcaggtgtgggtgaagagtattcactgtgtgcacgtgtggctgaagagtattcactgtgtgcaggtgtgggtgaagagtattcactgtgtgcaggtgtgggtgaagagtattcactgtgtgcaggtgtgggtg

SEQ ID NO: 65707 - DNA, 1486 bp, Homo sapiens
ggcactgtgaggcttcttcaggcccaggagtcaggcccactttcccttttctcttgagggaatgactcagagaacactcctgccaccggaggttctgcaggcttttgagaggcagccagtggaggctgatggtagcagttggtgagaaagaggaagtatgtagtggccattcctccggccactcctgacaaatatttctgtcactaaacagcacctctctgtggcagccttgggctgtgttctggaaagggaggagctttcctctccctgtgggagggcctgtcatctgtggcttctgctttgcccttggccacagactagattgcacaacacagccaatgagagtccctcttccctcacaagtgcttggagtgcagaccttaacttacagggttgtagaagtgaccgtgttccacactgcagggtccaggtcacagccggcaaagcacatgaaaattgacctaaggttagaatgtgattatcctactgggaaaggtttactgggacagcatttcacttctgactccataggctgtcgtctcctgccagggagtgagttttgtttccatgcttgtccagtctttactgctttcccagaggccataaacctgccttttcccagaggccataaacctgcccacctcctgctatgttctagttctgataggagtaccattcagagttcttggcaggggaccaacccgcttctaccgtggttggtttcccctccttttcccagcttgtttgatgtgcacgttctccaaaattcttatgcagctggttggctctgtagtgcccagagattggagctcctgcaacgggaaccccgccgcttccctccctggttttaggggcagggcttgaaaataaagaatcataatctcccttcctcctcctcctcctctcccccacttctccctgcccccacccccacccccacccccaccctgccaggcaaactggagtgaccagctcagagcgggactcagtccacctccctgctctgcatgtcagcagtgatctggaggagattccggggcgcatgagtatgtgaactctggagcacgttactgtcccgggctggcactctgtggcaggtgtgtgcactcattctgctgttactggagaccagtctccttaggggtgatggtgacccagctagatgtctgccaggtctgtccaaggccaccctgttctctaatagcttgggaaatggaaagcacttctaaatacccctgctcttcagaagagctggctgggtggtttggggagtttcttctttgaatctcttagagtacaatatcccttttttcccgaaagccaggttctttagttcctaagctccattctcttgttgctaacttactaccttcagttttcttaggttgggtgcatcttccctggcctcaacaagacagtggctgaaaggtcaagagagtggtagctgctcctttgagagaaaggggatgttggagtgggagcacag

SEQ ID NO: 65708 - DNA, 1021 bp, Homo sapiens
cggctcgctgcaacctccacaccccagattaaagcgattcttctgcctcagcctcccgagtagctgagactgcaggcatgcgccaccacgcccagctaatttttgtatttttaataagagacagagcttcaccatgttggccaggctggtcttgaactcccgaactcaggtgatccgcctgcctcggcctcccgagggactgggattacaggcatgagctactgtgcccagcctgaagattggttatttaggggctgtgacaaatggttttgcagaggagcactggaaagcctgtaacttcacagagccaggggtcagcttttgtgccatagccttatagcttctgtggcctgtagtgcctgaggccaggggatcaggtgctgaccacctttccctcttccttcctgtgtcttgcggccagcgactgttattgtcaggttgaccctctggttagagaggatgactttggcctggtgtccagactccctgctgccttatcccctctgccctggaactgcacctaaaaacaattactttcctcctgattccaacataagtggtcacagaaagttctgttttggcattttgatttctgattgggagtttaggcatctgagaattgaatgcttgctttatacaaatatacccttaagacatctcctcttttttcagccctacatgctttgcttgggtattaattgaacttggggctttttagggaccttatgttgcctaccttcctagtttcccctccactccacccccaaaaaacccaaagaacattggaaaaattgagcagtgcctcaaggtcacttgatcataagtggtatttggcatagttaactggtttggtgtttggtgagagatttctgctttatatttgagcaaaaaatttcttggcgggaggcctctatgctgtgttgccaatgcttgccctgtgcgcagggtttgccccctcccctcccttgacaggttgttctaatccccttgtctataaacaagtgcagcagaacttgtcggc

SEQ ID NO: 65709 - DNA, 1045 bp, Homo sapiens
tacctgggactacaggtgcccaccaccacgcctggctgatttttgtatttttagtagagatggggtttcatcatgttggccagtctggtctcgaacgcctgacttcaagtgatccgcccgcctcagcctcccagagtgctgggattacaggcgtgagccactgcacccagcccagactcttttcataggatgctgaaaggatgaattaagtataaaaagtgccttttggccagatgcagtggctcatgcctatcacttgagaggagcttgggcaacatggtgaaaccccatctctacaaaaaatacaaaaattagttgggcatggtggtgggcacctgtagtcccagctactcagaaggctgaggtgggaggatcacctgagcctggggaggtcgaggctgtagtgagccaagatcgcgccactgcactccagcatggtgacagagaccctgtctcaaaaaaaaagtgctttttaataaggtacacgtaatggaaaatggctgtcatctggtttgccatactctgctcctaggtagaaagtacaaacagcaagggccccttggagcaaaattgtcattgccgccagtgaataaacagcagtggttggctttgaggggcaccttcagcctaaagccataagctgacatatactcagtctcactgagaagctcgggctttccactgttcacctaactgctgacaaatgaatcctccattgatctggcaagctggccaggatacctgcccaggccatggccacttagtaacaggatccggttctcagtgcagggttgagactgcagcagcagtggcaagcccagtaaggcaggtatgaagcacagcccccgcatcggttgcctagtagggaagacagttgtaaagagcatttgcccctgttatgtcagggtactgttgcaggttgtcttttctcctctagctggaagttgttctacccagtcttccttaattagctcttcttttgtgtaaggcagcacccatttaaaattcttttcctccagcctcattcctcatctccatttgggtt

SEQ ID NO: 65710 - DNA, 1992 bp, Homo sapiens
gcttttgggcaaaatctaggattaaatatgattttttcattgatagaatgctctatcagtgataaaggctcttaatctagaaaacatacacctcatagggggctttacagagtccccaaactccctgaaattatgctcaaaatattttgtgtctaagtggaatgtgcatgtttccaaggttaagcactgcttttttaggaagtaggaggtccgtccgccactgtcagcttgctggtttctgcttaccctcctccccacttcgttcttgagggggtggtttgctggtctttggcagggccgccactctgggtcagcacatctgagtcacacatgttcctccccagccctattggaggctttgttaaagtcatctgcccctacccaggtcccacctgccacaggtgagctagggttttatgacagccgtggctgcagtgagtctcctcgacctctcgccagctgttacccagcaaagcaccttggggagggtggggctgcccacttccggggagggggggagggggaggggagaaggaagttgatctaaacccgcctctttctctgtctcccttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcgggtatgttgtccccctttttactctaggattgcctcctcctctttctttcctctcatctcaaacataggatctttagagagttgctaaggggcgccctgcctgagtccagcatagtaatattcatgggaagggtgtccagatgtggaagaggcattgactaggaaaggaagagggggcacataccagaagggtctcccctgagaacaagcagcttgacaagtgggcgaggaggggctggtgggaggcagaggcctgaggcctcagagaggatgctcccgtgctacagtgagggggagcctaggatctggggccattgcccaggactggtgcccaagggacacttttctcccccaactctatagtgcctggcttactctgcttctggccagggaatatcacccctcctggtttggctccttctcagccctcgggaagccaaaggacacttgaagccagccctgaatgcagagccccaaagcatgagcttctccatgggacaactgttggtaggagcctccagcattagggcaggggccctgcctacctgagtcagcgccaggcctctcggggtggaggctgtcttccgggcaagcctgacaacacacctaggccgagtctgagatcccaggcggaaggggcctgacaggcccagtggatgcaaaactatctttttattttctcctccatgtcctgccttctctcttcctctcagtagcagaccccaaagctgtttcagccctacttctgaatcaggcctgcttagtaactacttggtttgccttttggttccaaataactgccttgcagggtgaccccttattctttctaaaggctacttgagagccatagggtctactcttgacagacctcctccatcctttagggcctgtctagagtatgatataggccagagctttgggagtgcctggtgtgccacgtcttactataagcagggaggatggtggtagaggggagagcgtggcttttgccaggtcctattgagtt

SEQ ID NO: 65711 - DNA, 1163 bp, Homo sapiens
acacgtcttcacatagatgtatgttttttgtctagaccataccctttttgtacaggttgaacatccgtaatccaaaagccaaaatgctccaaaatctaaactttttgagtgccagcatgatgccacaagtggaaaattctacacgtaaccccatatgacaggttataagcaaaattcaatcactttatttcatgcacaaaattattttaaaatgtcatgaaattaccttcaggccatgtatataatgtacacatgaaaaataaatgtttagacttgggtcccatccctgagatatctgattatgtatatgcaaatattccaaaatccaaaacaatttaaaatctgccacgtttctggtcctaagcattttggataaaggatattcaacccgtattatgtttatatgcctcttcagtgctggtagttgtagcttctgcttcctcatcccctcatttgagccgggtggcagagcagggcagactgctgccttgctcagacctaatcgttcagttctttcattgtacaagtattcattgagcagcaaacataagccagtctctctaagtgctgggatgtatcagtgaataaagaatatatgcctgctttcatgtgcttccatttttactgggggagatggcaaataaatgtaaagtgataaataacaaaggttcagtggggcattcgtagttcagcggcagaaatttcgtctcctacgcgggagactcgggttcgacttcggccatgcagtccttccatgcaggaagggctactacgtttctacccaacaaagttattatggctgggcgcagtggctcacgcctgtaattccagcactttgggaggccaaggcgggcggatcacctgagatcaggagtttgagaccagcctgaccaacatggagaaaccctatctctattgaaaatacaaaattagccaggcgtggtggcgcatgactgtaatcccagctactcgggaggctgaggtgggagaattgcttgaacccgggaggtggaggttgcggtgagctgagatcgcaccattgcactccagcctgggcaacaagagtaaagctctgtctcaaaaaaataaataaataaaaaataaaggttcatgtaagttttgggtggcgatgagggcgttgaagcagttatgaccatgtagct

SEQ ID NO: 65712 - DNA, 3021 bp, Homo sapiens
ttgaattagggcttcccctacccccaacaaaaacaacaacaaaaactagttctgttctttgtgcaagtgatgaggcctgaaattacaaaaagccccacctccagttctctggcccccgcagaggggaaggagttcatttctgtcatctttctttatggaaatacatggtttggagcccctggttttgtttcacaaagagagcgtgagtgtgtggaggtggatttgattaaaattggcatcagctatatataggagtggcttcttctgtcaccaccctagaggcccaggaaggaaaggcctatcccctagaacagagccctctgactactgtaaatcagaaaatgatggggtccccctctggtgctctaccacccctttacacagaccaagctggggtgtgtactgtcactgaaccaaggcagcagctcggattctgaatattcacgcacacgggctcacactccctccagtagaggcacccagccaaaacctgcctgctgttttggggctggatttggtagacgcagcagagggcatggctggctcatcctgatgccatcccgggtagcacgtccccacagccagccctcctccagcttccccaacttcccagccacagggaaggccgtgcatgagctagacaaccaccctattttcttttccctgcccggttttggttttttgggaaaaacaaatcctggcagggactgtttggagagacctgatgggagcaagttgggcaggcatgacccctggtattttatcttccagctattccgcgaagtaagaataatgaaggttttgaatcatcccaacataggtgagcacaagttgttatttctttcttcttccccaacagcaaggcactgctttccagcatgtcatcttctccccgaggtgcactgccttctggagtctgcagtcttcaaggatacccctggggaagctcagctcaaaatccatctccccttctggcacactgggctgtctttagcagtttggctggcatgagaggaacttgttcttgggagtgggggatcatgaaaggaggggagactttcgttcctaggatgctcctggacatgttggagagcagtatgtggcccctgttgcttcttgacttaaggcttggccttttctcttgtagttaaattatttgaagtgattgagactgagaaaacgctctaccttgtcatggagtacgctagtggcggtaggtgtggaactgcctcttcctgttgtgcccccacttcttccacctccagccagctctgactgagatccctgcctggtctcttacaggagaggtatttgattacctagtggctcatggcaggatgaaagaaaaagaggctcgagccaaattccgccaggtaggtgtgactccctccataggagctaggcctgacctctgcttttggggtttgacatgtaaggataagctgcctgtctgtaagtggcccttggagggtactttgggctctgcttatccgtgtggcaggttagcactaagtcacagggtcactgctctgtcagcccctgtggcccaccctcaggcacccctgggttaacccttcttccttcctttcagatagtgtctgctgtgcagtactgtcaccagaagtttattgtccatagagacttaaaggtaaggcatgcacttctccttgtgcctttgagtgggagccaggttgttgcctcttggttctccatgataaaaccatcaataaccatcaggccctgagtgttccaggaaactccagcctttctttttttctttctttctttctttttttttttttgagatgaccagaaagcccctagggctgcctctgatagaggccttgtggctggacctcgggttccattctagcccttgagcaggggccctctgccatttcacctcttggcacatcaccttttagtgctgccaagcaaggcaggcacactccaggctttctcagtctttcaggcaacctggtagctgacccagggaagagtgctgaaagttccacagctgtatcccagctgctttgcaggcaggcacacacataccatctccatcaccaagatactcaagtttgaggacacctgtgggtctcttggctgctgagtcctcacagacatgatttgattaacctgggcctgatgctgaagctttgcacagctcacagggtctctgggccttcagatcccatctctcccatggctgcccacgtgaggagtggcctgcattgccttcctcctgcccagcctattcacgctgattgaagccctgccctgaaattggtggagaaagttctgagactgaagatgactttccgtttgttctcccattcccctcagctccttcctgcccagggccttagtctggtccacttggttccctgatgttttccatcttacctcccaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggtggagtgaagtgcaagctttttattgcttctcatttcctctcggcctctggtcttagccctgacctcctgcctttgccacctgtctacatttgtcccaagccaaagcttcagagaagggcttgctgaggtagcagcagtcaaaggccttctgcacctgggaatgaataacctcagttcctttctcgaaagatgggataaactgtgtgtgtgttcatcccccaaggcactccggattgcaggcctcggactggtcaagttagagggtacgagggtatttgacttcacttgcctctctggtgaggtgtcttgtccccaggctgtctgccttcttccatatttcatttatgtctgctttgccaggcttaagct

SEQ ID NO: 65713 - DNA, 1014 bp, Homo sapiens
ggctgtgccgggctgtgaggttaagcttgcctaggagttgaggccagtcttaactgtatgtccccctgtgcagagctgatggtgtccatgggttatacacgggaagagatccaggactcgctggtgggccagagatacaacgaggtgatggccacctatctgctcctgggctacaagagctccgaggtgtgtgctccccgccccattctctgacctggccagcctcactgtctgtagcacctatgcttctaacacctgttgagggcagaagctcatctctgagtaggtgtgctctctgctcaccaattttaagcctcagctttggtgtctaaggtcctctggcccattcactgatctccatgagtgaattaatagaaagctggtagggtcggtgtgggactgggtcagagtttcaatacgggtgagttgatctaggttagtctgcattgattagatgtgtctaggtcatcggctagcactactacattgatctagatatctttgtgtctctttttgtatctggaagtgtacatttctgggtgtgtgtgtgtgtctctgtgtgtgtctgatcggaagtttgagtctgttgcttttttttttttttttttttttgagacggaatttcgctcttgttgcccaggctggagtgcaatggcaggatcttggctcactgcaacctccgcctcccgggttcaagcgattctcctgcctcagcctcccaagtagctgggattacaggcatgtgccaccatacccggctattgagtctgttgcttctgtctagtgctttatgtttgggtgtgtgtatctgtgtgtgtgtgtgtgtgtgtgtgtgtgtgtatgtgtccgtcttcccgtctgtggatctggagactttgtgattgttcttctgcccatttgggttttgttcatcatctgagtatccccacatgaactcccagcctccctgccctgctctccctctggtggtgggatccttaagaggcacctggtgacacttggtataggcccata

SEQ ID NO: 65714 - DNA, 1038 bp, Homo sapiens
tggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgcagagagtgtgggcaggtctgaaagcctgggactctagtctcgctgagcggctcttccgaaaatgggatgacccttgaacctgtaaagccacctcccccacctgcttatccacataccgtcttgttggttttttttttatttctttttttattttgtcttttttttgtttgtttttttagaaatctgtctttcaggtttgccagaaggtaggcgttgagcccgctgtgtgtgtgtgtgtgtgtgtgtgtctgtgtcctgtgtcctgcctccatcactaactccccttttctggctcttactctcctccatctgcttaaccaagtctgtgtggccctcctctctctgccatcttaaagggatgaagactgcctctgattgggcatcagcacaaggcctgccctccgtgcccccagtacaaacaggcagggctaagaggccacattggcccactcagggcaaatggctttaaaaatgagggccttccttgggcccacagttaacgcctgtcctcaagtaaggggagactgtctcagggaagcctccctttaagattgtctcctctcacccaccccaccccacccccactccctctcaccccaggttttggtcacaagtgttgggatcctttcctgccctttcccttgtcatgtgcatgcgctatgaggaagctccagggttacaagtgcatctgggatggtatcttgtttg

SEQ ID NO: 65715 - DNA, 1346 bp, Homo sapiens
cacagccactccccctcctcccccagagcagaggctccttctccccggcacagatctgggaatgtggggagggacaagccccatgtgctgggctccctgctggaaaggaatggttgagccgccagtgtgaggtgctgcagagccctgttggcttgccaggtgatgggcagagggccctgggcttgggtcctgcccacccactggtggcacctccccagacccactctcatctgggtctgtggcggcggaaggagcgagagatcccagcactaaactctccctcgctctgttttttgaggaacctgaatgaacctgaaagcaaagaccgagtggagacgctcaggtgagagggctggagccagcactggccctgcccgggccaccgggcttgccacagcctcctgctcctctcttccttctgccacttggctcttcctcccgtggttctgccctgtccctaccctctggggcctccctttcctcagagagtttccccttcccaaacccaattgcaggagttacgggcccttctcctcaggtctggtatattctggaagtcggagttctgggtcgggtggttggggctacagattcctacccctggactatcccacctccctgtgctcggaggcttctttctggagagagagtctgtgctcgtgctgttgagggcactggtgtcttccctgaccccaccccgcctaccccaaggctggcttctcctccccttcgctgtcctgagagatgggggttggaggactgccaccctccgcccccgcaggccaggggccacgcctggctgctcctgctccctcccgctctcctctctgggctcaggggctgtctgccagggtggctctcctggggtggggtgcctcagcccccccgtgacgcccgcctctgccctctccacagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccac

SEQ ID NO: 65716 - DNA, 1352 bp, Homo sapiens
gagaatcgcttgaacccgggaggcagaggttttggtgagctgagattgcgccattgcactccaacctgggtaacaagaataaaactccttctcaaaaaaaaaaaaaaaaaaatatatatatatatatatatataaaaaataaaaatataaactggtctgcagaaaggggagaaccccagcggctcccctactgagtagttgtttaggaggaacaagccagatggtggatggcagaaagctttgccggggcagtggtgctggtgtctgtgcagaagtagggtcctgtgaggggcatagtggcctgcctgagatgggagtctgatattcctccacttcctggccttcccaggtacagagcatgaagcagacgaacagcagcctgcgccaagccctggagggcggtattgatccactacgccccccggaggtatggctgctctttaagttagggtgcaaaggggggtttctctctggaggcagagcagaaagagtactgcttggggagcagggcttccatttgcatggttttgagtctaaaggatatgttgttccttgctttccaggccaacaccaagttcaactcccgctggaccacagatgagcagcttttggctgttcaaggtgggttaaactgtggtgagaagagaggaccccaggaatctatctccccaccctccaaggagtgggggggcagaggggaagggtcagggaagtaactagttcgaaggggtattgacgctgctgcccttttgacccttgcagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtgagaagggggtgagagaaacccctcagagaggagaggcgaggcgaggtgaggcgccgccttggtccttagactgggctgagggcgggaagagcctggcttctcactctttcctctcccctcaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgcccccc

SEQ ID NO: 65717 - DNA, 1796 bp, Homo sapiens
agtgcaagcctggtgagccgcaggacaggctgtgaagtggggtgggggtggaggcccggggcttggcctgcagccccacctggggcgcccttgattggctcccctggaagggcaggctggcaggggtgggtggccccccagcatggtttgctttcctgccctgccttcctgtctgggtctctgcccctccttcccttctgggcctcaacctccctggctccactcctctgctgccctctggccatgggtctaggcttgtgccaccaggctgatctgagtgtcttccctcctgctcctcggcctttcagagagccccgcacgctacagcaacaaggagctgaaggggatgctggtgtggtcacccaaccactgtgtgtcagatgccaagcgtgagtggggcacagccctgggaggtgggggcttgggttcatcccagctccaagctagctcttctcagaagggggctggaagctgaggtgttcgtgggtccaacccttgccctggggctcgtgttcagggacctggccgttgtggggtggtccctttctggacaggcctgggttaggagctataacccccttcaccaagaccctgcccctgctgcccctgcagttgacaagtacattgcgatggccaaggagaagcatggctacaacattgagcaggtgagccttggcccccagggacttgggaatggggtggaacggtgccggggcagctcaggctcagctgccccttgccccgggccaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatggtaaagcccttccacccccactccccggcgctcctctgcccctcctttctgaagagcttacctggggcccagagtcttgagtggtccccagcttctggcgttgcctcctccagctgcctgacaagttgattcccagcctggtgaaatactactactcttggaagaagacccgcagccgaactagtgtgatggacagacaggcccggcggctggggggccgcaaggacaaagaagacaggtgggggcaggagcaagcactgggcatgggggtaggtagagctcctggcagctgcctcattccctccctggcccctgtgtcagcagtgatgagctcgaagagggtcgaggaggcgtgagtgagggagagcccgatcctgcagatcccaagagagaggtgagctcccagagcctctgggccctgcctgcctgtcctcttgcctctctctggctctgcaccacctacctgcctctcctttcactggcagcctctaccctctcggcccctgaatgcacgcccaggccctgggaaaaaggaggtccaggtgtctcagtaccgccaccatcccttgcgaacccggcgtcgcccacccaagggcatgtacctgagccctgaaggcctcacggcagtgtcaggaagcccggaccttgccaacctcacgctccgaggtcttgactctcagctcatctccctcaagcgccaggtggggccctgggaaatgaacgggctatgcaaaggtggcattcggcacctgggaactgaagtctagggggagctgaggtgtaagcgagatggttcaggggccgagccccatcctctgggactctgagtaatgtggtgttctttttgggccttctcttaaaaactggtctgcaggctgggtgcg

SEQ ID NO: 65718 - DNA, 1034 bp, Homo sapiens
gctgagaggcgcagagcccggggggcgcagattgcgctccagcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacggtgagcccggtggcctagggttaaaggcgcgccggcctggggggagcggagtggggcgggagggggaagagttgcagaccacgagcctgttacactgatggctcctgcctctcctggattggagcctctgcgttgcttctcccacaaacccaggctgccggcacagccaatctggaacctgggcccctagctgctgtggaggcgtcctgccggcccctgccctgccctcaccccctcagggaccgaggcatccctcccttgcatagagtgggtccctcataccttgccaccttgcaggggactgaggtctggctggagcagggactggagagacacctccacacagagctgtgaggctcctgtggtgggaaggagccttgggttccttgcagggctgtggtccaggtctaggggctgccctccaaccccgctcccctcccccggaacaaagcaccctgcttggcctgggctctaaaac

SEQ ID NO: 65719 - DNA, 2046 bp, Homo sapiens
ccgcgctcccgcctcctcctggtcggagaccctcggccagcctagcgggcgctccacctgcgcgccggctcaccgctgccctgcgccggttctgcgccggcgcggtacgagggcgcgcggttgggcggggggggggggggaagctgcgaggcgcatgcgcgttgcagggccgtccgctctgctgccgccgctgttgcagccaccgccgttgccgcctccctgccggcaagtgtgtgaagaagaagctgagcgttgtcgccgccgctatgggggtgagtgaggcagagagaggagatgggaggtccaggggcgctcctcgctaccctcgccccctttgttcttaaacccccctctcacgtgaccccgaccccctccagcctcacgtgacccctgacccccacatgacccgactcccccattctaagggtccctacgctaggcctagcccgggaatcctctggagagcccctggtccggggccccaccccctcggcgcccccagcgtcacgcccgccccttcctgcttcgcggacccgttactggcctccccaccaccgtcccccgcggggaccctggggttagcttcccgctcccccagggtcactcatcacctggctgtcaccagcttcgtcgcttttcacatccgaggtcaaccctggcttggagggaattgaggcccagaggaaagaaggcgcctagccaaggtcatattgtcgggggcgtcagaccccaccttgggcctcccgaatcccagtccactgcccttcccgttactcgagtctcagcgaagccggttcccctacactctttcgaaacctctccaccaggttcctgctgctcctgataaacacagccttcctttcccatagactcctgccttcgacgcctcctggttgcaatgaaatggttcttacgaccgcttgggttgttaggggttttggtagtgcaggtgttttttgcaaggggagggctgtgcaggtgtgcggggaagatgcggggaggcgggggcggcggcccagccgcggatggatattgaccacttgttccgtgccggcagcctggaggtgcattttagtttactttcccgggatatagggtagggcagaagttatttgcaagtttctgtgcgttcaccttactaagtctcaattacagcagtatcagtcaccctcctaaaaagataacgcttttcctagtattggctgtattctttttttttttttttttttttttttttgatatggagttttgctcttgtcgccgaagctggagtgcaatggcgcgatctcggctcactgcatcctccttcttctgggttcaagcggttctcctgcctcagcctccccagcagctgggattacaggcgcccgctactatgcccggctcatttttgtatttttagtagagacagggtttcaccacgttggccaggctggtctcgaactcctgacctcgtgattcacccgcctaggcctcccaaagtgctgggattacaggcgtgagccaccacacaggcctatattagtatttacatggaatttccatcaccttaagggaaccctgactttggagcccgaggtacctcacttccagccccgtcttcgctgctggtggtataatagtgtgccagtgagttggcctttatgtgtttgaatttcctcacctctgtaattgggatgctaatacctcccccttagggtagtagtgaagattaagtgagataatggatgtagattgctaaggaggtgtctcctaagtagtggctgttatttttgtctgtatcctcagccttaactttactgatctaaaatggatttgtgctatttttaacccattgggtttgtccctactgttgttaacctagtttttttttttcccgtcactccactatttatcgactgaacaaatcaacttattagacaaaaatagttgtctaatccgtgtcaaaacagtcatcgtgttttaacaaatagttttgggtattacgtacttcatatgtagaaaaccaagtctagagaccttaggcatatttaacctaaattttgg

SEQ ID NO: 65720 - DNA, 1058 bp, Homo sapiens
tcacgccctgctaatttttgtatttttagtaaagacggagtttcgccatgttggccaggctggtcccgaactcctgacctcaggtgatccacctgcctcaacctcccgaagtgctgagattgtaggcgtgagccactgcgcccggcctggaaagtcttttgacatactttagatatcccatattgtgatatctcatagtgttttcgtttttgtttttgagacagagtctcgcccaggctggagtacaatggcatgatcttggctcactgcaacctctgcctccctggtacaagcaattctcctgcctcagccgccggagtagctgggattacaggcaccccccaccacgcccggctaattttttgtatttttattaaagatggggtttcactatgttggccaggctagtctcgaactcctgacctcatgatccgcccgcctcggcctcccaaagtgctgggattacaggcgtgagccactgtgcccggcctcatagtgttttcatattccgtattcccattgacttccagaaatgtggaatagctccaaaacaggcattgccagccaagtctgggctcctctggtgccttgaattttgtgtggttcctgtggttgtgatcttactttcatgtactttaatggagaattcgtacctgcaggtgggctttggacattttatagttaagataggtgcagtgctgtgtttgggcagctgtgatggctaagtgggtgataaagaaaggaagatgcttcaggggcagggagttctgaattcataaggctgagtgtggtgtgccagtcagtagaggtgatgggattccagtgcgtacatcctctgggggttgtgtcaaaggtcactgaaaggtattgatacgggagctctttaaaggcttagagtttgctgactctagtcctttcagaatgtagtgctctctagggaatgtgatttcacagatcagtcaaggagtttaactgttttttacttaaatttcatttagaaacagataccttaacacttaggcatttgtgggtttagaaaaacagtgttgggctgaagc

SEQ ID NO: 65721 - DNA, 2195 bp, Homo sapiens
ggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatacgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaatcagccaggcgtggttgtggcctgtaatcccagctactcgggaggctgaggcaggagactcgcttgaaccc

SEQ ID NO: 65722 - DNA, 1112 bp, Homo sapiens
ggtttcaccatgctggcaagactggtgtcaaactcctgacctcagatgatctacccgccccggcctcccaaagtgctgggattagaggcgtgagccaacgcgcccagcccgtacttttttttttttagtacagacggcctcccaaaagttctgagattacgggcgtgagccaccacgcccagcctgaatagagagagatttaacagtatgaatgaagggaggagtcaagaacagtttaggcttctcgcgtacatgattgggtggccccagatgtcattcacaagtataagccttggaggcggaacataactcgaagaagagcccttttgtgctccgcccatagcgtaggaaggtgtcaattggctgtttcgaggaacgcgccaaaaactgccaagggctgtgggaggtgtgttcttgcgtcatttccgagagacttccgcgccgcagtttccctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggtgaggaacgggcctggaagagcgcgggaggcgccgtgggctgaccccttctgcctagctgacctcaggtggtcctgagaatgcctcgcgccccgcagcgtagcggggagcagcagtgccggtttgggcatgtctggagggcgcgaacgacggggacagtgcccgggcgacagtcggggctgtcggcgttaggtctttccccacagccccaggatctcgggtctggtcctgtcaggccctccctctcctgtcgcctcctcgctgcgccgcctcctgccgacttctttagccgctctgagcccattttctcgttggttcactgggggatgcctgacgctgtcagcgacgaaaatggttgttactgctatttattttattttattttattttacttatttattttgagacgggttctcgctctgtcgccaggctggagtgcagtggcgc

SEQ ID NO: 65723 - DNA, 1123 bp, Homo sapiens
ccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtaggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacttcagaaattcattgtgccttccctcctgcctgggctcatgcctccactggcactgggtggaggtgtggagaagagcgcccggctggctgccctgtggtaggttttgtgtgcctcagctggactcctcgtgtgcttctgtacctttaaatggtgcctggcttcctgggaagacaaagcctgttgtcattgtgcagcttttctggctcatcccctccagctcccttgtttgtgcaaagcccaatgggcgtgtatgtgtctgtgtgtgtgtgtgtgtgtgtgtgtgtgtgtgtgtgtgtgtgtcccactggggc

SEQ ID NO: 65724 - DNA, 1030 bp, Homo sapiens
cgacccccggccgggagggagcacgggcgaggcgggccaaggcccgcggcccttctccatcgtgtgcgcccggggcggggcctgggtcgctccgccctctgcccaacccctcggctcctggctccaggggccccgagccctctcgcccctgtccttgcagtcaggcagagaggcctacgccagggccgagccccccggcctgctccagcggcggcccgcgccgtgagggcctcgagtttcgctgggctacggagcacaaaggtccgggcgggccattcgggatgtcgtaggcggccctgggatgtgaggggcctgcgggatctgtccctgaggcctgcgactttttctggtagagccgcctcttctggccttgcagcccctttccgcctgcctagacattgttagtctccttaggagatgggcctttcaaaaatggtcccactctgtcttttcccgcctatgagttgggccctggggaccgcgtaggtcattgggtggcagggacagttcttttgcagagtagtgcgaaaagggtaggtaggtcgacgcccagccaagaatttgggatggcgagccccaaaagggttgacctttaaagtcattcagcccacgcacctcattctcaccgaacacttgagggaacgagaagtgggaaaacggccccggaagggacttgttcaagatgacattaagagagagccaggactaaaattcaggtgtcctagctcctcaccgatagctgctcacagtggggtccatagggtggacctgcccagctggctgataatcctagagcacgtactggtatgcctctaagaaaggcgagggtactcgccccattttacagttgaggaaaggtctctgccatgtggtagccaaggagaggtattgtgctgaagagctcagcctggaattagacaaacctgggtttgaccgcaggtcttttgctagttgtgaccttgagcagattgcttcacctgtctgcagttgttttgttaattgtaaaatgggcaccattaacaatatccac

SEQ ID NO: 65725 - DNA, 1047 bp, Homo sapiens
ggagaattgcttgcatctgggacatctgtaacatacctgcttccagattctaagcctgtcttcctgaccctgggctgctcttgtccctggcccagctgcctgcagtggagatggccaggaccccctgtaatctttggcttttttccttttcccaggtgttaactgtctggcctatgatgaagccatcatggctcagcaggaccgaattcagcaagaggtgaggggctgcagtgggcgagggaggcagtggccagcagccccattgtggaaatgcataggctgggcatgaggcctattgtctgtctctactttggaagctccctcctccctaggctatgctaggtactggtgcttttctgggggtcgctgtgccaccgggtgaccagcccagctcttttgtagttattctgtctgttaggcatgggtcactccatctccctgctaggacatgacagatccctgcctcctccagattgctgtgcagaaccctctggtgtcagagcggctggagctctcggtcctatacaaggagtatgctgaagatgacaacatctatcaacagaagatcaaggtgggagcctggccagagcgggtgggaagcaccctgggggtggggcaggagggtgcctgcttcagacttgcttcctgctgggtctgtcacctgagggagtagggtgttggaggacacttttcgttgctggttcttgaagtgcgtaggctgaggcctcaaaaacacattgattcaatgcttgaacctgggaggtggaggttgtagggagccaagatcacaccattgcactccagcctgggtgataagagcaaaacttcatctcagaaaaaaaaaaaaaaaggtggggggcaggcacggtggctcacgcctgtaatcccagcgctttgggaggccgaggtgggtggatcccctgaggtcaggagttcgagaccagtctggctgatatggtgaaaccccatctctactaaaaatacaaaaattagccgggtgtggtggcaggcacctgtaatcgcagctactcgcagggctgaggcagg

SEQ ID NO: 65726 - DNA, 1026 bp, Homo sapiens
ggcgcggtggcttacacttgtaatcccagcactttggcaggctgaggcgggcggatcacgaggtcaggagatcgagaccacggtgaaaccccgtctctactaaaaatacaaaaaaattagccaggcgtggtggtgggcacctgtagtcccagctactcggagaggctgaggcaggagaatggtgtgaacccgggaggcggaggttgcagtgagccgagatcgcgctactgcactccagcctgggcgacagagtgagactccgtctcaaaaaaaaaaaaaaagcatcttcccatagggcgattgtgagattgagggaggtgcaggctgggcaggagctgatgatctcggtgcccatacgggggctgaccaggctggtgctcagtggggtaggagggttgccagagggctgtttcccacagcttgcctcctggatctttgtggagaggcaggcagcagtggggtcaaggggccacagatttcctcaaagggccctgctgcatcactcaaacggaggcaaacttcaccacccactttctaggtctgtgagctgggaggatgacatgtgaaatggggccaggcatggtggctcaagcctggaatcctagcactttgggaggctgaggccagaggatcgcttgagcccaggagttcaagaccaacccaggcaacatagtgagaccttgtctctccaaatcaaaaaattactgggtgtggtagcacatgtctatagtcccagctactcaagaggctgcggttggaggatcacttgagcccaagaagttgagccatgattgtaccactgcactccagcctgggtgacagtgagacctgtctcttaaaaaaataaaaaaataaataaataaataaataaataaatgtgacaatgggtgtgtggaaacagtatctggtaggctcagtgtaggtgtttagtaaatgtttctcttcccctggaagatgacagatgcttagagtcctctactggtaggggaggcctctgtggccaggtaggtaacccaggtgattgaa

SEQ ID NO: 65727 - DNA, 1115 bp, Homo sapiens
aattgtgagggttgaaggagatgttacgggcggttgtaagcagcgggttacaaagctgctcctctccccatacagggggtgagcttcattcattcattcctcttatgtcagtgtcctccagtgggaccccccatgccaaggcctgccgctcatgctagaccaccctggtaaagtggacaggacaggctgggccccaggttcttcccacggagtcatcaaacatttggatgtccagagcatgctgtctaaaaggcctctctgtgcccccagcacccgcattctgtatgctgtgcctgagcccaccttttctccctgggcagagacagctgtggcagcagagcccaagcagagagagctcctctctctctaaatgggctcttgtgaggatcaattaggatgacgtttattcgccctgtgccaaatccctggcacagagagtgtgctcacaatggccatggtggctgctacagtagcagtggtgatttgggttctttgtggtcctggtgtgctactcatttaacgtttattgagaacggactgtggtccaggcgctgttctaggtactgaagatagagccatgcagacaaagtcctgccctcacaaaacttacagttcagggtggaaagacatgataagccaaagagggctctgggacatgtggggtatcagaaggcggtgagtgctgtggagaaaaatgaaaaggggatcggggccgggcgtggtggctcacgcctgtaatcccagcacactgggaggctgaggcaggtggatcacctgaggtcaggagttcgagaccagcatgactaacatggtgaaacctcgtctctactaaaaatacaaaattagccgggtgtggtggcgcatccctgtaatcccagctacttaggctgaggcagcagaatctcttgaacctgggaagtggaggttgcggtgagccgagattgtgccactgcactccagcctgagtgaccagagcaaaactccacctcaaaaaaaaaaaagaggggattgggagtgggagcatttgccattttaaacagggcttggtgaaggccttgctgatgaggtggtatttgagtaatgaacagaaaaagaccggggagcgagtcacaggc

SEQ ID NO: 65728 - DNA, 1053 bp, Homo sapiens
gttgttgtacagtcctgtaggccccgcagaactttagtgacccatgcaactagtttgtccttaagtgcccagcttcctgccgtcttttgggaggactctgggcagtgggccgctcccattgccacattcagcagcctgtttcagggacccagggtggcaggtggctgctgggagctcagttgccacctttggagtgtgacctttgctgggggacatttccttggccagcccccgttctggcctgatgttaacctgtcggggtggggctgtctccgcaggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctgg

SEQ ID NO: 65729 - DNA, 1022 bp, Homo sapiens
cctccattcttgccaagcactgccttaagcacattacaaagttagtttaactcaatccttccaacagcccaatgagctctgaggtgggtgctattatcccattttccagatggagcaactgagacccagagaggttaaatgatatgtgaggggtcacacatctgtggctggcagagccaggatgtgaactcacgttgcccagctccacagcccagccacggcaccccattcggaacactcacttcccagcactgggagctccagcctggacgcccgctctgggccctgccttcttgctccatctcagcctcgccctgggctacagctgcctttctccctgcagaggagaggagcaggtggaagggatccaggcctgagccgttctcagcgttcccctaacctctctgcccacccatccctgggacgctctgggaaattgcctggtgccagctctgagtaaagttgcagaatgaggtttaattgtgcccccagggcacgagatcaaacagcaaaagaaaggggtgtgagctacctggcatccctggaactgtgccgagactgaggtgatgaaggagaaggtggccttggtttgtccatctgtaaaatggggaatgatggtcctctcttgatgcccgcctgtgagcaccaggcagctggtgcctgaggagctcctggcgtgggcgatcagagctgccaaagatgggccctgtcctcccggccagcacgcggcgttttcctctgtgggagggtcgctgtcccggtattccagataagagggtggacgccagagaggggaaggggcaggatctcacagccgatgaggggtgagcccgggctggacccaggcctgcctgaggccgcgcctctcctgcgcggtgccctggcgaggttgggctgctggagcgtttcctccatgcctcccgctgcgccccggttgtttatctgcgcccgggtccccagggtcgctcgcgaggccctgcagccgccctcggataaacaagcccatgcggggccgtaattaa

SEQ ID NO: 65730 - DNA, 1075 bp, Homo sapiens
gatcaggtctaaccagctgcccctgggtgggtggggagacagacgccagagagggtgggaacgcaggcctgggcaaaggcaagactgtgtcacccggggggtggttgttccacctgtcagctggtcagcccccagccccagcaggactgaggcggttggtggccaggcttctctcatgggcccctccttcccttgggagcttcctctgctccccaccagtgacatcacctcccctgcccccatcccttccagacactcagggctgcctctcccggctccctcccttctcagcgatcattcccagcagagaatatgctttttgcggtgatttagaccttcctttactccagctgtcattcacctgttacacacatcccaagttcaggaaggagatgtgaactgtgtcctgaaagacagccctgtggagacaccagcctcagccagggtagggagggctgtgtgacgagcagctcatgggcatgggtccgagaggggggtgggggcgaggccagctgcgcagggtgggctgggaagggcctccaggagagagactgggccttctggatggtgcagagtctgtggcaggtggaagcaaatgggggctggacccccgggacagtgaggaaggggatgccattgggagcgagaggtagggcctgatccaaagagagggtggcagccccaagacatcagggagccaggggacggggtccctgtgactgcccgaggtaggggatgcaggaggctctgagattggtgtctcagagacctctactggggatccccccaccccgtcactgtgcctcttctgccggccgccagatgcctgtttcaggggccccaagctctgcagccccctcatctcccctcccgttcctctgcccgtgtgagctgctttatggcctcagcctcccccacagcgcaaaggctcttgaggcccagcgcccacatcccagcacccggctcaaccaaccccagcaggtggccactccccacctcactgggaactcaagcagctcctcgcccttccccttgggttgtctctgtcccccaacagatgccaataaagctaagg

SEQ ID NO: 65731 - DNA, 1066 bp, Homo sapiens
ggagggcttgggggggggtcctcccctgtatgccaggcctgacgagggggcacctgtagctgccacctgggtgggcgaagagcaggtcaggccttttcccaggcagctgcctcatgccttttggaaggggcagcagatgcccaggcctgggagatgccacgaggacactgaagagggggtggtggaggagccggcagctgccgggtgcagcgggcacggccctgtaattgggcagcctgttcccagataaggcccatgacactgaacagcttcccgctccacgccggctgcaaccgctcatttcctgctccctggccagcgatgccaattacctcgcctcctgcttgccagcggcagcttctagggtggccagacgattcctctgtcatcggccagggcctggatcctctctgacgggtgggagggcgtgaagagggcagccggcaagggggggtaggaccagtgataggggagcttccatcttcactctggcctgggccacacccaggcacagctggaggtgggggtgagtgacacatggacccaggctaccgtgggagggctccatttccccctctgcccctaccttcaaaacaggggctcactgtctactggatgggctgaggagtgcctgatgctctttggatggagtgaggatgggcacccaatttgcactgggggaaactgaggctcacatggaaatttgaccagtgctgaaaggacggaacagcccctggtccttctcttcctcttctgtgtttcccccagaggacagacttggggagcagtaggaggggcagcctgtctaaagggggcaaaggctggctccagattcctcttgccgagcggggaaaggggagaagcaggtgagaggtgccgccctgtgaagagggtcttgcgggtcctggctccactgaaggtggatgcgtgtagccaccgacatgggaggcgttgcgggcttatcccaagaggctcgcagcccagcaggctgccctgctccctgtagtgggggtgggaagagatgtccccccagggttggaggctggacagggaagcgtgggcccac

SEQ ID NO: 65732 - DNA, 1051 bp, Homo sapiens
acatgcggcctgcagcctagtctgtctccacaaatgcccatcagtacctgggtcctgaggcaaggctgatgggtctttaaaaaccaagaagcttggggggaaaatccgaggacggggcacagctggggagggacagagggcagggcagccccgtgacaggggcccccaattcccagacattgcttctggaagcacagcccctgagagatggtgctggcctccctgaccccctggatgcaaacatttccagctggccgcctggggtacctgttgggcaaatgaatcactgggtccctgtggctggtgcctttccaggtagctcctcctggaggctcagacccagttctgaagacctcagctgcagaacagtttctccatcatcagggagaaggggttcaggcctacccgaggctggactgaggtggagggcactgggctgaggcctgtggggtctggggtctgtggacccccctaccctgccctatctccctccctcccatctactccccacagctcaagggcctagcgacagctcccatccgtcactcagccctatttttaggaggtgataacccagctgtgaaaattctctccgtgctgatcccttccacatgaagaagtcttagccccaagccgatgagtaagtgtggcagcttgggaaggcaagggatggaggcaggaagaggcttgcaggaggaccggggggctgctcacgcagtaggagggacgggagcccagagcctgggtcccaccttagctagctctgccaacaacaacatgctcatcgcagtgttgtcctggatcaaacctccggctcctgaaaacatggaggaccaacctctttctgagctgtgtgttcttaggcgatttcgtctctctctgtgcctcagcttcctcctctggaaaatggagataatgatagtatctgtccaataaggctgttgtgaggatgactaagttctctggccgagaacttagagaagcaactatgtctccagaccccagtgccagcacagggcccggcacagatgagacatcatccgtccatcca

SEQ ID NO: 65733 - DNA, 1034 bp, Homo sapiens
agccagccttcctcctgcctccgggcctttgcacagcggttctgcgactggggtgctttttccggcccctgcagccccacttctgtctgagactcctattcatgctccagggactcacatcatgtgttcagggaagacagagagggggagaagggcatgaagaaggaaggttctcgtgctcacagtacagagatgtagacacacccagatcacccaagcagctgtggagctggacgtgagccctcatccgctcctccaactagcccgtgacttccacaggcggtgctaggggtggcggctggggatggagctgggaggggaggtagcaggcagcccgctagcccttccctgtcctggcaggagctgtcactgcctctctccttgatggcggggtatgaagagaagccttttgacgcagggagatgacccctccccggcctccacctacacagcagccacgtggccaccctgaacagctgccacagtgaccgacaccccctggatgtgtttgtcctcccacagcaaagcacaattaacatccccactggtaaatgatatggggccatatttcacctggacccaaatgtgggccacagaggcattaaaataaatgacggcacggttcagtgaggtctccgattcttggatctggcagaagtgcacctgtgcagcgcccccactgctctcctgggcccctgccccagttccatgccctctgtgcagggaaatcaacctgctcctgtcacttcggatgtgggaacagggtccgccacccagacctcaccccaaccctgccacccctgccacccctgccacggctgtagccctgaccacaggccggttgtccccagcccgaggagactccggggtgcgtctgcctcccaagaaagccaggttctctgggaaccagactgggcagggtccagttggccacacctctccacagttgccaccccttgctggagctctgggcttggaggcaagcacgcagtccccaagaaatgggcgcagctggtaccagcatcctgcagctt

SEQ ID NO: 65734 - DNA, 1106 bp, Homo sapiens
gattcttacagaaggggaacagtacagtgaagggccaggctggagccagctcagggcattagtgggcagtagtgggagacacggctggtgggctgggcagggcccttggagactactgtaggagcactgcctctatcctgagagctatgggacgctctcaggataaagccgagaagctatgggaagggtctgaggtgaacacaccagtgggatgaacctgcctcctttttgggttcttaatttcaaaagcagagctcagtggtttctctctttatcgggaggcagcggccacagctgactggagcctctgggctcccaggacacggcaatcatcctctcaaaatgccaaggcccgctgcccctgccccacccccatcggtataaaacaatttctgcgccccggccagggaggcggatgacctcactggactttttccatctctcgctttcatggagaaattacaatttataattggatgaaatcacgcgggtggtaatagcaataagggctcgtgctagagccggccgccctcccgccgcgtgcagggactctgtcctcatcttccctcctgcgtaagccccaccgtaccccttccagggcctgtgccccacctgtagtattcaccaggcactggccattcagaatcgatgtcccgtggggcttgctggctctgaaacctccttcttcctagggcagcttgtcccaagaaaactccccctgccaccctgtccaccccatcagactcagcctgcacaccacctggctggcacacacccttcccaaatgccttccctgccaggctgtgagccccgtgggcagccaccccccatctgggtgctgggcttattaaaacatgaaccctaatatccctgtttttatttgtaacggcctctgacaacaagcatttctcaaatcagccaccttaggccctacaaagaaaagtgcccagatgcagctgagcccatctggatctgatttcaaaccagagtgagcactctcagatgtgtaataaaagcccttttccaaagaggggttcctgcagggggaatacagacaccagggcgccgcggcccttccacatgccgcactaatgagaggtgctggg

SEQ ID NO: 65735 - DNA, 1043 bp, Homo sapiens
cgaccccctcctcagctctctgcctggctttgttcggacagggctgggctgggctcagagggagggtttcccagatccccaggggaaggaggagacccggtgcctgtgtagagggagggagaagaggcacacggcaggtgtgggctttgggctttgggagagtcaggttgggcccctcctagctgctgccatcttcccaggtgctgtcccctcccctgccagcgtcacccagagccaggaaggtgcaatgcccctgctcttggctccggacctgcatcctggccctgtgtcagggaggcccctggccgccgcatgcaccatgttagcgtggagcaagccccagcctatttagagaagatggaggctgtggcgggaggccgtggggagggggaaggagaaaagggaagaaaaggagcttttgatgcacatcatgtctgtggaattgagtatgactaattaatagattttatttttagtaatctcttaagcattccatacattgggccccacgcctgagctgagcttacaagaggcctcattcgcaaaatgcaaatgattcccggcctgctggtgccttctctctctccttccttgccttttctttcctttccttttttttttttaggggagatttaaaggaaaattgccatgtaatagaaaagagattccaatcactacatctaattaccacgaagggtaaaccacttaaccaaagaagcgtcatgggctttttttatctttaactttaaacctgccttaaatgccacaaaacgtactcatcagtgctggggccgctgaggttattctggctacttagaggctgtgagggtcagcccagccgcggacgttcccttggaaatgtcagctgtgcacgggagcccgggagaatttagacaggctggggttggcatcccaggccttgtgtcctcacgcatgtctgaggtgtaggggaggctgggtgtcctgaaacatctcctatcttgtggtatgagaccagctgggaggagctgggccaagaggggatggggtttcagaacggacct

SEQ ID NO: 65736 - DNA, 1070 bp, Homo sapiens
actttgggctttatagctgcatgttctgtctctgctcctggcctttgcctgggcacttacctctgtcaggagcaccctctcctccatttccttggctgactccgaccgtcctccaggtcccagctgagaaaccctcccctccaggaacttccccagacctgggtttgctgtcgctcccatgtagtctgtaacagtcattcattcgtttcattaattcctgcagcaggtgctggggctgcaagggggaacaagggagatgtacccgggcagctggggtgccctagggtcctacaagtcacccgtcatgaccggatcccaggggaaaacctgtctgagagtcagggactggggacaggggccctggggcagtctgctctgggaatggctcagcttgctgcactgggaagggaggctggggcgggtggcagggccatgcccatggggtctgggtccagatgtctttctctgcctgctctacctgtgtccagtgcttccggagcacaggggagctgccttttaggaggagatcaagggagagaacgcgagccacacttcacacggccgcagccccgggcatctggctcggcctcctgccctctcacattgcgtgtgcctccctatgcaaggcagccagcaggagagctccagcctgggatccccagcagtctcctctcttggctccctctgtccctgtcccccatcttttgaggcatagcctggcctatcctgtgcccctggcttcctgccagtcttctttccagtttcccaagctgaggtggacgcaaccttcctttctgcattcaaagggcacgaagtgattaagacccagtccttgctccctgtgtagcggggcagcaggggcatagcgtgggggctccgtgcatctgtgcaggaatccaaggcgctgggggctgctcagggacggcttcctgtgggaggtcttcctggggaggtctagttccccacagggcgctctggctggggctcatgggtgtgcatttccctccagctcactgaccctcagcctggtctcttcatgaggcctcatggggccaggactcggggcagtg

SEQ ID NO: 65737 - DNA, 1035 bp, Homo sapiens
gaaaccccaaggcctaaagaggcaggggctggccgggtgcggtggctcatgcctgtaatcccagcactttaggaggtggaggcgggcggatcacgaggtcaggagatcaagaccatcctggctaacacggtgaaaccccgtatctactaaaaatacaaaaaattagccgggcgtggtggcgggcgcctgtaatcccagctactcgggaggctgaggcaggagaatagcatgaacctgggaggcgaagcttgcagtgagccgagatcacgccactgcactctagcctgggtgacagagcgagactcagtctcaaaaaaagaaaaaaaaaagaggcaggggcttgcccaacatagtggaggaaccagatcttagccagttctgtctggtaagcagccactgccctggcctctgggacctccaaagctggccaaccaagcatgccagcgccctccaccccacccctgaaggccttcaggggtcttctctggcagcttaggcctcagcagatggcagccaggccctgacagggccacttcagtcacctggcttctctggggacatcccctgtcctagcccacctcacgccccactgcacaggccgtttccatgtgaccacacatctttcccaatggaaggcagagcaggcatggaccgccttgctggcagtggggagtgaggggcccaggctgcctgccctgtgccctcatggtcaggaagcccatccaagagactctggcagtcaggagagggccgtcccctcggccatgccaggtccagcaggtgactcgattccctaccacgaatatgggaaggaggtgccttcagcctgttcaggatagagggaccattcccccgttcccagccccaccaagggctgggtgcagggcaggtgctggctgatgggatgcccggttcagcgggtctcagcagccctcccagagcagcagctatggcaacaagaactagagctggcatctcctgggcgctcactctgtgccagacactgtactgagcatcctacacaagcagtctcct

SEQ ID NO: 65738 - DNA, 1004 bp, Homo sapiens
ggtgtggtggtgcatgcctgtagtccagctacttgggaggctgaagtgggaggactgcttgagcctgggaggtcgaggctgcagtgagctgtgactgtgccattgcactgcagcctgggcaacagagtgagatgctgtctcaaaaaacaaataaaaataagaaaatcagattctgtttccctactgatctcctggcatttgaaattcaggactggtttccactcttacattattgggctatgagatgtgattgggatgtgtgtgatggtgtgtgtgtgaggtcaggagtttggcctgtgtgtgtgatgtgtgcggtgcgtgtgtttgtgatgtagcatgtttgtgtctgtgcttgtgtgatgcgtggggtgtgtgtgatagagtgtgtgtgtgaggtcaggagtttggcctatgtgtgtggggtgtgcgtatgcatttgtatgatgtgtgtgatgcgtgtgtgtgcgtgatgtgtgtgtgtctgtgcttgtgtgatgcatggggtgtgggtgatggagggtgtgtgtggtgtgatgtgtgtttgtatgggatgtggtgggagtgaggtgggaggttgggcagaagcatagaagtggggatgcctggctggcgggtggcagggcttgaagttgcagggacggaacaaacccccacaccctcaggcacagtgcaggcctccctgggccctgtccccgtgggctgccagctgaggccacttgcttgggtagcacccgggagagtctcaggttcctgccatctgtgtcggccacggctcctgcccacaggagcatggcgcatccgtcttaatgaaattgggctgccatgtgcaggagataagccagggagcccccgcaggccccctcttctggaggaggaggttctcagagccggtgcctgcctctccagccttgcctatgacctcagtcctgtgtctggggagagcgccggtctcagggtatccactagggggtgctgtggctgccagggtgtttatgtctcctttt

SEQ ID NO: 65739 - DNA, 1219 bp, Homo sapiens
gctcccaagaaagagaagtctccgctgccatcccacagcctttgggtcactggagcatgtatcagtgccactccgcccaccttcttcctgtgaggggtgactagggctgtgctctgtttgtcatttggatgctttggaaatctgtggcaaatgaattgacttttccatggaaggagcatgtggcacattctggagtggcttcgtgagctccatgtggagaccggaagagtggcagagccctcgttcgtcacatgggggccagcgtggagtgcagcctgggctctttgcccctgcttattttttctttgctggctccttagggaaggtgtgagaaattaaataaatgaaccggttttctctcttctgatctgtaaagtcacctatttatttgttggtaactacatgaaagaatgagtgttgtctttaaagcttgggattaaatgggcacatcatagagaagctgtgtgttcctttcccctcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaaggtcagctgtgggcagtggagggagagaggcccttcagacccttccagaaatgccttttggtggcctgaggtttacctgtcctgatacactgatagttacctacccacctccctgtttgagtatcctcctcagaaatggcatttttcatcaaatctaaggtagccattagttgtaatacaggctttatttttggtactaagaaggaagaggccagggctgggcgcggtgacgcacgcctgtgatcccaacactttgggaggctgaggtgggcggatcacttgaggtcaggagttcaagaccagcctggccaacatggtgaaaccctgtctgtactaaaaatgcaaaaaaatttagccaggcatggtggcatgtgcttgtagtcccatctactcaggagactaaggcaggaggatcacctgagcctggcaagcggaggttgcagtgagctgaaatcgtgccactgcatccagcccaggtgacacggcaagaccctgtctcaaaaaaaaaggaagaggcccggtacagtg

SEQ ID NO: 65740 - DNA, 1100 bp, Homo sapiens
agttcgctgcaacttccacctcctgggttcaagcgattctcctgcctcagcctcctgagtagctgggattacaggtgtacgccaccacgcccagctaatttttgtatgtttagtagtagcggtgggtttcaccatgttggctaggctggtctcaaactcctgacctcaagtggtctgcccgcctcggcctcccaaagtgctgggattacaggtgtgagccaccgtgctccgctatctgtgacttcattttatttgtttttgttgactctattttagatagtgttttgacggtttgagtatttctcaattgtaactcatgagtggtgcaaaatctagccatcttttgatgggtgaggagcttctaaacacaagaatctgactttagtagtaagtgggagttaaaagactaattgtggggaggagtaattacaatttttctttatttttttaaatcaatactaggaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataaacaactagaaatctttatgttgaatggggacatctgttgaccttgattgaccatgattattatggtttttttagagacggagtcttgctgtgtttcccaggttggtcttgaacttctggcctcaagcgatgctcctgcttcagctaggattacagtcacgagccactgtgcccacctaaaactattttgagtgctttagtatgcgctaagcttatggctattattcattagaatggccagcatgttaaaaaatcagcttcaggccaggcacggtggctcatgcctataatcccagcacttttggaggccaaggtgggcagatcacctgaggtcaggagttcaagaccagtctggccaacatggtgaaacctcatcttcactaaaaacacaaaaattagccaggtgtcatggtgggcgcctgtagtcccag

SEQ ID NO: 65741 - DNA, 1120 bp, Homo sapiens
gggtgtctcagctggaaaaaggccctccagtgtgggcggtagtgagctttgctgaagactcgtgccactcagccgcttctcatcctctcaccaccccctctgctatggttccctgacaactaagaccctgaggcaaccacaagactgacaccagatctgctgcagcctcagaataaagcctggtccaaaactctgctgtcctcaccggttgcttcaagtcgaagggatttcctctcccctaaagaagcgctctgcttcctgacaaagatctaggagagtaggtggaaaagggggagtttcagagcaagcaaagatgaagttagttttcattctaacggctgatactttattgtctatagctgactgatgaagaggccttcaggagaacttgatagaattctattcatgttagttgcatttcagaacttgtgacagatcatagattcttgctttgtcacctgagttagatttgctcagcactcacttctaaacctcatctaggcactgaaagaaaaagagctggggaacgatgcctacaagaagaaagactttgacacagccttgaagcattacgacaaagccaaggagctggaccccactaacatgacttacattaccaatcaagcaggtgaggcccagaaacaaggggcaagggaattgttgggtgtctctgagggaggaagcaaagactgactgttccttcttaaccatcctgcctggcagcggtatactttgaaaagggcgactacaataagtgccgggagctttgtgagaaggccattgaagtggggagagaaaaccgagaagactatcgacagattgccaagtaggctcaaccttccagaataccttgagtagcgcggagggtttgctgtccaagacttaagtttctctgcatggggaggagggctgctggccatagaatctgctgtgttaagaaagggctggcaagaaggtcaccagagacaagacaaaaggtgttgaaggcagtgatgcgggcctttctagctgcaggtgtgtttttctgcaggagctgactttatctctctgtcctaagcagtccttgtccctctttctttatcagagcatatgctcgaattggcaactcctacttcaaaga

SEQ ID NO: 65742 - DNA, 1050 bp, Homo sapiens
ttcataacatcagcctcttgcagagtccaggcagtttgtcttgtgtgggatgatccatcatctggagttgtctttcctgatgttgtcccctctgtttggtgctgggtgaggcattagagttggaagtccacatgcttgagttgcctgtactgagcttgtccaagggaatgagcctaatttctttctgttgcttcattctaggactgtgaggaatgtatccagctggagccgaccttcagtaagtgcctttctgctgcctgtcccctgtctctagccaaaagattagagaaggaaagggcaagccctttgtctacctgtgtgtccttgggacctgtaggatttaggatccaacatcagcaggtgtgaacagtgttggtgtgcaggtgaagaggtgcaaggagcagccttgggcgctgcggttggataacgcgccacctttcctgtttgtagtcaagggttatacacggaaagccgctgcgctggaagcgatgaaggactacaccaaagccatggatgtgtaccagaaggcgctagacctggactccagctgtaaggtggggctgcttctggcctccaggggccccccctgcctctttctctgttggggcttttccatgttcagtccctgatttcttccctgtcacctccatttctctctgtttctctcttacttgttctctctccccttgtcagttacctctgttatcttggacctgctgaagcagtgagctgggtggtcctaacacgcttcacctttgtctcttctggactgcaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagag

SEQ ID NO: 65743 - DNA, 1023 bp, Homo sapiens
gagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgttgctttggccttgagtgattttttttttttttttaaaccaggagtttgtcttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggattctaatgtgagatgctgagacctctgtggggagagggcagctatgctgttagctgc

SEQ ID NO: 65744 - DNA, 1072 bp, Homo sapiens
aagacctctggatggtagggatgcccgggcgtcctggataccctgcgggactcggggctcctgcggggaagatggcacgttttactgcccaaggagtggtcaggggggtggagaagcgctgcggataccctcaggaggtctgcgacagagggggctagctgcgcagcccaggagtggtagtggcccccctggatgacaggcctggccgtatcctcccccagagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgagattccaggctgggcacaaagacccagacagctcaagggagctgcagctctccaccctcccaatcctcccagctttggtttcctcattccttaaagggaaaattggcctggtatttctctggaagtttgctcagggcagtccacctgcctccccactgacccctgccccagtcctgtgagaaactagaaaacacgggaggaaagattgggcacaggaagaagatgccctactccacccctgccccctgtgtatctcctttgaagctggacctctggttgtctgtcagggaaaggacaccagactcaggatcactaactctcttacactgtgccacatcagaccctcaag

SEQ ID NO: 65745 - DNA, 1050 bp, Homo sapiens
ccacaacctccgcctcccgggttcaagcgattctcctgcctcagcctcccgagtagctgggattacgggcatgcaccaccacgcccggctaattttgtatttttaggagagacagggtttctccatgttagtcaggctggtcttgaactcccgacctcaggtgatccgccctcctcggcctcccaaaatgctggattacaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccagaaggcagggcagagctagcttctgggttccttcagcccctgcaaggtttgggactctgtccacaggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggcgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgc

SEQ ID NO: 65746 - DNA, 1047 bp, Homo sapiens
gcgcccgcatcgccctagcccggcggcgcggggggcggcgacagccagagccccatggcgcgggcccgggcgcggcgggcgggggccgggcgcggggggcgactcctccgcggccccctcccgagccctgggtgcaggcagcgcagcgcagcgcagcggaggcggccggaggagccgggcgggcgggcggccggtggcggcgggcagcggcggcggggacggcgggggcggcggggggctgggcccgggctggcgggcaggcggctcatgtgacccagacacgcgctccccaccggcccgtggggcgggggcggggcggcggggtgggggggcgaggccgtcggcggggcccgcctcctccacacaccccctcccgcctcccgccgcggcaggggaaaggggacgcaccgcccaggaggctgggctccccagtcgccgccgccactacccggagggcggggcgctgccccttggcgaggccggggccgggggcgtcgggccttaaggagggagccggacacgagctctgcgaatcactttattgcgcgcgtttcggggagcgggccgtccagggaaggaagcaaagcgggaacgcactgcaggccccatccaggtgagcccctcaggggccggcgccccggggcacgatctcggggccttgggttggctcggatggtggcggctgccgctgccctagccgttgtcgctcctgctgaaggatgcctctgttggccctggaggagagggcacctgggtggttgggatagggatcccgaagtgtggttcctggacagggagcagggagcagaatagagcagggacagacctggcccgtgcccgggcttcgttgtagaaggctgtgatgatccgatccttttcatccatgaagttaaggtgcatctgcttcaccttcctgcaatgggtcacaattaaccctgggaatccaattcctgctgtccctgaagtcctgcccccttccaccccactctaggggcctcacagctttttacccttacacagggttaggaacctcagtctaacccttcc

SEQ ID NO: 65747 - DNA, 1093 bp, Homo sapiens
tcccgaggagtgtcaggaggggatgacctttgcaaaaggttcatccttcgccctgcagcctccagtgcccagggccgagtggtgtggcaggatgctcaggttgtgatcttagtgggcccgaggcacacatgagtccagggctggggctgcgctccagccagcatgaacagatcacttcctccctcctcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgc

SEQ ID NO: 65748 - DNA, 1145 bp, Homo sapiens
ctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactggtaagtgtggccccggagcccgggggagagggcggtgacccgggacaaaggggatcccccggggcaaggaagatacagtggcggtggaaccctcctgttacctacccgtgttccatactctccctgccctcccccacgttcagtcggtcggtcggggtctgtgcccacagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggtgagtgggttgggcgggccttttgggagtgggtggggcttccgaggaccagagagtgcttgggagtctggttctccataagccaggtaggtgaccttgggcaagtcccctctcgcctctaagccagtttccatggttctgccttgcccttgcctactgcccaggtgggcaccagcaggcagtgacagtgtactgtgagctgcccaaggctctgtcctcttaaagaactatgaccagctgggcgcagtggctcacccctgtaatcccagcactttgggaggccgaggcgggtggatcacctgaggtcaggaatttgagaccagtttggcctcatgatgaaactttctctgctaaaaatacaaaattagccaggcgtggtggcgggcgcctataatcccagctacttgggaggctgaggtggaagaattgcttgaacccgggaggcagaggctgcagggagg

SEQ ID NO: 65749 - DNA, 1015 bp, Homo sapiens
gtcaaactctgtcccatcttccagcttcccctgtggaaccatgagaaggccagtgaggaagaggggaccacccctgacaccccctccctcagctgctttccccatcaagctgcccccccacgcccacccacagccctggtggtcagtcctttttgttttttgagatggagtctctgttgccatggctggagtgcagcggcgtgatctcgcctccctgcagcctctgcctcccgggttcaagcaattcttccacctcagcctcccaagtagctgggattataggcgcccgccaccacgcctggctaattttgtatttttagcagagaaagtttcatcatgaggccaaactggtctcaaattcctgacctcaggtgatccacccgcctcggcctcccaaagtgctgggattacaggggtgagccactgcgcccagctggtcatagttctttaagaggacagagccttgggcagctcacagtacactgtcactgcctgctggtgcccacctgggcagtaggcaagggcaaggcagaaccatggaaactggcttagaggcgagaggggacttgcccaaggtcacctacctggcttatggagaaccagactcccaagcactctctggtcctcggaagccccacccactcccaaaaggcccgcccaacccactcaccgtgtagtgcatgtgcaggacatcccctttgcgcgatttgatgggacagtggtccacccgcttcttgaccccgatctgcagcttccttttgccctcggcccccgtggccgtggccacggcgctcaggcagatggacagtactgtcaggacccggaaccagctcagcctcatgtctctgtgggcacagaccccgaccgaccgactgaacgtgggggagggcagggagagtatggaacacgggtaggtaacaggagggttccaccgccactgtatcttccttgccccgggggatcccctttgtcccgggtcaccgccctctcccccgggctccggggccacacttac

SEQ ID NO: 65750 - DNA, 1601 bp, Homo sapiens
aagcatgggctctttgtttcctctttgccaggcctgggtccttcccagtgacccctcagccttcacttcctcctcactcccggggagctgtgacaggtgtttgggggaggggaggggggtatgataagctgggacagctgcacccaccggtgctctggtgagatggggggcccggatgttggggagacacatctgctgggttcccagcccaaggtccccaaccctggctgtctggccttgtctgtcaccccccgtgcccactggcagggacaggaagctcccccccccaccccgctttgggcagtttgccttggcacgggcctgatctgttttcctccccagagcagctgctgttctgtctgctgggcagagggctgggttcctccgaggtaggcaggggcctcaacccagagcccctctcacaccctctctccaactcaggcttatgtctctccctcctcccccacccccaccccaggaagaggagatcccagaactggagattgacgtggatgagctcctggacatggagagtgacgatgcccgggctgccagggtcaaggtgagggggctggggggcgatgggttgcctgaggcactgccccgggaaagtgaggctgtggagccaggccctcaagccccagctcctgcctcaacagaatggggccaatgcctagctgtgaggttgttgtggcatctcctgtgcctcagggtggccccagtctcttggaagtgggtataggcgagctccaggcccccactcctgaggactcacttatccttcctcccccatcctctgctaggagctgctggttgactgttacaaacccacagaggtaagagatttcctggggggctggcgggggtggcagggtgaggggagcccggctcctgtcatcttggggtctggtctccttaatgtttaccctcccaccccatccaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagctaacaggctcggctggtctcttttaggggggcacactgctctttgacttctgccagctcagcttctccccaggtgaccacaggccttcctaagggccacgtagccatgacgatagcccagtgctggctcccagaccaggagttgaaagtggctggggagctgtgggggtggggggagcagtattgctgttggcaggcaggaacactcctttctctctgggcaagggccaccatgtcattgagcctagacccccaaggctccacagtcgggaaaggagaaggtggtggggtatgctggagctgaggtctctgagtctc

SEQ ID NO: 65751 - DNA, 1301 bp, Homo sapiens
ctaaggcgcaaagagctgggcagtgcgggggccgcgacttataataataaaggcggtaattgcggctgaccctaggagcgtgcgtcgggaccgccgcccagtcggctccgcagagagggcgccgtgccggggctcctgcacccccgccctgcggctcctcggtccttcacatagccctggcccacctccaataagccgacggcgcatcccattccctccctctattttattttctgcatctttaaatggtctcattcattcgtgtattgtctgtctcccacttctagattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattactacaccacagaggttaattaagtcgcactgctagataaaacgggagacgagactttgaacccaggctgtgtggctcaaaccccctgacacgaagtctctactcaacctcctcactaccctgtagacaccacccaataaggctgcgcagctcccgggggatgtttctgtggaaggcaggctcaccttgtgccaccccaaacagggtcttggatctgagaggcaatgtttctgctccagcccctcaaagacactctttggatgttgtggggggaagccctctgcagcgggtggggttcagagatggattgggattggccccggggtcacacagctggggctgcatccaaactccaacccaggatgttgggctcctcctttgccctatagtcagagagaagagaccaagagaagacagaggctgggcattgtgaaggcaatgggctcacagggctcagttcagggaagggtagagtgagctgacccctccccttcccgtgcccctcctccggcctcagcctcccttcagccagtctgggtgccgaggaagggctgaccctcgctcttgcggattaggtaggatccaccctctccaccgggagccctatccgtggcctggcctcctgccctaagcctggcctgataggaggatcactttaccccagtccaaattccccaccacaccccaccaggccaggccagctccctctgaacccaagcattgtttgtaccttgagggtgcacacagatta

SEQ ID NO: 65752 - DNA, 1010 bp, Homo sapiens
ggctggcctgaagggaaaagtttcttcttttcattccactgtgataaacccaaataaggaagtgggaacagggagagggccctgggggtggggtggggggtgctgacggaggcttggggcaggagagcaggggacctgggctgcctttgaggtccagacccctggggagaggtgggagggaaacactaggggcagtacccatagactccccgctctgcacaccattcgggggcctcaggcccagggtagggttgggaatccggagaagtgctggggctgggtgtcagcacactgaagtggggaggcccatgcatccccaaattttgggggccttctgttcccagatgaacgcccatcttttgtaagcaaagcctgccatgggtggggctggtgcaatccccattctccagaagaggaaactgaggtctggaaagcagagagttatcccaggccccacaatggggtgtggctgaggccaggagccgggagcctggcagaagtctccgctccctgcttcccaggtcacaggacgctgcaaccacactgcctgcaagcaggtcctggctccagtgatctcgggcaggctacgaagtgtccctgtaactcagtgtcctcatctgtaaaatgggagtgacaacagcacatgcctcttaggctggttaggaggcctttgtgtgctcgaagatgctaggtgcatagaactgtacctggtgcgcagtaggggcggtgtgcgtatatgagatgtattgataataatagtattgtccaccagacactgagatgcattttgggggtggcacccaacatgaggtggggtccttttctgtctggaagaacctggaataggagggttctacctgtagccacttgttcactctggccctggccgagtctaagccctggaggacagcccctctggctgctggtcctgagtcacacagggtggccctggtagtgtgccagggaccgggcccttcttagaaaatggggctggcatgcacttccctgcc

SEQ ID NO: 65753 - DNA, 1050 bp, Homo sapiens
acacggggaggcggtgagtgggggacacaggggctgcccagccacaacccaggtccacaactgcctctggtacacagtaggtcacagagcagcctagaacacagcaggtgttcggtaagtgacggccgactcacagaataagacagtgactcccccttcgtccccttggtgccagcccaccttggctgtgtcatcctgcacggccatgaagttcaagaacactgtgttcactgggtctggcccagacaccaccgtcatcagcttctcctccagccgggcatcgggacccccaaagcccagaacttcccggatcttggggtcctgagtaggtgacagcgaagggtgaagagggggctcccgcacagcctcgctgtggtcttcactcccaggctcatcactcaccttgggcaggcgggcgtaccggcctgtccgtgtgtccctgatggaactgatgtccagtgtgtccacctcctggggggaaccagatgccaggctgagtatgagaggctgcagggcaatagccaggagcttccaagctctctacccaggccagggaatggccagcccctggctatagccccagcctcagctcctgccctgagcacttcctgtctgggcagcagtgggagaggtcagcctgcagccgggccccacccccacgggcagggcaggggtctgggacaggggtccttggcctgagcgagctgcaccagcgcccaccctcaccatgttggggcccgtccagtacaagaagaagccattggggtccacacgcagggtcaccaggttccgactggaggtctcctgaggacagcacagggcagcaggggtcaggaagtgagggctgtggtgcaggcctggcccctggggccctcccatcatgcaccccagagttcctgcccatgagctaagacgaaacctcatccagtccacaggtcctgtgtggctgcctgtggccctcagaacaaagccaaggtcctaggtgtgacatttagtgtcacacctacctcaaagcctcttcccagcctcacctccctctggccctaggat

SEQ ID NO: 65754 - DNA, 1045 bp, Homo sapiens
caaaaattagccaggcatggtggtgggcaactgtaatcccagctactcgggaggctgaggcaggagaatcgcttgaaccagggaggcggaggttgcagtgaaccgaggttgtgccactgcactccagcctgggtgacagagcgaggttccgtctcaaaaaaaaaaaaaaaagagattggattggaggcagggagggctggagtcttccacacaggaggtggtgtgagctgtgccagggctgaggtgggtggagggagtgaggagagggagggattgttgaggcagtggggagctatagtgagtctcagggatgactccccccagctcacgctggtgggatggacaggtggtgggtatccatctgagagatggagagccctctgcaaatccagcatgtcctggttccaggtggggccggggtggtgaggagctgggctggtgggcggcctcggtgacagagcctcgccgccccagcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcgtgagtgagcccctggcatgaaaccccatggaccgggggacagtcttccagcttcagtgctgttggactgctcagggacctccaaccctgcgaacggccactgacatgtcccgtagacctcagcttcctctctgggggagggatctctgacctctgacctcggttccgcagggcaaagcaacaggcaaagatggctgagtactgccgctccatctttggagacgcgctactcatcgagcctctggacaagtacccggtacgggagctcggagcgaggggggtggcatgggggccagggtgctgcggacccggtccagggccctgactcgt

SEQ ID NO: 65755 - DNA, 1129 bp, Homo sapiens
agggtgccagcttgttgcgctcaacttccagaccctcggtgagccctggccccctccatcttgaccccgaccctcagtcttactgacttctgacccacgatcctgctggtcttgcctgaatggacctctgaccctgtctcatcccagatcccaggggaacccagctcccgactcaccccgcctcctgcccttggctgataccagacccctcccctgtctgatctgtcctggatccggaccctgatgccatttgagcccgcccctgaccctggaccttggatgccatctgacctgatgatctcccattccccacatggcaccgtcctgcctgatccctgcccctgctcgacgtgcccgtggcaccccagatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtggggcttgcgggcggctcaggccaggggtgtcctgggggcaggactctcagcatccgcctcaccctccttggcccacccccaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtgagcctggcccctgcacccgcccaggcacaggcagatccagcccagaccgccccgactctcaggtgggagaacaggaaccaggcacaccgttggcgactggggatcagaaagtggggggtgccatgggtcccccaggacctgcctgtccgagcgtcagtctccctgccctccttagggtaagagaccagggtgagaaggtgagatgggggttggggggtgtcagctagacgtcttgtgtcccctgcgaggagtggacacagcctaccctgtctccgaggcaggagctgaggtcacaaccccaagctcatatccgctcttcagcaccccgcacggccctgcatggacgcggcctctgc

SEQ ID NO: 65756 - DNA, 1044 bp, Homo sapiens
tcatgactcactcccgtttctaaactggcaatgaccagaactgtctgtgggggccctggaggggcctggctgcctgtcatcttgcctcagggtcctgatggctgcagtcatccattaggccaggacatggaagtggggtcagccatcagcttagtggcaatggtgactgatggtcagtaggtcagctcgtctgaaggtctgctttgttaagctttgatggctgtggttagctgtggcctggtagccacagtggcccagggtcagccctgtggctcagctccagtctggcccacaggtggtgctgcccacgctggcttcacttcgcattgcagcctttgaggaggggggtaaattcgtagggcaccggatcctgcctgtctctgccatccgctccggtgaggccttggtgggctctgggcagcacagcgggcagtgggtagggcccccacctggcccagcaacccaacgttgccttcctgaccacccaggataccactacgtctgcctgcggaacgaggccaaccaaccgctgtgcctgccggccctgctcatctacaccgaagcctcggactacattcctgacgaccaccagggtgagctgggggtgggcggggcctgcctggccagggagtgtgagggacaagggccacccccagggcctgggagtggccgagctggatggccccgactgagtagggaactgagtagggaacagatctgaggacaagctctggaattcctcattgagaccagaggtggcgggtgggggtggcctgggggctctgtctctgagaccttggccttctgcctccccccagactatgcggaggccctgatcaaccccattaagcacgtcagcctgatggaccagagggcccggcagctggccgccctcattggggagagtgaggtgagccggggcagggcagggctcaggctcactgtgacccagggggccgctggacatgactgctgtggccacatgaggagggggcttctggtctctctagcgcagtaggcttggcagccctgggattttgagga

SEQ ID NO: 65757 - DNA, 1062 bp, Homo sapiens
agcggccgctgccctgacccgacgggtatcagccggctctccccctccacccaggacgacatgaacgaccgaggccagggagtcctctccttgggcctctgcatccccccatccttggctctggggtaggcccagggaggagacacccccaacccctatccggtctgtcctggagaaaagagactgcccttccatgcccctgagtgaggggcctggggcccaggctgcctgtgttccccaagggcaagggtctctctgttgaggaggaggggcctgtcagccacaacttctttcctcctgagcgccccatctccctctctgcaccctgcaattcccacccctccgtatttatttccctggtcccgccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtaaccaactgtggtcccgggtggggggcgggaggtggcaagcctcaaggacccacaggagtgaagggcatctctgctcctaggtggtgttcaaggccaaggtgaagcgtcggccggagatgagccgaggcttgtaagtactcgggacactggtgggctcagcctccaggtcaggggcaggtgacagtcccatgtagatcccttcccacctctcagggctgagacaaaggcaacccagggaatgtctgtggaagatcttggaaaagttaaagcacctggcgcagatggct

SEQ ID NO: 65758 - DNA, 1092 bp, Homo sapiens
cggcctggggcaggatctggctctggctgcgggtcctgactcgggtcagggttgggcctccgatccagcccgctccggggcagggttcaatcccgcatttgccgaagtccctggggctggccggggtggaagacggggagggctctatgtctgggaaggggctctgaagaccacgtgggggcgctcgaaggggcctggggccaccctcctctctgggtcaaaggtcatcgcaccggcaggggagaacttcctcctccttggctctccccacttacttcctgataacctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgtgaaaagctctggaggtgttttcatgagtccgtgcctgtgcgtgtggatgtggggagacctagtgagagtgtgtgtgatcatgagccttgactgagttcgtggatggggtgtgcgctccaggagaagtgtgtgagcacaagtgtgagcaggagtgagcacgggtttgggaaggccggtgcaagtgtgaaagccctcagcagagagcgagcctgcgtgggcttgtggggctcctgagcaccccggtgagtggagtgtgtgaactcggtgtgagcacgtccactggccttgggtctgctctccaatgcagaatacccagatgagggcagggtctcagaggtccccccaacatctggagaaaactgggaagtatcctgctcctggctagggattccaggtggggttgaaggttgcctgggggctacggttaccctgctccctggcctgggtgggagtaggggctttctaagcctcccccaggttcccaagggggagacctgctgtcagttactggccctgaagactctgtttccatggcaacagctaggagggggcagtgttcctgggcagtccttcctt

SEQ ID NO: 65759 - DNA, 1068 bp, Homo sapiens
gggcgaggtgacagtgactatcaggtcaagggtggaagtagttgccaggggcaggaggcggattctggaccttggaggaggtaaagcccaccagaatgtgtcggtggcttggatgtggggtgtgagaggaaccagagattctgcctaggtttcttcttgggcaagtgaacacgtggagtccacgtaggctgtgttcggtccgagatgccttctagacatgcaggatgtcaaggaggcagctggagagatgggtctggagctcacagcaagtccaggctagaggtagaaacgtgagagccccacggctggggaagattgccatgggattggagatgagctccaaggacagccctggcagtctggatggaagagcttgggaagatgctcagaaaccacaaagtggctggtgcggtgggaggaaaaccagagtgtatgctgtcctagaagcaaaagaagaaagtgtttcagtgtttctaggagcaggaagtgatcaacagccttagatcctccttttaggccaagtaacatgaggactaagaattgaccactggatttagcaatgcagaggtccttgtggcccttgatgtcggcagatgagggcagtgtggtccagagatgaggcttggggctgagatgcagccccgctgcctggtccagctcctccctcatccaggcagggctcccccgcccagcagccactcccctccctgcctgctcatggccccctgctctccctttcctccccatacccccagacctgtgcttgcccggggagagtcagggctctcctgtcagctgggtcccctcccagccccgggaggccgccactggagccctgcctcttcctggcagggagcatcgagtacagctgtccggcctccaacgagtgtgagatcaccaagcggagacgcaaggcctgccaggcctgccgcttcaccaagtgcctgcgggtgggcatgctcaaggagggtgagcgctgggcaggggctgggcgagggctgggggagtcggggacccgggccaggtgggggtgaggcctgggagttctggtgagtggactcggggagg

SEQ ID NO: 65760 - DNA, 1164 bp, Homo sapiens
ttctcctggctatccaatagcatcgagaggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacgtgaggatccttaccccgccccagcatatcccggggaatgcggggcgggcacacctcagccgggctgaggcgggagttcgggatgcccggagataattttggcctcttgcccacagttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagtcaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctgga

SEQ ID NO: 65761 - DNA, 1108 bp, Homo sapiens
aggggcctcaagtggggacaccagcagggtgtggggatgggggccattgccacggcaggccctgctcctgggcctctgccccttggtgcagggaagccacgcctgtgatggtgaggccccactgcgtggagtctagggggcctctgtgccctgcgcgatgctgcctgcctgcccaccccaggtgtggtaacagccctcacaagaattggtgaggtgtggactgctgctgcctctcagccacctacagggagtccgcattccatcaccgcgtggagctgccctgccatgaaccacatcaatacctggctcccaggcacttcctgcgtagtggtccccaggggtcagcccccactgctgactcaggcaggccacactcttgagaggtcagggagaaggtcaaagcagggcctcatagagcaaatgacccttgaggcagtgggagtggcgcctcaagtgggaggcggagggaggcccatagccctaggggtgagccccatagccctaggggtggagggtgggacaatcccatgctgccgcagcaaggtgggtagcaggagtagggggggaatgttggggacaagagaggatgcctggaggtcagtgggctctctgaagctgatgagcagcttgccttccaccctacaggcaccttggccatgggctaccgtgtgcagcccccaagctgggaggctgggagaggcaccagatgggcagcagggagcaggacccatgatgacagcaatgcccaggaggtggaggtggagatgtgttgggagggagggtgcatccagggagctgcttgctgaaggtggaggggctgggtgcttgtggtcacgtctgtgagaacagacactcagtaggaggggagccagcctccctgcccagggttgcaggtgctcagcctacccgagtcgtgctgcccaccaacctctgtcactgtggttctctcccacaacctgccaccccttcaggggtcccaggtgggggcagggaaggaggctgactgcacctcgagctgccctggtaaactgcctgcctctcctctcctgccaaactcgggggtacagtgttgtcctcatggacacgcataacacaaagcccctttctt

SEQ ID NO: 65762 - DNA, 1040 bp, Homo sapiens
tggcaaaaccccaactctactaaaaacacaaaattagtcgggtgtggtggcacgcacctgtaatcccagctactcgggaggctgaggtaggagaattgcttgaacccaggaggcagaggttgcagtgagccaagatcgcgccactgcagtccagtctgggtgacagagcaagactccgtctcaaaaaaaaaaaaaaaaaaaaaaaaattgtacctgcctcacaggatcctgtaagataatgagcgtagggagcttggggcaatgcctggcacctagaatggacctgttccatgggagggaatggcagcaggtaggcagtgaaggtgagggtagggctggcgggctggaagagccggctccaaggactgagagggtgggggaagctagggacaaagggggaattttgtgagatttcctggttggagcaggagaaggtggctggccagggggaggtcagggaaccagggggtctcaggttgtccactgggtggggaagcctcccaggcttgggggagggggttctaggagggctgtggccagggcccggaggagggcagggcaggggctgggcgggaggttctattcaccgtgcctcctaccccagtacttgcgctagtggctgtcagccagccaggcagcagtgcctcatcggacttgtagtttttcagggagaggtggtggccaagagtgtcaggaggtgcagtgccccttgggcaaggcctaggtgcagttattaagccaggaaggtagttttcagcagcaaggcttgtaggcttggtttccaaggcaggatttggctggcagctggtcatgggcagctgtccccgaagcttcatcctgccaggccccccatgtggcagaatggtttggtctccctccctctggggcacacaggccagaatgggcctcccgtctccttccaaagtggtgcagcccaaccgccaaaggccacaggtcacctagctggcagcatcctggcgccccctgcccccccagcccccactgtcagctcctgacttcctgtccctccagccctccgt

SEQ ID NO: 65763 - DNA, 1057 bp, Homo sapiens
gcaggagaatcgcttgaatccaggaggcacaggttgcggtgagccgagatcgcaccattgcactccagcctgggcaacaagagcgaaactcttgtctcaaaaaaaggaaaagaaaaagaaaaagaaaaaaaaagacaaggcaccaaactgtacacagtatcatgaggctgctgaaaacccggggtgagatgttcatcttttcacctatggctaatgtgtgcttggagttttaacaaagacctctcatttttttctaaaaagaacacccgtatcacagatgtcaggagcactggaccttcgggaactaaatacaatcggctcactctccatttatgcttttgagcaaagttcaggagggtttggggctgaggaagctctgtgttcctggttactttgtgcccctgctagagtcgtcctctgccatgggggcttgtggcccttcctatgtctctatcctggagggattcgtatccttgaaacatgaatggcagtccccagcttttacacacagacacacacatgtacacatagagacacacaggcaggtgggcacatgtgtgggctcatgcacacacacagcaggcaggcacacacacgagcacacacacgcatgcaccgtccacctgagttctcggggtttgaggagatggagggcgagttcgccttgcagccatgaaaactgcttgtggctagacagataatggactggaccatccttcctgatggatgccctgggcctctgtttaccacgcagctcctctctacccctttcttctctgttttcttttttttttttgagacggagttttgctctgtcacccaggctggagtgcagtggcgtgatctcagcccactgcaagctccacctcctgggttcacaccattctcctgagtagctgggactgtaggtgcccaccaccatgcccggctaattattttgtatttttagtatggggtttcaccgtgttagccaggatggtctcgatctcctgaccttgggatctgcccgccttggcctcccaaagtgctgggattacaggcgtgagccaccgcactc

SEQ ID NO: 65764 - DNA, 1033 bp, Homo sapiens
tctgaaggttggcaacagtgtttgaactcagggcagaggcagagggctgtgggtgggtggggagcaggagaagagcgccaagatgtgaaggtggaatgtggctggcctggctgcagtggggctgcagtggggcaggcgggacctggcagtggaggccctggggtgctttaccaccaagaggctgaggggcttctgggcgtgatctatgaagaccacaccctgcagagaccagcgagaggcactcagatgtgggcagggcttaggctgtgctgaagagagagccagagaggaaacctccaaccctcgtcaggcccagaggtgcccctgcaagaggagcaagtcctcccaccagccacctagagctgagccccagctcccttctaccccaaaccaggaggttgcacaattttggtttgagaggaggaccaggaggctgatgggagtcacagttgttgactcagtggctgatgggaattgtgttctacactcctccaaggactgatgggagttatagttctcaccttttgggggctgatgggaattgcagtttctgcccaagggactccagttatcagacctagagatggggagacccattctcccctcacaaagccctcccctctcattcccatgggccctatttagcaggtgcttccctcccagatggctgtgtatgtattttcttttctttttttgctttcttcttctttccgttgttttgttattgttttaactataataagagggccagaggcagtcaagccctggccaggtcctggcggcccatgggggttctggggagggggaggggggaagtcagtgggggtcagaggtggagggtgaagaatgagaaagttggggagttaggcttagctcaggaaccatgtgtccctgcccactcccctccttccttgcccctccctacctccctgcctctacatggcttctctccacccctcccagagtcctacgggacaggaccctgctccagtggtatccaactcctccctgcccactcttcctcatgggccac

SEQ ID NO: 65765 - DNA, 1045 bp, Homo sapiens
cccccatgcctctttctcttaatacagtggtgattgtcttgaggacatttgaaacaataggtgggaggttgcgggggcggggggcaacccctaaatctgatccttgagcaaggctgagtgctcttattcaggtgagaagttttactgcgccattgtcctcaaagcctttttcacttttctctcttactgtttggaagcagtggcctcttctgactcttgtgggatgcagatttctgggctctctgtattcttttcacttctgcttgcaaaccagccagttcttgcctcctcatactccttgcctccttggtctcttccttgtactatgttactaaaagtagaaagtagaagcctcatggtcagtggcctttcccagccctttccctcagtgcccagactccacaggcagtgcctaccctccaggttctcatgagcaacggtgtgcaccacatgctttgccactgcattatgtgggttttatcttcccagcctccacgccttggattgtcacgagtgccttctcaggtttgtgttatcgtgacatccatttctggtgccagtgtctatattagttaaagtaacatttgtttctgtaacagataagccccggatctccgtagttaattcaagagaagtttctcactcaggtgcaccctacctgggtatgcctgatcagcaggtggctctgctgccaagggtgctttaggaatccacactccttccatctgtggtgcctccattttcaacttgtggtttccaaggtcactgcaggagaaggagcatggaaagtggcaccaggaggctgctggggcactggtacgggcagtgcccactactcagtcatacaccaggcctactcacaggggatgtcaggaaatgtagtcttgcttcccaggagaaggggaaaatgagtttggtgaaggacgcgttccctggggtgcaccgctggtgctcagatgcctgtggtgcactcacatgttctggggcatgttcacatatggacatgtgcacacggaactcagacccaggctcagtggccggcagg

SEQ ID NO: 65766 - DNA, 1028 bp, Homo sapiens
gaatctggcctgggggcctcccagctccagaaaagacattcaggctgagggtgggccacgaccttggaaggggtgtggatagagcaggaccatagcatggcctgtggagccttggggcagaggctcagcttcaaaaaccaagggcagaggggtttctggggcacaggcgcccagacccagaggctaaagcccagttgccctccatgtcccccaagtaggctagagctgagaggggtcattcccatgggcctgggcccagggaccttcaggggagctgccagctgctgggccagaaaggccttcctttccatagcccagggcctgtgctttctgggtcagatgccttcctctctaggaggcccctctgctgagtgctgttacttcttcccctggggcgatcttggctcaaggatgtacactccaatgcctccattgctttggggggctctgggcatctggtgacttcaacacacagtaccccctgccctgctttactgctctgagctctaggcgtttattggtggctcctgtggccaacacagcactgctagcccaggcctgctggaagtggctgtgatgagcggccccataaaagctctgggacggggctctggggacaacggtctttgagggtcctgaagaaagggcactgagtggcaccacatgtgtttacacacaggtgcccatgttcacacactctgggacaggaattcctgggtaacaggaggagtctctgctttccctgcaccctgcagaggggtatctggggccagatggtcaccacgtaggggcatgcagtgcacactggatcccacctgggccatactctgcccaccgaagttctagcctcccagccctgtcttggagtctagtcaggggcctgggtctgatgctgaatgggtgcattggtggtctgagcccttttaggctgcattagggcagagggtgaggaggcgctgaagcaggcgggtcagctggttcccagtcagggatctgtgaggtcactgaccactgagccaccctcttgg

SEQ ID NO: 65767 - DNA, 1103 bp, Homo sapiens
aacccccagtgccagcagctgaaggttccgggggagatggggcaatgtggtaggccctctgcccaccccctccctcccacaaaataagcagcaccaaaaccaaagttaaatctaaacttaaacataataaacatcttttctaaaaaccaaaccaaaacaacaaactcagagggttaaaccgacccccagatccactaaaaacaaacagaacagcccaaccccacccagctgggaattctgaggtgtcatactggagtgtggggtgagattggagctggagcgggttttattggctgtcagtgagcgaagcaaggtccctttaacattttccacttctgtgcttgcatgtccaggtggggaggaagggctcggcttaacagggcctggtcccaggcagtgctgggccttggcagtccgggagaagagaggggatcctggccaggggtcagaaggcctggttgtaggtgggaggtcagcctgggcaggttgctgcttccacacaccatcactctgtctcacctccttctctgctctcacacgcaccgactccaccttggcctggcagctacctcctctgtctctgcctctttgtctcctctatctgcctcttccaggggctccatggcttcagggcttggggctggacactggggcaggatgtttggggaagcagagggagaagatggggatggactgagggaagaggatgaagaggggagatgaccttggagctggagaggagagggaatggggaaggtgggaaggcttgcacatggtggggaggagggactgggctccccttccccagcccatgtgtaccctgggtgccctccccttctggggtccccacctggctgggctaggggctgtggctgacaaggactttccctttggctttctgccccttcctcatttctccccgtcccctcctcccttactggctttctcctccattcctctttcctctccttggcttccttcttttcttccttcccttcctggtctcccctcactgcctgccccttctctgtcacccccttccactcctgcaaggccgccagctgaccatcttcaacagccaggctgccatcaagatcgggggc

SEQ ID NO: 65768 - DNA, 1001 bp, Homo sapiens
gaagtctgctgcccacaggaatcatgcctacacagccagagctgtcagtgttggcttgttggggggcgtgggggataggtggaatttagtgtaggagggttggtgtgtgttgagtgtccctacatgtacccagggacttgatgtaggctggcatccctctgcagagctgttttttcatgtgtctgtctgaccatacaaatgtctgcagttgtccatatgtctaaggttgacctgtgtgtacatgaacctctgtatgtattagggggccacgcaggcctctttatctccagggactttccagaaatgtctgggtacaagcctgcgtaattggtgtcataagcctgtactggcatctttactccagcataggtgagcccatgaaagtttacacattggccttttgcccctgcccctcgcagtcagcatggggcagcttctctgcctcagcctggctatctctccgcctgggagagtgatggaggtcgcagatgctcactctgcttctcagtcaggccctgtgtgtgactgcaatgtcgctcagactgtatctcaccatctctgtgtttctgcagttctccctgcagcgttcctgtttcccctccctctttatctcccatgctggggctctcctccgttccctcccaaggctctgtccacctcttctctccctgggcctgcatgtcagcatctccatctacctctccacatctctcctcatctttgcatatagttcagtgctatttccatatctttccattgcttcccctctggtttcctctcattctaaggctctgtctctgcctccctcaatatctttcagagtctctgcctcctcatttcttccatgtcctcatctccatccctctcctgtgctcctcagaccttggtttgtccttggccgccacagctgtcaccctgttgaacttggtctgtctgcattctcaaggctccctgcaagcagggactgagtgccccggacctagcacaagccctgatatcta

SEQ ID NO: 65769 - DNA, 1044 bp, Homo sapiens
cccaaaataaaccccattagtcgccatgttccctcctgcggctgactgagctctctgggggtgggggtgggggtggggggctggtcacccagtttcccggaaaggagccttgtctgggaggcctggaggactagtactccatggcctgcagagaagggaagggtagagaacaatcttgcattctttagaacataaatggagcagatgagattcataaaatgcttaattaaataattagccactaatgactcctcacaaagcacttcttgtgaggagaggggttcaagggaggacttaaagaaggagagaaacagatgaggcctaagggcaaaagcctagacagggagaaaatgtcagtctgggggtgggagaactctggagtcaggaactaggagcctgcagtggggggcaggagggcctgcagcacttctaaggagcaggccttgccagcagccaaggaggtggcccagttggtaacactaggccgggttccctcaggtacctcggggtctctcgcctcagggacttgaacccccttgtagttggggcaatcaggggtgaggaggctccatcccagggagctcctaggaccccaaaggggaggggctgcctgagtgctttggggggagccaccatctgcaggcccagggaggtgctgaggagagaagggaagattgttgcctggttcccaaagaggtagtgaggccagcagggggttgggggaagcaggagccatgggtccccttgctgttccccagagcacccaccatcaacaccttccatccccccagagtgagaggtgaccctgggaggaagggcaggagggaaagaaccacctggatggctaataactgacatctcacctctgcctgtggccaagaaaccacccccagcagacagagggggcttggctctgccctccccagacccaggtgtcctttctacctgagggccctggagcacagtggtgagcactgaaccctcaggatggggccccaagtcgagggcggagagttggctgacagtggggtatgcagtgacccc

SEQ ID NO: 65770 - DNA, 1057 bp, Homo sapiens
gagggccagatgtagaaggtaatggggaggacagagcttgggagtgatgggggcacagagtatggaggacagagatggaaggtgacaggtacaggggtgagaagagatggcatgcagagaatcttaggggtctaagatatgaagtgatggggggcctgagatggggctgaggaaggacggaaatgagaaggtgatggggtctgagaaggaaggttaagtttttccatagatggttatgaggggcagagataggaggtgattgtaagtggacagcgatagaggactgacacaggaggggaagcctggaaacgggaagtgctggacctacagaggtgagatgctgggggtcagaggtagagacagagcagagatgaggggacatggaagggagacactagagattaggggaacaaggatgggagaatggcgggacagtggagtgagttgggaggtgatggaaggccagtcatgggaaaagaaaggaaggttgctagagggatggaggtaaaacagagacatacatgaagaggtcaaggaggaagagacatgtcagaggcagaaatgacagatgtgacagaggtgggagagaggtgaagggggagagatgacagaccagcgatggaagggtgagggtgaggcagaggtggaggcaagacagatggagagatgataaggggccgagatggagaaggtgatgcgcaagagaaatggaaggcagagctgcacggagaggatgaaaggacagacagggcggggagggtaaggaagtagaaggagataatgaaccagacctaggggtaagcaggtttaggtgaggccaggaagcaaagtgctgaagacagagatgagggtgatgggggagaggagagatggaggcaagggtggggctgagatgatgggagctggagattggaggtgaaggggctccgggacgcaaagcagaggggccaggctcggcgtgcacagctggggtggggcccgcgggggcccagctgcgcacacgggaagcgccccccgcccccgggccaaccgggtggccggcatctacagtgccact

SEQ ID NO: 65771 - DNA, 1051 bp, Homo sapiens
gtccagagagtaccttcaggagaagaaaagtgaggatgccatttgcacccatcctgtgccccagaatgggggatccgtcctggagcccccattcctgttcagagtgccctccaggaactacttcttgggggacctcatggggagctctccaagtacccttcaggctcctgcctgctgagttgggggccagagggcaggtcttagcccaccctgaaaccatcaaatcttgtgctgcctccttttcctcatttcctctcttcccccactgttcctcctccaagacaagcagacataaaaatgggggtccccctcccctgctgccctctggcccctcctttgcctagccgtagctcttcctagggatttgatgttggttgtctcctgtctttctccctccctcctgggctggacaggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtgagtagggctagggaggggctgcaggctgttcaggagccctttgtctcctgtcttcagcgtgacttagtctgacctggctagttgtctgggtcatctgttccttccaagtccatggtgggagacaccccctctttaaaacctaaggcccactgactccatcaagaggcttctcccctttgatttccttgagccttggaaacccctatcctcatagaggaccctcaaaggcagctgtggtacagaggaaagaatgctgggtatgaagactaaagaccttgcttgagtcccaactcttccactcattggttctgtgactgtggtcaagtcacttgactgtctgatgctgagtttcctcctctgtggatgggtagtcagtgcctacttcataaggttgtgaggggcacatgagagtgtaagtgaacatacttcattgagtggaaaacagctaccacacgtcagtggccttgtcatta

SEQ ID NO: 65772 - DNA, 1026 bp, Homo sapiens
tgtctccagtcaccctttttttgcgttttcctggtagtgtatcttgcttttttttctttctcatggtggtgtttgatttccttccactcattctgatcattctttcttttctatggacctaagtaacaagagaaaagcatgggctggagaaagagggtcttaggcagtctcatcaccctcaccttgctactgtgggaggcccccatccatgacgagaagggaaatgggagtagaggtgtagggtctctccgtttccacagtgtgcgctcccaaccccctgcccacccgcacgccttcacccttgtatcttttgaatgtctcttaaccctgtttgacagatgacgacgttgaggaccagagagatgaaatgacttgttagtgattccacaacccttattggtggtatggttgggactagccatttaattttagcactcctttgactaagtgcctaccatctttgagagccctggtgttaagcaaacctggagacagaactcaggagtcctgtctgagctcctccagctctggcctcctctagccctctgctgtcactgattctctctgagctcagggttttggcctttcagaccctttggcactgttggacctgcccaattcagccctctgtgggggggtcatcttacagaggaacagagtggggtccttagccggtaggcaggaccaagattgggctgcagggagaaactcatatagatatgaaatttgggatggatttaggtctggggaggtagaggccttggagtcttgcagggatgtggaattatggcaagaagtgtggggaaagaggaagtcccaaatggagagctaggagtaggaaccctggttggttcactcacatccttcttgcctctcagtgcctggttctatgggtgctggctgtggctcccctttgtcataagtgaaggccctcccaaaggatctcagaaagcccccctggaaagttccacagctcaagtattattctagttcaagtttggggatttgcaactggggttgaagtaa

SEQ ID NO: 65773 - DNA, 1043 bp, Homo sapiens
tctcgatctcctgacctcgtgatccacccacctcatgatccgcccaccttggcctcccaaagtgctgggattacaggtgtgagccaccgcacctgacccatttttctttatgtataaaatggtgatacatggctgggcacttgaacccaggaggtggaggtcgcagtgagctgagatcgcgccactgcactccaacctggctgacacagcaagactctgtctcaaaaaaaaaaaaaaaaatggggatacacatgcttatctcataggtttgttgtaagaattaaattagcatctgctgtataaaattagtgatgagtaaatggtagttactcttacaagcaaagtgcaggggagagtttccaagttgaggggatcagtaataggtttatgaaaggcatgctgtttacaattggcctcgaacattgattaataaacttggttgggggaagtcgtttgaagcaaaggagctgatatgagcaaaggcatggacacagggaaatgtacatcatatctgtagagggcaccaaggggtatagggagaatagtagaacctaaagcaggagaagcaggttgaggccaggtcttgatgatctggcttaaattatttaactcacattgaatgctaactgggtacagtgtattggcaaatggagccacaaaagaattttggggagggaaatggataagatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtggggggagtggggagggatagcattaggagatatacctaatgtaagtgacgagttatttgggtgcagcacaccagcatggcacatgtatacatatgtaactaacctgcacattgtgcacatgtaccctaaaacttaaagtataattttatatatatattatatatattatatatatatac

SEQ ID NO: 65774 - DNA, 1049 bp, Homo sapiens
ttccatgtggattcatgtagaactacctcattcgttagaacagctgcagagtattccactgtgcggttagtccatcatttccctaaccatcctcctgctgatggacagttagactgttccagtttttcagtatgattctatgccaggctgccatgaacgtccttttactgatccactcaggccagtatttctgtaggagaaattcctagaagtgggataattggatcaaaagatatgcacattctaaattaggagagagactgccaaactgacctcagacaaggttgtaccagtttgcacccccatcagcagcgtacaagtgcctgcttcccaacttcctcgccaacagtggatgctataaaaagcttcacaattttgccagtctcattggcaaatggtatcttggttaaatttgcatttctttaatactaatgggggtagggtatcttttcatatgtttattggccatttatttcttctgtcaattgcctgttctgattccttgtccattattctactgggtttgttggtctttttctcattgatttttagaatctctgttaatggatattaaccctttgctgttgaatgtgtttgcaaatattttctccctgtctgtcatttatgttgtctttttccatataaaatttaaaaacttttgtgtgctcaatatgtcagtcttttcctttctggcttcttggatttgtgttctgtgtagaaaggccctcagcccctcaagattataaaattattatatcttttcttttttttttttttttctgagacagggtgtcttgccatgtcacccaggctggagtgcagtggcatgatcttggctcgctgcaacctccacctcccaggttcaagtgattctcgtgccttagcctcccgagtagctgggattataggtgcctgccactatgcctggctaattttttgtatttttagtagagacggggctttgccatgttggccaggctggtctcgaactcctgacctcgtgatccacccgccttggcctcccaaagtgctgggactacaggcgtaag

SEQ ID NO: 65775 - DNA, 1352 bp, Homo sapiens
ccccctgctgccaccccacagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtatgggggtcagggttcacgggcaaaagacacccaggtgtggctgctggagagtggtgctgggagcaagcggcacgtctggaaagactggtccaggcccagcaaggtcttggtcatggccagcaggattctgggaaactttagagggcgcttacagcaaataaggttaatgaaattggaaaagaaagaagtaatatagaactgaaggaaaaggaagagaatattatatcaaccctaagagataatattgtttgggaaatggaagtaaaaaaatccttgctctacgccgggtgcggtggctcacacctgtaatcccagcactttgggaggccaaggcgggcggatcacaaggtcaagagatccagaccatcctggctaacacggtgaaaccccatctctactaaaaatacaaaaaattagccgggcgtgttggcaggcgcctgtagtcccagctgatcgggaggctgaggcaggagaatggtgtgaatccaggaggcggagcttgcagtgagccgagatcgcgccactgcgctccagcctgggtaacagagtgagactctgcctcaaaaaaaaaaaaaaaaatccttgctccctgaaagccatgggcaaaagggaaatatgggcacagtagttacaaggggcctatggtcagaaacagttcttcagagaagacattatcctggcattacattaaaaaattttattttattttattttaatgtatttttttttttgagacggagtctcgctctgtcacccaggctggagtgcagtggcgcgatcttggctcactgcaagctccgcctcctgggttcacaccattctcctgcctctacctcccgagtagctgggactacaggcacctgctgccacgcctggctaattttttgcatttttagtagagacggggtttcaccatgttagccaggatggtctcgatctgctgacctcgtgatctgcctgcctcggcctcccaaagtgctgggattacaggcgtgagccactgcgcccggccttttgttttgttttgagatggagtcttgctctgtcacccaggccgcagtgcaatggcacgatcttggctcaccgcaacctccaccgcccgggtacaagcgattctcct

SEQ ID NO: 65776 - DNA, 1050 bp, Homo sapiens
ctatcgcaacaatgttgtcaacaccatgcgcctctggtctgccaaggctcccaatgacttcaacctcaaggactgtgagttcatccactggtagccagcaaccccagcttgcccgccggccacgcccagcgcaggccttaccctgtccccacttttgtccctcagtcaatgtcggtggctacatccaggctgtgttggaccgaaacctggcggagaacatctctcgtgtcctgtaccccaatgataatgtgcgtcaccccctgggctgggggctggaagcctgagtccttggcagcaggggtcagggagagctggggaaggacacttgctggtgccctagtcacacccagggcatattgctggccttgtgcatcctgtgcccccacctcaagtcttttgagtgcaaggacacctgagtcctgaggaaactgggttagcgaagggcactttggaggggctgttccctggcgacacccacaacacactcggttcttgtacccctcttcctgacactgtctctcgccactagttcttggtggaggaaaggcccctgggtcccagagagggggccggctcagggctcaggggtcccggtatgggtgggagtccctcctggccacacccaccgcagctttaggccatgcccccaccgccctgactcacgctgcctcatgctgtccccagttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtaccatgcgtgtggagggcgactctgtgaccggacagtgtgtgctaggcctctccctccagcctcggcctgcctgccccatgtaatagataagggagtggagactgggagtgtgggagggtcagttgttcaggattcacaatccacaggctcagaacctgggcttccctcctcctcccgccccactccccccattcctcccacccccatgagcaccggcct

SEQ ID NO: 65777 - DNA, 1901 bp, Homo sapiens
aaagctgtggggctatgcacacaaatggggtgaggtcctcgaggtacagattaggcacccattttataggccaggtcacagagctggtttacaaaatcctgctcagagtgtggccccaggtggcaggaagaagtgaaagaaggcctctaatcacttcctaagcagtggaatcacagggagaacttactgtcattaaaccagtatgatgatggagtggggaatgcctcagtttctcccaccgccgagggcctataggactacagttcccagggccccgtgctgcaggctagcggcctcccgccaatgctggccagtaacctgagcatccctctccaaaaggtcacttcagggctccttgagggacagcaacagggggagcctagagctgctcagcttcggtgggggtggagtgagggctgtggccctgcctcacacaacctccctcacaccacccctgcaatgcagggtcgtgggcccctttctcaaagacatccagtggcctctgctagttgcacctcttccgtcaggggacactgacttggctcctgcaccacagcctgcagggggtcctggttccttttgccacaacacatggcctcccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaaggtgctgctggggagcctggggtgggggtatgggctgaaggcgctgccagggagctggcgatcttgacttaagtggctgcccctcgtcactctaggttcttgggggtggagaatccaggggtgccaggcacaaggggtgctgggacaatctgagggagaaacctggggcaggagtgggggtcagggagctcagagcaggtgggctggctgcaaagggtcagtgcccactcggagaaggttggagtgggtgctggtgggcaggacggcgcctgtggcctggctgggcccaggtggaaggacacatcagttgctgcatgtatgcgcggtgtgcctgtgcagcaggcggggctggggcagctggggcggcagagatcaagtgtccggtggggtcactggtaaatgtcagcaacctgacacgcctcggtggggagtgggggaggggcgggcagacggcccaggaggggacccaggaaactgggagaccaggcactggcagcatcctagtttctggtgcctctgggtctccttgggattgaggcttgagggccaaggggaactggacagtgcaaggatgggaggtgacagtctctagcccagtctctagccactgtgtgaccttgagcaaatgacttttttctctgggggtgtgtgcagggggaag

SEQ ID NO: 65778 - DNA, 1048 bp, Homo sapiens
gcggcaaagtggcgctatgtgggttttagaaataaaatcaataaatgacttaaccacagcttagctatctcctccgcttctctcccccaggccagctccattcctgtgctccctccctttctgctccctgccgtcagcttttgttaaggttttggagaggaagtggctgactaaggcatcagtctccaaggtgctagaggccctgaaatggaagagacagcaggaaggcttggccctctgaaccgtggcaagcacttgcctctggcagaatcagagagagaaaggcctgcccacctgtcttaagacacctggggtgggaaagcaagccatttactccatcacattgtgacagggctgtgcttgccccaccccctctcctcacgttcatttctgctgctgtagcagcactgtccccgtccctcaaggcctggcaaggcctggcaagaggaatgccagtggggaaaggtcagcctcagggctctgttactgaggttcagccaagggctctggagaaacccaggattggtccaaggaaggaggccgggtttctagttagaaacttagacataaataacctcgagtgagttcaggttgtaaaagtgcttcagggttcattaaacctgcatacacaacaccaaggaggggcggaggaagcagggaaacagatgagatcgtgctgcccaggtgtgatcatgctgggctggggcatgcagtgtcaccccgggacaaagcctggaaacagtggggagtgatggcatgacaaagacggaaagaagccacagaaaaggtagttggagaaagttaaaaatttcccagtaaaaatgttcctgagagcaagcgccctgggtgcaagaggggagagtagctgggaaaggatggaatgaacttggccttccctgcctgtaagatgtggatggtctatggggatcgggtcctcagtggcaggaacataaagtcttgcaggaaataggggtcaatgcaaagaaggtgtgtgtggccaaagcaggctgccacgattgggctgtgaggtgacggcatggttaacaag

SEQ ID NO: 65779 - DNA, 2782 bp, Homo sapiens
accccctccgcccagcagcagtatggcttccagtacccccttgccatggcagcaaagtgagtagaatattttgggcttgtgggggtgggtgggatgggggtggggctgacaggaaccatagagcctcacacaagcaggcaggtgtcttgggatgagcccctgggctctgctggggttgtaaacagaaagggcctcctggtccagggggtggaggggcatcttgaagaggagagctgatgtttggtgtggttgtgtctggggagaggttcgtgggggcctggaggggagcctgctattgtaggtagggggccagaagtccagaccctcgcaggctgagtgagcggctggctggactgagcctggtgcatatgggtcgagtgggatggtgcatgcttgctctggcaagggctgcgattggggtgagagactgcagaggtgggactgggcagtggggagacagcagctgtggccttgaggttgaatgtgccgttcggtggtggcggcggctgggcggagggacatcagagctgttcttgtgtctggtaccttcccctcagcccttccaggggcattggtgacaaagggcttactctgttaagcccagagacctcgaggctgaccccagggtagtcctgcccacccctccactccccatcaccagccccgcccacccgccccccaccaccgtaccgcatgccaagcaaggagcaggcgcccctcgcccccatcccaaggcagcagccgcagacagccgcggtgtgcccccgcgcgtgtgaccttgggcttctttaccaccccagatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggtctgcttctttattttctttttaatgcctgccccgcccggtttttcttttcacataaacttcctctaccaccagcagcagcagcagcaccaaaggtgccttaactttcgttcagcaccaggtccgggggggtgagactgtgggtggttaattagggaagcccaccacctgcctcctgtgtgtggctttggtggtgggagctcagtgtgtgggtggctccacagtctcccctttggtgactagttaacatcgctgagaaccaattttgcccctccttgttcactgctcatttttctagtctctgtcctttgaaggctttttcctggggctcagacgtccacgtttgatgagctccagtggtgatttgtgcctggaagctgccacctaaggccctgggcctggggaggcatcaacactaaaggtcaagccaact

SEQ ID NO: 65780 - DNA, 2532 bp, Homo sapiens
ttctgtgagaaggtgtcttaacttccccactagtgcggagaagtcaaatcctcaggtttactgtggctgaccataatatagagttcatggagctcttggtgggaaaatccaattctctgcgcttgtggtttcccaccaatgccaaattggtccagcctctcttccctcttgagtgtgaatttgtcaggtataaacttagtcatttctgcctctctagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacaggtgagcggtgagcccagaaaggaagcctcctagcagaaacctaggtggaggccctaagcacttaactgtccattgcattttcactagataagaaacatcctgaagcagggtatcgagactccagaggaccagaatgatctacggaagatgcagcttcgggagttggctcgcttaaatgggacccttcgggaagacgataacaggtatgtgatcagtttaaaggagagtgtagagacctgaagaacctatggaagtagagattgttcccttgcattgacctctttttcctttaataggatcttaagaccctggcagagctcagagacccgcagcattaccaacaccacagtgtgtaccaagtgtggaggggctggccacattgcttcagactgtaaattccaaaggtgaggggctggctcttgcggtttcctggtagcctgcgatgtgcaggacaacttttctggcacattcattggttgctgttaatcttaccaagagaaacatcctttctgttagtgtggtctgtaatggtgtgatttaaagcccaggatgattagaaataggctgtacagatacccctgtttgtttgtcttgagcccaagaaaactggaagtttccattttgggtatgtttttactggggctcaataggaaattcactgcttttgctgttcagaattggttcaagaagactaagcaatctctacagatttctgaccagttgcaagtcagcactcgatatcaacactttctgactggctggcgaatatgtaaggttttgtttaggaagttcgttctggcagttgtgccagtcttgcatagattttcctttcctcaaactgggaatgaagtttgatgaaattgacttgagagaacctgtgcttcatcggtgctcagggtctcctgtgctcttcgcccaggggcccctctactctggtgatcccagatgcagaactgggcacgaaactgaagatctgatgagactgttgagagccatgcccagtaaggggttagaaagatgtgtgatgatctggtgattgaattcttcagaactttccatatgttggttcctcaggataaaagcttccttcttaacaagtttttcccctttctctgtttgtgtcccccaccccacttcaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccggtgagcctgggggctggctctcttggtctggcttccccattctctactgcagagactgggagctatggccacgtggtttgggtagagcagacaatggatgtggatggcaacattgttcttccgggatctcaggccagtttggggacttctcacttcgggaagaccttgttcttgtgttctggtcctgtgtcataacccgaagaacaatgttgccactaggaggcgcaggcagggacgttggcaggaaatgctctcacgtagtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaagtaagtgtcagaccagaaaccttgggggctttgggataagcaaggggttacgtcaggtcgctgttggctagaagcagctctcaagtggctgggcaatgtgctgggtctgcctggcttgccagggttgtggctctggaaggagcaagactccattctggttcagggagtgattctgtgttgggtaagcacagacctgccttttacaggcatggttttcagaactcgcgtaaggatagcaactgaggttatcacaggggtggcttccctggcca

SEQ ID NO: 65781 - DNA, 2055 bp, Homo sapiens
caggaagatgatgtaatggctttagaagtcactcactcatgcatctttcttccgccctttgccaggaaacattaacttccttgtttctccatattgactctttaatttgacttactacatttgctatattttacctatagatagattttggttgtagggttgtgttgtgtttcgtttctttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatctagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtgtaacgtggtgtgacatggttccctttaggctgaagacagtgggagcagccgagttcagtccttgctctccaactaggcaaggttctctcaactaaaccaagggtataggagtcttgattactttcagtatgtttttttaataacctgatccacatggtctcttcccttcttgcagctgctactaaattttcattcagaatatcaagctatggtcctttttgtaatcttaactcaaaattctaggagtgtaacctctcttttttattaccgcaaaatccagctgtggtaaactgaccattttatcattacatttttttacttgtagcaacagcattttactccttaaaaaaatgagagagagaaaatctgctttctggacttgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccagaaaacaggttgtctcctgggccttggacacagccagccaggccattgaaggaaaagcaaagacgaagcgaaccatctctctccattgtgggggccaagtagctgcagtagccttcagtcccagttgcattgggttaaagagctcatacatactatgtgttaggggtacagaagcttttcctcatagggcatgagctctccaagagttaaccttttgcctaaacttggggtttctgtggttcataaagttgggatatgtattttttttcaaatggaagaaaatccgtatttggcaagaagactccaggggatgatactgtccttgccacttacagtccaaagattttccccaaagaatagacattttttcctctcatcacttctagatgcaaaatcttttatttttttcctttctcacacacaccccagacccctaacgttaagccagcttccatctccccattccacacgatcttgagtagcacacgttatggtcggttcctccgaagagtgttgtattagggtctgagaggcagaggggctgggaaagacttgtta

SEQ ID NO: 65782 - DNA, 1714 bp, Homo sapiens
cccggccagtattttctttcgataataatgggttttcatttcttcagggttttagtgtgtgggtgtggtatagccctgtggatgtatttaaagttagaaggaatctttggttagacacgcattaatcctatcttggagccagctcagttttaacccaacctagtaacatttgcccttattggagatgcctgctgaaaattctcagatgctgcgaaggtaaggaacaggtggttattccgcatgttgaagaaagctgctctggctctgcagttcccattatcttggaaaatcagctgtgtaacatttccctggcgtcactggcaacttttgtgaaaccctcatctctctttttcatgcacagcctcattggtcaaggcccgagggccaagtacattgtccttgaacacacattccattcttctacacgcctgctccccatatgaacagtgagcctgaaaacaaattcttagcactttatggttactggtttattaagatatgtggtttgtcatttaatatttgaataaatatttcatataattgaataagagctgcaggtattgggagacccttactagtacaggtctggttgtacagaaagagtatgtacaaatttctataaggtgttgaattttgttattaaatgtcttatttaaggaattttaaatgtattaatgaaaatgatctttgctcaattggtatttttccttgtcccatgttaattgggtctcattttgggctatgtttaacatttaatgaagaaaaaactcaattcttgccctcaagtaatttgatgggagtcgggtattggtgacgtaacatggtttatggttctgggtaccaatggtaagcaagccttggtggggaggaagaggtgaaacacctcctaataattgcttggatgttagccttagtgaacagtctttattgctaacccctcttccaacaaactgtttgcttccttaagtgataaccattttgaagtgaaaaaaacctatagatgtaaaaggactcctgccgataggtggttgggggtttttgcttcaatgtgttcactgatcagtcgtccctttcaaagtctccgagttcttcatgcttgttgttgagatttgagatgtttattggtaacattgtcttttttccatccttttttttctttcctaacctggtttcttccagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgct

SEQ ID NO: 65783 - DNA, 2965 bp, Homo sapiens
cgcgcgcggcctggttctagggcctcgagtgcgcacgcgcgctgtggggggagggctgggcgggcgggaggcgctctgtgcgcagacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagaggttggcatgcttcagatgatggttgggtctgatctttcttggtctcttttggggagagaattttagtttgtttttttttttaaatctgttcagtatgtttagatctcagtctgatcggctgccctgtcgctttgttttaaaaagcttttccctctgatcctgtaccccttgggaaatagaaggactcttttgtggcaaatgtagggagtttctgcctatgtacggggaaaggagaacttggctgctattgtataggttgttgaatttttgatagatccttttaagagttcagaccctcagtgtccaactggccaggaaaactgaatgctgatcttggctaaacttatgaagacaaaggtgatcttgttgaagaattgggcttttcccacttggtagggtgtaactaggtttagttgtggtccggcctctcgtacaaaagtgactggtgaggggagtggaggtgggtggagcccccagtcccatcaggactgctttacaaatctatgattcttcagtgtatttttgtctcccctggggatttcagagcactcatggttgatgtagtatctatctaacactctctgcagccatatgcattaagattaccacgtttatatatctgacagtttttctagacaaaagaaggtgaaatgttaacttgcctgaccaaggaccacatacccttgtagtggccataagctttaaatctctgatctctgaggtttgttttctgtttttttaatgtttaagttttaggttaagctctcagcttcacagtctgctgagtttctgtgtagtaccttaaatacccttagctgtctgttgataactacttgtatttacatcggatggattttgtctctgccttttagacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaaaaaaaaaaatgacaaaaagtggttctgaaagtgtgtttacaatttacccctttttattttcttgaatttaagagtttaaccttcccttcaacatcttttctggtttggtctatggagagctgtcttaaaatgaaggctcttgtatttacttttaaagaactctgctgggaaagggatattgcatggatatggaatgaagtgctaggataaaaaggttttatttgctgggaggttttgagaattaatgactatccacagtggaattgaaattaacctcaaaattgcttttttggaaaaaaaagtttttaatgcaagttttatctttatatacctgtgcagctgtctcaaaaaagttcactttataaacatttcctactaaccaaataaacatcccctttggaggaaattcgggcaaagacctcctaaacctacgaggctgtggccttcacaaccaaaaagcttcaaggccagcatgttactacttttgagggtcttaatttcctgttttttagactgctgagaattttgaggcgttggaattgtctgtctcctttcacagtactactaatacttgttctttcccctactgttcctgtctactcccacccattccattgtgtctcatattagactagtctgggtctttacatccttgtgaaatgcccctagtggagtgatatcccaagaacacaagcatacttagaagatgggaagagcacaaattctttatatctccatttctgtttttgtggagggctagttagttcactgggccctaaggactatttatagctataatcaaaatagaatcaaaggagaggtgtagttctccacagaagagaatgaccctttttatttagatcaggccccacatctccatagtcagctaggaagactcaccttctcccctcagtgaaggtgactttcacctcgagttgttgagcttaatactcaactgcaaagtcagaactttttaggcataaaggagcttggggaaccatgtgtcttactacttttctgtctcccacggtacatactgctttgtccaggatgccctcaatatctttttttttttttttttgagagactgagtcttgctgtgtcgccaggctggagtgtagtggtgcgatctcggctcactgcaacctgcgtctcccgggttc

SEQ ID NO: 65784 - DNA, 1034 bp, Homo sapiens
gaaaaaggctggaaccagcgacagccaatcccgcgacactacaacgcaggcgagattgattgagtccaccaccgcagccaatgagagagctcgccgtcgctccgtcatagagttcgccccaccccatcccctcctttctggactcggagctcagttcacgcagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttgggtaagctgggcccccccgggctgcccccgctccccgggcccaaaggaggcttcgagccgggccctccgcctgcacccgggcctggggcggggctgctggctcccgggccgccgccgcccccgcccgtgggctcgatgggggccctgaccgcggccttccccttcgcggcgctgcctccgccgcctccgccgccgccccctccgcctccccagcagccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggaggtgagtcgggccgagagagcgcgagaggcgtcgcgcggacgggcccggccgcctgaggggcgcgcggcggcggcgacggcggctgcacgc

SEQ ID NO: 65785 - DNA, 1013 bp, Homo sapiens
agagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaacccacctcatctcccgcctccttccctccaacacacgtttctgtgggcaccacagaagggcagggcccccagggttttggagaagccaggtagaggtgacaggaggccatggcccccagcagccttctaggggcactgtgccttcccctgcatccttgctcagaactgaccctcagctttgcagtttgagggctctgctgtagtttagcaccccaaggactcatgcagatggggggacctcaacaaagggactctcatccagggcacccttgccccacgtaggatctcactgggtgacccctggaagggcccaggaggagcccccagagggctgttccctccattcccatggaggctgctgcccatggaggtagcctgtgtgacctgtatcccctgcctccacctactgcctaggtgttagaccaggaacatcagatgacagcacgatcatcagattggatgggaaggctagcctgtgtccgtctaccagactcccaagggctgcctcagtgccaggccctggggtcactaccagaaacagaccagcccccagggagggcgtcctcc

SEQ ID NO: 65786 - DNA, 1025 bp, Homo sapiens
ttccagccgcccaaactgagagataagactcgctggtaagggccacaccctgctgccgggacccccttttctgtcagccccatagtggacaaacagcctctgccaactcccggggggcaaccccaagagccctgtcctttctgggctactacagaccatctgagtcaggggcctggtccttctgtgggttgaagacccagcgtggtcaggaaagaagggcagagggttggtggaggagccgctgtgtcgcaaggcagcgttgctcggccagtggcccttggcctcggctggctccttcctgggtgggcccagcagacgcctctggaggggtggtagggcagctggcaggacaccctgcacgagggctaacctggatctggcgctggggggctcttgtgccttctaggacccagaatttccaccactttctcaaactggccctgaccaagaatcctaagaagaggccgacagcagagaagctcctgcaggtgggaggcagggggccgggagagaggcccagtactcaaaagcagggccctggatcaggggccaacctgatcacccccctcccccactttccagcacccgttcacgactcagcagctccctcgggccctcctcacacagctgctggacaaagccagtgaccctcatctggggaccccctcccctgaggactgtgagctggaggtaggtgaggggggctggaaagtgagtcttgggctggtctgcttagaaagagcccgagggtgatgttggtggaggtcctttaactggcaccattccagctcagggagctggcctcagctgagccctcccattaggagtctctgtcatgctgacttttgtttcctgtaccacccccttgataggtccctgcccttgagtccaagctgaccatgaccacgactgtgccattttcttgctttctgtgtgatctttggcactgctctgtgtgggttctctcatctgtgaagtggggttccattttattttacagtagtcccagagggctgtcatgaaag

SEQ ID NO: 65787 - DNA, 1002 bp, Homo sapiens
gccccgaagcctccccctatcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtccaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatgtccccgtctctgcttagcgtctgggtgagaaaaacaggctgtgatccagaagaagggaagatagagaaggagggaaaggatgtaggcgaaggaggtgagagacaggataggaggaaggaagtggaggaggaggtgataggaattggaaggaggtagaagccgtgcagaggaagaggggagagggacgaaggaggagcgatgaagaagaggagggagacaaaaagagggatggaggagagagggagtctggagaacaaagggtcctttctctggggaggggtgcagtgggcggggctgacactgtcagccaatcctcccatcggggaagagaatcctggacagggacaggatggggagggtatttataagggctttttggtgggagatgggtacccagtgggggccactggagggtctccgggcacactctggcccttcccagaaagggggtcgtttttctcgaatcttcaaccagttgtgtattggaaactagggcgcattttactattgatcacagtcattatattgttatt

SEQ ID NO: 65788 - DNA, 1037 bp, Homo sapiens
gcacgtgtggctgtgtggccctgaatgccagctgactgggccccgggaatgtgtgagcacagcccagctctccacttctcccacagagaaggacgagttcgacatcccggacctcaccgacaacagccggcgccagctgttccgcaccaagagcaagcgccgcttctttttccgcgtgtcggaggagcagcagaagcagcagcgcaggtgcgcgtgcacgacgcgggggctgaggctgggtggggccgcctccgcttgtggacgggtcgaagggagggtggagcttcgccacccactacttacacctccgcccacagggagatgctgaaggacccttttgtgcgctccaagctcatctcgccgcctaccaacttcaaccacctagtacacgtgggccctgccaacgggcggcccggcgccagggacaagtccccggttagtcctctggagccaatcacaagccactttggtgaggctgagccaataaccggcctctgtggtgagctctagccaatcacgggccgctgtaattactcctaaggcctgggactcacacttctgctacctgggacttaagtaaaaccaggctgggggcccagtggcgttcatttgtcctggtctgttgtgccttgggcctcttgtcctccttgtgcctgctagtcccagcccctccgcactgtcacccaacaggctcccgaagagaagggccgagttgcccgcggctccggcccacagcggccccacagcttctccgaggcgttgcggcgcccagcctccatgggcagcgaaggcctcggtggagacgcagaccccagtaagggcagcccctcagcctccagtgtgccaccccccaccccaagtttctaccccctttggatccctgaaatctgatcttggtatttttgtctcctcgtctgctgctggagcagtgaagaggaaaccctggacatccctgtccagcgagtctgtgtcctgcccccagggatcgctgagccctgcaacctccctaatgcaggtgagcgggtccgggaggcttg

SEQ ID NO: 65789 - DNA, 1246 bp, Homo sapiens
aggtcaaacgcctcactctccctgcctgccatcccccagggatgtcaagccagacaacgtcctgctggatgtgaacgggcacattcgcctggctgacttcggctcctgcctgcgtctcaacaccaacggcatggtaaggaccccgccccagagtgggagcaggggatacaaggcgggccaagctctcaggaaaatgggaggccccaggcctagtgcagaggcatcaggccccccggggaaggtgggtgagacccaggccccaggtgggcagcagcaggccagcctggcagagtaggggtgacagggccatcgcgaggagccagcagtcccagccaagcccaaagctgtcctcatggcttcaccaccaccacccacaggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggtctggacaccaggctctgggcttccagagggggcagtgggacccctgagtctgtgtggttggaagtaccggcaggtgaggctgggttcctggacacttgacccagcctgccccctcccccgacccacaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagtgagtggcaaaggccactgcaggaggggagctgccctacccccttgttggctgggggaaccctccctctgaagtcccctggggtgggctgggggtgaggccttcagacaccggggcttatgatttatggactcccagactgacccgttccagccaccatccgctggcccagcctcttccagccaaactggggtgggggagcatctcccacaggctccccatgcttgcctgcactgaggtgggctgtgtcaagggaagggcctctgaccacaggtatcattctattaac

SEQ ID NO: 65790 - DNA, 1010 bp, Homo sapiens
gggtgcaagggattctcatgcctcagcctcccaagtagctgggattacaggcgtgtgccacgacacccagctaagtttcttgtatttttagtagagatggagtttcaccacattggccaggctggtctccaactcttgatctcaagtgatctgcctgccttggcctcccaaagtgctgggattacaggcctaataaacccttttgaaagcaagcagagtcgttcccattttccatatggtcacactgaggcccagagctgtagagcgtgggcttgggctcagtcgcagccagacaggggacagtagagctatgacctccatctgagctcccagactcacagaatctttctccatcccctgagctggcaaggggggcatcctgggctctgatcccaccccaccccttacttccccaaacctgctgcagacagcctgtttccgggaggagcgggatgtgctcgtgaaaggggacagccgttgggtgaccactctgcactatgccttccaagacgaggagtacctggtgaggatacgtggcggggctggaggggaacatcctagggacacaggagagggcccttggggccaggggcactgggcccaaagagagacccctcttgggaccaagagactcccacttcccaccagttcctgggcttggcgcctcctgcctgagccctggctgggaactggccagcccagagctgctgggagatgcaggcctgccttcccagagccctgcgggaccgcggtgaagtggccaggtgcacccttcccccgggtctgattcttgtccgccacctccagtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacaggtggggccccaaccccgctgccctgcccaaccccgctgccctgcccaacccctg

SEQ ID NO: 65791 - DNA, 1572 bp, Homo sapiens
agatgtgccagggagttgtcccctagccccaacccttccatccagggcgaggcagtcagaggcccctgcctctgtgcctgtctccctggtatgcctccgtgctatgcctgtctgcctgtgttgttgtcaccccccccatgacacccacacacgtgtgtgtgtttgcacacacatgtgtgctcctccctgactgcctccagcacctctgcctgggaccccggcatgggggccctctgttgacaatctcccaaggtaactcaaagggctgtgactcattcctctcctgcttgtctctacttgtccctgctcctgcccggagcccccatgccctgtgggaggccagaggattaggcagcctgtccaggggcctggatcctcctgcctgtgggcctgggcttcggccctcttctggcgggtgggtccctatggtgctggcttcaactcccacggggaggcccggggctgctcctccccagctccacacacagacctgggaaagagacaatgaatttctgtaatgaggtttccaccccgcccccgctgcgggcttctgcctgataaacctgtggaacagctctctgtcccacccacagacccgcccagctggcagggagtttacctcctggcagggggaaactgaggcagggcgccagaccacagctgccccccatcctgactgatcactcctgcctccctaagacccaattccttcccaaaacctggggctaatccaggcctggaaagtgcctgggagtggctggagttgcccttcctggaggtatctgggatgtgaggaaagaggacgttcttgaccagacaaaagcttcgtccagacagggaggcagggctgggagtgagagagccggtcaggcctggaggcatcctgagcactcacgccttcaggggctagtgctagcaccagggaaaggcatctttgtcctgtttgtgagtctcagcaccttggcagactggcatccatgcctccagcctgaggggccccacgtgggaagcatagagcctgtcctccctgccctaggggctgcaggcctcacccccaaccaggcacctctatgcctacagggtcccgggacccaggcccacagctcctgaatgggagagaagcctctctggggataaggaatgtcacccgtccagtttcctaagacaggccctggcctgaacctgtgagggggccaagaactgtgaggtgggggtaggaatggtgtccccatggtccccagggtgacctggccaagcagagtcaggccgcagactgggcaggactacaagtcccatcagcccctgggatggaggctgcctagagtctggggccaggggtccagggaggtccagggaccaggcggtcagctgagcccggcctctgaccttccgcacttcctgatcatggccaaaggagcaccagttcctgccacaaccccttggcccgaggctgtccctggggaggtcatccctgcctgggctcacaggagcggcagctcctggcttgcccaaggtgagagggggaatggagccctccctccctgcactctgagtcccgccctgtgtcccctc

SEQ ID NO: 65792 - DNA, 1927 bp, Homo sapiens
aaagagctggaggtgcctcctgtgtacaggttagagagccaagggccagatggttttgccgagtcgcccctgctagtgtgggggagcagcactttatgcttgtgaagccctgactggaaccacttggcctggagtctgggaggggcctcccttcccagcccttgtccttcctcccccgcccacaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtgg

SEQ ID NO: 65793 - DNA, 1209 bp, Homo sapiens
aagcagtcaggatgcagccaggctctgtcagggacccctgaggactgcctcagggacgagaagggggccgggttggggtctcttgggctgcctttgcctgtgtgctaatctgagtgactttaaagataccgttctcctgtgtcagcagagaaaggtggcctctgggggctgcgttcattcttgagtgctgcctgtgtgactgataagggcattccaaagggcagctgggtccggcaggggtggtgcccttggctccaggggctgccgaccagttgcgtggtcccggcagtgcctcatgccgagtcatcccccggcggggcctctgtgggcagcccggccagttcgttcgttccccaccatggtcactaggcaactgtgaactaagcgggagtttttgtgtctcaatctccccatgaaagctgtatcagcatcagcagggtagtgtttctacttgcagtagcagatcagagacctggccagctttgtgtctgactttctgctggccactgccacatcagtgagttccattgagttatcacagcagctgcatctaggaggaagctcctgcctttcagaggaggaagcagaggcttaggaaagttaagtaattggcctaagatgacaggcaggccagcaagtgtcggcgctaggatttgaacccaggtaggggctgtgctcctactgcggcggagctgagaagggtgccttggcatgaaggctgtgggcgaaggagtgccgggagcttgggtcagacagacctttgcccctgttgggtcattactgtggacacacagtaatgtgtgtccctcctgagacacacagaggccaccctctgtttctctcccacccaaggttagactccagtcctgaaatggacctgaggtctggggctttgaacagcagtgctggtattgtgttccctgttcccagccataaatgatcccttggggtctccagggagcctggtggcctgggctctcgtttgccctctggtggtctgcaggctccctctaagcctgggagctgtcctgatccttagtggttggatggggcctccctgcccacactcccacctgtgtgtcctgagccctccggcccagaggcaggcctgcgccgtgggccgcccccacttcctgccgacacctcctgagatggagatgccgctgccagcagcacccccaggctgaggtttcaccagggtgctccgaa

SEQ ID NO: 65794 - DNA, 1112 bp, Homo sapiens
aagcccagctcctcactcccacacctcaggagtcaaacatcgtgcccaaggccaccctcctgtcccctctgctgggcgaacacctccctcctccatccccccaaattaaagtctctttgtaggtcacttggggtggtacatggtggtcccccagcccgcctgtctgccgacactcagtctccctccccgtcctgtggcccagctgccacattcctctcacctgcagcttctttactgtgcccttaagtacagaacatggtgacgctccatctgcaaggagactggagaccagaaccctcccctgaggcccacgtctgcccaggcaccatgcttgctcctagaggtacatgttggggtgtccccgagggcaggaatatagtgggaccctctcagaggtggggtcaggcctccgtctcctgctcacccaacctggtcccctgccccttggctccatgtcctgtcccagaaacacctctcttgccctttggtcatcattaagcagaatttcaggatgtctgcaagatcccccacccctggtgtacatatccagtgtaatgctgggaatgcggatctggtgacttactccatgacatgcggtgttagatggtgcagtccactgtacaaagggagataatcccagtgggccccccagctcactgagccctctgaaagcagagctggctggacagtggcttacacctgtgatcccagcactttaggagactgagggggtgggtcacttgagcccaggagttcaagactagcctgggtaacatggcaaaatcccatctctacccaaaatacaaaatattagctgggtgtggtggcatgcacctgtagtcccggctactcaggaggctgaggtgggaggatcacctgagccagggaggttgaggctgcttcgagccatgattgtgctactgcactccagcctgggggacaccatgtggaaaggaatgtgggtgacctctaggagctgagaggggccccagcagaccaccagcaaggaaacggggacctcagtcctatggatgcaaggaaccggattctgccaacaagaatgagcttggagacagattccttcccctgcctcccggtgatagggcagcctg

SEQ ID NO: 65795 - DNA, 1247 bp, Homo sapiens
acaagtagggtggaccctttgtctctggctttctctgcccaccaaggtgtgtgtggagtcgggggcacagctctgagccgacctgggcattggggaagaaataggaaaaggcagcagtgatgacccccctaattccccatccccctccaggtatctatgaagatggagggaagccacctgtcccttgcctgcgtgtctccaaagccctggaccccaagagcactgggcgcaagtacttcctgccccagtaagtaggggctctggactgggcccaggagaggagggttctgctgggggtggcagggggccagtttggaactgggtgccgggggccctgcaggccagtaacaggcctgtgccccggcagggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggaggtgagacttggccccacctcttcccaggaccccctcccgcccaccgcccgggttcctgccgtaggagccacctgtgtggctgtgggccagggcagcacgaccacctggggtgggcatgagctgacccaacaccagtgaggatttcggctcttccattctttccagccagtcagagagtctttctgaaacggcactggtgagggcaggcccctggggagcatgggtcctcgattggaaagatcaggtcctgccccacctgacccgtggatcagcactgtacacttagaaaggcagttaagggccaggctctgccacttggtgactgtgtcatcaccctggggagttatctgaccttgaagagttacctatagatgagtttcttcccctggaaaatgggcaccatgacctgtctttctctctttttttttcttttttttttgagatagagttttgctgtgtcgccgaggctggagtgcagtggcatgatctcggctcaccgcaacctccgcctcccaggctcaagcgattctcctgcctcagcctcctgagtagccgggattacaggcgcgtgccaccacgcccggctaatttttatatttttagtagagacggggtttcatcatgttggccagactggcctctaactcctgacctcaaatgatcacccacctcagcctcccaaagtgctgggattataggcatgagccaccgcacctggcc

SEQ ID NO: 65796 - DNA, 1022 bp, Homo sapiens
accatctgtgacttggttccctggggaccaaacaaggtgggagctggtgatagagtggacagagcctaggtttttcagtcattgatcttagtcaagcacttgaactctctgagactcagcttcctcttccataggaagagaagggtgagatcagcctttgccaggctgtatatctgggttcatgtttattgagagcttattgtgtgtgggtgctaggctgggtgctttatcacatcctgtccttccagcaccctgaggagggttcagttgagcctgggcagaaggcctggtctactggaggcaccagtgtcacccctgcctgaccaagccttctgccagagccacatggtggggcagacctggcctcccaacccccagcctggtggcaaactattgctccacctggggtacccggaatctgttgggagcccctgctgaagcctctgtcccctcaggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggtataagcccgaggccagggcctgaggagagaccatcagagccccctaagtgcaccttctgacgcctgtcctcttccccgcaggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggaggtgagggcagaggcagaatgtgtacgaggcggggtctggaggtttgggtggctgtggggccaggcctgaccctgtgtgcctcccgggtcccatcccag

SEQ ID NO: 65797 - DNA, 1050 bp, Homo sapiens
ctgggcctcatgcatgaccacaagcctgcagctggcccaggagtgtctgcgggatgggctaccggagccctctgagccaccacagcccctggaggggctggagatgtttgcccagaccattgagactggtgagcaggcccctcctggccgccctgtctcctgcccttcagtggcacacagaacaggggctccagacaacggcacggccaccctggtgcccagatgggaaattctgcctcccctttgctgctctacctgacctgagacccctccccaactcctcagtgcttcggaggatcaaagtgaccttcctggacactgtcgtgagggtggagcactctccgggtgatggggaacgtggtgtggccgtcgaggtccgtgtgcagaggtaagggcaggccgatctggggtggactggtgtgaagatggggagtgggggctgctggatggtccccacccgcagcctaggttcctgggaagaggcagggtggatctggatgggcctcggtggtggtagggttggggaggtgggctgcatcgtgagcccggactggtgtccagaggccaggtgatacaggcccagagtggccgaggccccaagaaccaagttagatgctgagggtctgaggagcaagggctggcctgagcctccgggctggacatggtggttcaggacggcctaggtgtgatggggcagctctgcaggctaggctccctgaccccgtgcccctagagcagagcactgtgtggagagaggggctccaggcctggggtggccagggcacgggctgaccctacactctccagactggagtactgtgatgaggcagtgcgggacccaagccaggcgccgccggtggacgtgcatcagccgcctgccttcctgcacaagctgctgcagctggcaggggtccgcctgcactacgaggagctcccggcacaggtgagcgggctctgattcccacagcccctgtctcctctcccttgagcccattgagcccctcccatcctttctgaccatctctgactccattttctcaacctttccct

SEQ ID NO: 65798 - DNA, 1044 bp, Homo sapiens
tgagtgattttgggcagatagtcaaccccttctatgcctcccatcctttagggggtaagaaaaagaaatgagaaagtacatgaggagtacttgaagctctggagaacaaagacactttatacaaccaagataattactattaaaggaacattttcctcgctctctaccctttgtatcttcctattcttagtttgacacatcatctccctcaagaacagtacccacagcttcttactcaacataattaccttttcaacctgattctggctttagaaaaaactctagtaaaaggaacatgtttattgattttgactcaaggcctaaagacattcaccatcatggaccctgttcccaggaagatgatttctcctaaattaaggtgatcacagtgactctcagtgtaagtcacttgagctggaaaaattgaatttgctcctatggtccattgcttaatatgttctgccccctttgcagggagttagggtgtaggatcacagtcactgtgcatgtgcgtgtctgaacacattgggagcctgtgtggcgaaagcttagaagaatataacacgtacctctgtttcataagaagtgtttagggacaatgggaaggaagagaaaacccccttgcctttgttacttcaggtcccagatctagagatccagactttggaaggataaaaaatgggagggagcagatgaatggcccagaaatgaaacagagtaactgcacgtcgcattttgttgttgttgttgttttgctatatctgttcgaactgcacttgtaaacagatctggtcctgaacatacggaggacagtcttgcatcaggttttcagagtattatgttctgatggaggtcccagatgataccttcagtctgaattccagctataatgttttctctctcttatgactttttcttgagaagacatctctcaagattttgggagatcacaaaaaggctacagtgtcttgtgaggagacttttccctggttcagcggtaggctgtacctctgtcccagggcctttgccctcctgttcctcctc

SEQ ID NO: 65799 - DNA, 1049 bp, Homo sapiens
actttccgctctgtcagaggatgatgccgagggcccagatgagcaggatttggactgtgttgctgggaacgggggcctacactggccccaggatgagttcgtccgtacctgggggccctgggttctgactctcaggtcagacgcagccaagatgcaactcaggaacttcaaggtttccgctccggccaagagccccagtccggcaggggaaagggtgggggagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgctgtatcctaccggacgccggaaccgcgagggtggcggggtccagccgggcaggcggtgccgggcgccccctgtcgggagcggaacgcggcggccggcgcgtcccaactgcccctggcgtcaccacgcgggccccatcaatcgccccgtcgggccgggaggagccgcaccccaggactggggcaggggccagctccgagggccgcagaagcggtcctgcaggcgcagcggcggggctaggcggcccgagtgtcaggggtggtgggtcccggagataactcggacgccaccacccggcggcctggcccaagcgtggggccgctgccctcccggctctgatctcctcccccgggcccgagggttccaggccccggccccgccctcgagctccgaatcccgggggcgtgcggggtggcgggtggcgcgtgtgggctccgcggatcctttcgagcgtggatccaacagtccgtctctttggtgttacgcggcccgtggttgtccctgcgg

SEQ ID NO: 65800 - DNA, 1139 bp, Homo sapiens
ctatgtgatatcagcaggttaacctctctgagcttcagtttccttttctgtgggaattctagaagccacctcacagacatggccaagattcagtggagataatgcccacattttgcagctcactggaggtacaccttctcccacttcccatcccaagcctgtcacctctgggctttgttcccccagagcaagacttcagccaggatctaccccacctaccacacagcctttgacacctttgactatgtggacaagtttttggacccgggtgaggagggagacaaggggcatcctgagaccaggacaggagaggctgaagactgagccctggccttgtcaccttgccgcaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctgggtatgcacagccctgaccctgaggtatggggagccctgcacccccatgactgagccactgcttgttcctcacagggcctctggtgactgcagtggagaagtttgaggcagaagctgcagccttgggccaacgcatatcaacactgcagaagggcagccctgagtgagcaagggcagcgggcaggggctgggagggcagcacccagggcaggataccaggctggtagctgggctgctggctccagggtgactggcagttcctgcctccccaccagccccctgcaggtccggatgctcaatgaccagttgatgctcttggaacggacctttctgaaccctagagccttcccagaggaacgctactacaggtgagtctgtcccagagtcctgggaggtgcctccaggtggggccggacaatggctccccacctgagacgaggtggtcagcttctctgccctttagagtgcaacccagcccctgaagaagatgggaatgtaaggctcagggaggggaggaaagttgcttgagggtccctctgggagctaggactggaacccacatttcctcccccgaccgccactgctgtaagagctccctggccttcagagacaagtg

SEQ ID NO: 65801 - DNA, 1026 bp, Homo sapiens
tggacatcggtgaggtcctgcccagtcttgggaatgcccgggggtggggagctgctgggcccagccatgatactgccacccctccaacagtgggccccactgggggcatcatccactcctgccaccggactgaggagaacgtgaccggggagcaaggggggccagatgtggtacaaccctatgctgcctatgctccttctggaaccccacaggtgggcccagaaccccccctactgctctggcccagctcccttggttccacccagggttctccccaccctgacccagggaacgtgcctcaactggggcacagcgcgccctccggaatttactcaccgggacactccatcgctgctcctttcctccatcagtcattcaacaaacactagtggctctgctcaaggccaggtctgttacagggcacccagacatggaggaaatgaggggtgactgttcttggggagcttacaagctctgggtgaggtgggggaacagaatctaaattctccctcctgccatgcaaacttccaccccccttccccacccacacttcgctgggcccagctctaaggatcaccccctcttgggactagggcctcctcgtctatgccaaccggggcgcggaagaagactttaaggagctacagactcagggcatcaaacttgaaggcaccattgccctgactcgatatgggggtgtagggcgtggggccaaggtgagtggcagtcccccagtgcaggaggcctcggtgaggaaggggctgggcagtggactggaggaagtgaggggaaggggaaggagaagaggcagtgttgagtggggaaccaagccccagggtggggcaggaaaggcaaggtgttttcgggttgtcccaccaatgggctgtgtggcctcggatgcctccctgaccctctctgagctgtaggaaataaaggggttgagtacaattttcaggtttggtattccagaagtctaagtcctcctgtgaaatagttttgaatattcaacttaagtccctcctgttg

SEQ ID NO: 65802 - DNA, 1190 bp, Homo sapiens
ctgttgaggagcaagaacccaagggccctcaggcttccgaggagcggaacttggaggtgatgggaaaccccagggcctcctaaggcagtgggcaggggaggcaggagagctggagaaattcttcctgtatctgaatggaggcctgaacccccgtcgtcacacccagcttccagctgtcagggcgtccaggcccagctcctgggttcagggctgaggaatgggtgcaggggagttcagcgctggagggcctcctggacaggtcccattcatacctcctaccaggctttccctacagggtgggggatacagacgatggggcccctgaaagacagggagatggcaaggatggggggtgtgggaggacccaggctcttgggtgagcagccgtgaccctctccagtcaccttggcgctttctctgcaaagccaccttcctcagaacaactggaacccaccgtcacgttcctgtttacactcctgaacacctctgagcccactgagccaaaagaccctgaatcgtaaggctgcatgagagagagagagagagagagagtgcccatgcaggcacatgcaggcacgcacaaaactgggggaggtggatggtgtttctccccaccccacacccagaaacattcaaacctgggctaggactcagtcctggcccgtgcagagaggaggcccagagaggcctgctgaagccggggcctttggctgggcacccccacaccacccacccacttccctcatcccctagaccctctggcctgaccttcactacccacttgctccagggactcggagatccaggagtaccagttcttagatcaggaggactggggcccccagcggacctcaaaggagatcaggcagttgcagaatgactgcatgaggtgatctgggcgggcagatgggagcgggtagggtgacagggcttcccccgaccaaggccaggcctggctttcaggtcagggcccacgtggctggtgaacgggcattcaggaacccccacctttaattgtccaagaacttgaggagcgttcagtctgggggaggggcttgttctctggatgtcgggctctggagctggggtccacacaatcccatggccgctcgcccctctcaggtaatgctggggtcagagccccatctgtcagcaaaggtcctgaggtgggggcagggcatgacggaggc

SEQ ID NO: 65803 - DNA, 1645 bp, Homo sapiens
ggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttggtgagtgagaggcaggggtttttctctgccgtgtgctctgggagacgtgcagggctggggctctggctcttttgggggataggcagcacctgcagggtgtgggtgagatgctccagccaccatgttcccttctcactcacctgctcctcatttctcttccctcagaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagac

SEQ ID NO: 65804 - DNA, 1025 bp, Homo sapiens
gcggcgctggaggagctcgagacggagcctaagttatgtctgggaggcgaacgcggtccggaggagccgctcagcgctccggtgagcggagggcgcgcgggagacgtgaggtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccagggccaagggccccatctcctactaagcctctgcggaggtcccagcggaaatcaggctctgaactcccgagcatcctccctgaaatctggccgaaggtgagccccagatttctcacttcctccccttgtggcccctcacctaatgttgagctcacgttcatccctcttctccagacacccagtgcggctgcagtcagaaagcccatcgtcttaaagaggatcgtggcccatgctgtagaggtaaaggctaaggagagtgttgtgggtggttaggcgggcaaaactggggaccagctatgtgatcaattggtattgtcccccgcaggtcccagctgtccaatcacctcgcaggagccctagggtgagttcactttcatctacttaattaagtagaatctgggtcactctagagctggacagcacacattggctcctcacatctgcccagggagctgttttgcagtactgcaaaaacagtttgcctgtgggcacctgcatgcattgccagtcttgattactccctgaagacttaatacacttaactttttatgccttgtgtatttctaccattttcctggaacttcctttaaaagctgagctatgtcttaactccacgtactgcctttctaatccattatgccttcagctttcatgtatgggtgttctgagataagtcatgtgtatgacatttttacagttttagcagaagttattatcaaaggatgtttcattaata

SEQ ID NO: 65805 - DNA, 1417 bp, Homo sapiens
gttagcaaacctgtgagtgtatagatgtgtatgtgtgagggctcctgtacccatagtgtagatatagggaatgccacttgtgtttgattatgtgcttataaggacatgtacatttgtgcccagggatgtgtacatgtatatgtgtgcctgtgtgtgtatcgaggaaccttttctgaaactgttcattattagccattagcccaaagaatatgatgagtgcaggcccagagaggactcattgaaaggactgaaaggggaggtggcgttttcttcctacccaaacttacccctgtgagctggacagcttggtagcacctgcctggacttagatggtggtagccaagaagactgacattttagggaacaggacggggaggagaaggctctggcacacacacatgtgtccatatgtcctgcaatggtctggggactattgctaggctaggagccctaagtgtcttcttcctcatgtctcttctcccctgtctcatgggccctaagatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctggtgagagtccctcgtctgtctgaccatctatctgccctgggccccacctgagtcagatgggtgggtggggacaatactaggcagcctggtgacccagattccttcctccagatcgatgaggtggtgagcccagagcccgagcccctcaacacgtctgacttctctgactggtctagttttaatggtaagtggtggcttccaccgactgtttgggctttagcctccctgctctgctgacagctcccttggtctgcagtcacatgctctacccctgagctctatgcactgcttctgctgacggctctctttccacccacagccagcagtacccctggaccagaggaggtagacagcgcctctgctgccccagccttctacagccaggccccccggcccccagcttccccaggccggcccgagcagcacacagtgatccacatgggcaatcctgagcccttgactcacggtgagcctgggagttatccaggccgcagaaggataggaagagggtggaatggtttgtatagggggagcttgaggatccagagacccacccggaggaacctttccttaatccaggcacagccattacctcctcacaattctgagatgttctgtcagactgaggagagcaggtgatccccctagccctccccaaagcggccagttttcctgagtctattgatgctagtggctccaccctgtagcccctaggaaggtgt

SEQ ID NO: 65806 - DNA, 2518 bp, Homo sapiens
ctgcccaaggagccccaggactctgtgaccaactgggggtgaccctgaccctccagtctctgtctctagggctgtttttaggtagtacagagtgccctgcctccaaatcccacagcccttgtcccagtcttggtgtatgcccagcctgagtctgggtgctgacctgggattactgtttgcccttgtccttatccccacagtagtcttgggtcctccccagggttttctgttcacccatggtccctgccccgcctcactccaagctcagggatgcctctgattgctgggccctacctgtcccctgccctccagatgacggcgctaatattgtatccctcccttcttatctggccccggagactttctgcctcatcccagctacttccatcgtatgtctcccgggcccctgcttggaacttgggtgtcccccacacacacctgcagtccccaagctgcatccctgtgtccctgcctgcaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgcccgacgtgatggcccttcccgcaggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacggtgcctaggggacgggccctcgcgctggagttaagcggccgggggtggagctccaggcctagcggggaggtccacggagattggcccccaccccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatga

SEQ ID NO: 65807 - DNA, 1150 bp, Homo sapiens
atgacagaggccatgggcaaccccaggggctgcgggtggtgcagcaggaactgggcctgcaggctgtaggtgaagggcacccaggccatgtccccaaacgccagcatgaagccaaacccgtcatgtgtgatatccatggtggtgaggacggcctcctgcagggacaagacccagacacactggcttagtccctatgcggccctcagacacccaccctcgtccagtccagcctcacctcgtgccagagggcatcacccacgtagagcaactggaagccattgaccagccacatggccagtgagggactgcctcgaagctctgcctccttcatcaacagggccaggttgatgaggacctggggagagggaacaaggcaatagtctccacagaagtggcagccttgggcagagcagtggccagcctctgcccttctcaactgtcagttacactccagctcttaagtggatccaggccctagacccaaggacagagactgtggacagggaggtgcccgcagcctgtttcttcttgccttgtctgtcctaagccctttcgggctaaggcttcagtgctcaaacagacctgttttcagatctcagcatcatcacttgggcaggttgcttgccctctccacagcctactttcccccacccctgtgtgaaaaatggggataatcatgggcctgtcatgactcaatggcatcatcgtgtttgaagccctccatagcgtccctggcaagtggtacgtgctcagtgtggctagccggagcaagcctgtgctgggcgcctgcatttgacactgagctctgttctatcataaagattacctcttctaatcttcccagtaatcttaggagaaagctttaattttatcacatctcaaagatgaggaagtgtcctcagatgtgcctgtcatcaggccaggacccagacccagggtgggcacctggcactcctgcctcgggtaagataatttccagggcaacaggagaggccttgcccaagagtttctttgggtaatcttggccacagaaccagagatcacagttggaatgttgtcaaggccactagtgacgggtaggttgctaaccccagcgatcaatttcaggttctgcactgccttgaccatcaagcagcatgcggtcactccc

SEQ ID NO: 65808 - DNA, 1595 bp, Homo sapiens
tatcccagagcatttcttggcttctcttacaagccgtcttttctttactcagtcgccaatatgcagctctttgtccgcgcccaggagctacacaccttcgaggtgaccggccaggaaacggtcgcccagatcaaggtaaggctgcttggtgcgccctgggttccattttcttgtgctcttcactctcgcggcccgagggaacgcttacgagccttatctttccctgtaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcatcgcattgtttcatctttacttgcaaggcctcagggagaggtgtgcttctcgggttggtggtatgtcccctaggagaacagtgaggcagaaaaggcagaagcctttggtatggggggaagaaatggtaaactacaagagaaatttcctgtgaagaaacagctacagatcctggggggcttcagatgtaaaattggggttattccctatcctaagtaacttgatcagtccccccaggtcattctttttcatcttctaaacagagaaggtagcaggaatcactgtggtgagaggtttgttatggaggcagcaatagaagggatgggtgggggaagaggtttgtatagaaggtg

SEQ ID NO: 65809 - DNA, 1086 bp, Homo sapiens
tgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaactgtctccaacaactcttgtaacacaaaaccaaggggaaaagacaggggcaggcaggtcccagctcctgtggtccctcctt

SEQ ID NO: 65810 - DNA, 1050 bp, Homo sapiens
agccctagatttgaagcaagactgacccaggttccaggccttgcgtcagtgtgatcacttaaccccttcgagtctaatttgtaaaatggggtagcgtaagctattctttgtctgatgatttcgagggcgaaatgtgatttcccccccactttctcctatgaattgaggctgtgccaggcaccgggctattttgcacagcacgagcatcacataagttattttcttgccccatgcaggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtgagttcagggctcagggagggaggaactccctgggagggaaggaggagtctgcctgggcaaggggcggggctagaggtcaggtaagtagggaagtagccgccagctgcctaactttgaataaactgtgatgaggatgtggaggatcctgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggaggtaagatgtcggctgccccaaaggtgagggcagggtgctgggaaagaatgtttggtatccacattattccctgcctggcccccagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttgtgagtcaaggcagggagttctggagcaggtggaagccagggagtagccagcgggcaggcttaaggagcagggagggctaggttgagggtgtggggtgagccccaggcctcctgaca

SEQ ID NO: 65811 - DNA, 1041 bp, Homo sapiens
ctccaaaagagcagcatctatatgtgggggtgtctataggtgggatcggggtccctgcttgcttctcctagcaactgttgtatgtgcaagtgggaacgtccaagaccctgagtgctgggggctcatctgatagggcggggggacctagccactgaccacagtgtgtgcctctttctgcagatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggagttcgagaccagcctggccaacatggtgaaactctgtctctactaaaaatacaaaaactacctgggtgtggtggcaggtgcctgtaattccagctatttgggaggctgaggcaagagaattgaattgcttgaacccaggaggcggaggttgcagtgagctgagatcgcaccactgcactccagcctgggtgacagagcaagactctgtctcaaaaaagaaaaaaaaaaaaagtgcctgctggaagctagcactgacaggagctctggcaaataggtgaactaccgaggccaggtggtgagcctgatccggatgcggaacccctggggcgaggtggagtggacgggagcctggagcgacaggtgaggggcagtgggcactgtctggagtgccttgg

SEQ ID NO: 65812 - DNA, 1027 bp, Homo sapiens
gcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaatgtgagtcccgcacccctcccgccctgcagccgtgctccacgctctcgcccgagttcctcggcgcctagaaccgaaagtggagcgcttccaatttccacttcccctggagcagagttctcggtggctgtgagatgaagaatcaaacttgagttttgagatttaggatgtggggactttgaaatgcccaccgggtaccgcttggatgccaaatcaaaaataggaatatgcagcacgattttaaaccaactcgaagttcccgaaaggcggaattgggatgtgctagatagagactaggcactggtggcacctgagtttggaaattgttgaagccccggtaacaaagcaacagatgtgggggttttgaaatgtagctttttattcttggctcctccctttccagcctacaccttaaacctctgctgatccatcagttattttatcatagctgttggtggtctgtgcaaatatgaatccctt

SEQ ID NO: 65813 - DNA, 2009 bp, Homo sapiens
ctcagagtagttcctctggctcttttccccatctcagttaatagggacgccactcttcctgttgcacaggctaaaaatatcagcatcatccttgactttctttttctcataccttacattcagttagcagatcccactggcttcacttccagcatgtaaagtcctatccagagtccagccacttctcgccatctccactgccaccaccttgatccaagccaccatcatctctcacctgggcttttccatgattctttaattggtccccctgattctgcccttatcctcttttgtctcccctcagtggtgagctttgtaaggacaaggatgcttctgttttctcattgcccaaaacagtgcctggcactaatagattctgaataaacattgatggagtaaaccaggattatttttgcttttctaggtgaaacttcgagaaatgaactaagtttttacttgtccaattttcctttctacagtggtagagctttgtgttcagtatggacagaatgaggagggaatggtaggcgagcttatagccttctgcaccagcacacataaagttggccttacctcagagatcctgaactcttttgagcatgaggtaagaacaaaatgaaagcaaactaataatgtgattctccatttctgctctacaggggaggcattgtgatatattgagaggagtgtgggctttcgagtcaggcctggattccagtcccagtgtgagcttggacaaactatgtccctgagcctcagtttccttttctgacattgggtctaataatctgtattttttatgattgttataagaattaaatggggctgggcgccgtggctcatgcccataatcccagaactttgggaggccgaggcaggcagatcacaaggtcaggagttcaagaccagcctggccaacgtggtgaaaccctgtctctactaaaaatacaaaaattagttgggcatggtggcaggcgcctgtaatcccaggtactcggaaagctgaggaaggagaatcgcttgaaccgaggaggtggaggttgcagtgagctgagattgcgccactgcactccagcctgggacagagcgagactccatctcaaaaaaaaaagaaatgagaatggacataaagcacttaaaactatgcccagcaggtgataagtcttcaccaaataattggtattattaggattgttatatgttatagacagtcatgggatgtctttgtttttagtctgtgtgtatcttaattctttgaggaatgttagatctttgattatattttgaataccttttattatctcaaggcttttgaaaacacctctgctattacttgactatgaagtactgtattcactatcttttctttttcagtttctgagcaaaagattatcgaaagccaggcatagtacctgcaaggacagtggccatgcaggagctagagacattgtttccattcaagagctgtatccttttctgctgaaggtctttgcaccaagctacatgttgtattttataatttgtctgtagtcgcatgtgtaatttaaaaacaaataataaggccgggcacggtggctcaggcctgtaatcccagcacttttggaggccgaggcaagcagatcacttgagcccaggaatttgtgaccaacctgggcaacatggtgaaaccctgtctctatcaaaagtacaaatttttttttttttttgagttggagtttcgctctttttgcccaggctgaagtgcaatggtgcaatctcagctcactgcaacctctgcctcccaatctcaagtgattctcctgcctcagcctcctgagtagctgggattacaggtgcacaccaccacacctggataattttgtattttttttggtagagacagggtttcaccatgttggccagctggtctcgaactcctgacctcaggtgatccgcctgcctaggcctcccaaagtcctgggattacaggcgtgagtcaccgtgcccggccaaagtacaaattaaaaaat

SEQ ID NO: 65814 - DNA, 1875 bp, Homo sapiens
tcagctaggctggtagaacaagttccaaggttgcctttcaatgtatgagttggtagatgtcctcatggaagccctagtaatggagggacacgggcaatactatcagtgattgccccaagtcacttcactttgctaaaacgcacataaccattcccagcagcaaaaacttgaacgatgtaaaggaattcaacttaaagatattcatggttccttcgttagaagccttcttcaggttggccttgacttgcctaaaacctcagtgaggacttgagtaaagggcagacttggagatggggtggggttcatgctgattccctggaattgtgctatggggtctcctgtggccagatggaaggccagattcagcaaccaaatatcggaaaattggcaaaggttttagaaggtttaaactggccagatgtccaggcacccttcctgcttctgtaaaatgactgactttaatattttacaatgtgctgtattttctcttcttggcaagtgaaatgtcttaaacataatacttttttccacttctgggattgtagttctgacctgtaagatagaagaacttggcagcgaactcaaggaacattacaagattgaagctttcactcctttgctagccccagcacaggtaagagttgttctaatagttctcactaattaatattacgtttttaaatcgatgaccaagaggcatccttcttgcttcctttttcacttcttgtctgtgttctagtttgaacatctgtcttggttgaatttgggaaaatgggcccttctgaagaaagatttgtaagtgctgtctggttttgtggccagagagtgattttcttcccacttggattagagtcttgcacataagcagagactcaaggccttgtttcccttggtggtgagtcaggtagctccccggggatttcccacaaatagaagcattcacgtatcgagataaaaggacagcagcgacggtggggttttcagaatcttgttctctggacaatgactcacagtctctcccctggtttggtctcttgttatagacaaactgctgccaatagtatctttatatcatagtttaatctggcatatataccagtgctttctctctagaatgttttctaatctaaggggaaatatattctagaagtttctttaaagtacctttgtcaatgtttacattcaaagaatgatcagttggggaagtgatgcagaactgtgtcatagaaggaagtgttagaggacttggaaggaagtaattgagggaaggcagggaggcacaatcactgggaaagatgagacttcctctgttttctcccaagagtgggaacagaacagaggaagccatggagacagagattttagctcaattaataaagaacttcctgttaagaggttgtatggtatgtggctaaggatatggctctagagccaaatttctggtttcaaacccaagcttcacccacagtttgaccttgactaaattatctaacctttctgttgcttgttttcctcatctgtaaaatggatacagtaatatccacccgatggttgttgcaaggattaaatgagttaatacatataaaatgcctaagaatacattttagaacagtgcatggtatttagtaagctcaagaaatgttagctattattaagtagttatagctgcccaaagatgcagtgggctgccctggggtggtgaggacagggtggggtaggcatccaggggcaagttcccctacactagagatgctcacacttaggcagcctcctaggaaggctcaagtgctgggtggatgggtggacaagatgccctttcagagttcttccatcctgagagtcagtgatgacgcggtagtcacctcagggtcaaag

SEQ ID NO: 65815 - DNA, 1478 bp, Homo sapiens
ttttacagtattcttacttctttctcattactccaacttctgaactaatctctttttaaagctcaaaatactattattagtatggtgatcaatttaccttgctagatttagaaagtcagaaaacccagtgtgcatttttattgttcgtttgttttttgtttttttttttttttttgggacagagtttcactctgtcacctaggctggagtgctgtggtgcgatctcggctcactatagcctccacctcctgggctcaagtgagcctcccctatcctccctgagtcttccgaatagcttggactacaggcacacgccaccatgcccaactaatttttgtatttttttgtagagagagggtttcaccatattgcccaggctagtcttgaactcctgggctcaggcaatctgcccacctcagcttcccaaagtgctaggattacagatgtgagcccagtgttatagtggttatggggctctgggagcctccctccatctggggcaaacgtgtttctgcctgtgaaattggcttggcgccccgccagcccatctgctaactgtccccaggctctacaggcagccttggagggacagatgagccctccacagagaactgccagaggaggtatctgaagtcattcacagacacaagtgattctgatttgttcttttggtgtctttgtttctccccttgcagtttggccctttcctggatgctaagcatgaacaggtggaggtgagtgggctggggtgggaaggggtcctgggtacttgaatccagtcaggctctcacttttcattttttagtgtttatcccacatctgtaacaaacacattaagtcctgtggctaatcagaaaatcattttagcagagcactttattaataaagatctggaatccaagggcctcctttcaccagaatacaaggctgtctggaagctgggggagggacatataagtcctaatgttcctttgtttgtgatgcctgctgctaaggcacaagagcactagcacaaatgcaggtgtctggcagtcatgggctgccctgtgaaagaacctgtcctggccaataccccaagcttataactcatcttgctgtcctttgcataaaacacgaatggtccttcctgggacatctccatggctgaggtctgggacctccaatccttcgtctcacgatactttaccttccatggaaaatatttcaaagtactctttcttttagtctctctcagattgcattcaagagggttaattcccacatctcttctcctcccttcgactagacttagctccttaagacaaagaccatgtctttttcatctttgcgtctccttcagctcctagcccaacagctgacttctatgggtcacctaacaatgttaaacaagtgaataaacaccaaacatctgccgtctaaatctgtctcctttcctttcttgcagaattgtctactgacaagtccatttgaagacattt

SEQ ID NO: 65816 - DNA, 1033 bp, Homo sapiens
aatttctttgtattcctgagaggtcagaaatgcagagcattaagctgagtcatcattagtaaaagtcagagccaggctaagcacggggctcacgcctataatcccagcactttaggagactgaggcgggcagatcacttgaggtcaggaattcaagaccaacctggccaacacggcgaaaccccatctctactaaaaatacaaaaattagccagatgtggtggtgggtgcttgtagtctcagctactcgggaggctgaggcagaattgcttgaacccaggaggtagaggttgcaatgagccgagatcgcaccactgcactccagcctgggcgacacagcaagactccatctcagaaaaagaaaaagagccagtgagaaagcacctcagagaaagcgagcagagcccgcggttctcgtcctgtttgcgggagcagctggaggaccctcccgctgtgacgtacgaggttgtgcaatgctgagcatagttgggatgtttttctgatccctccttctataggcgctttctaaccatgagcaggaaggctatttcctccttaactattgcccttccaaagcctacactgaaacagggcaattttgtcccttgagagcagccagctgcacctcagtcctttgtgtttatcacagatgtcaagcccttgagatgtggagcacagattgtcccattcaagttaccctgtggcctgtttaccagaccctggcacccaaatggtggactggatcaccctagtgagcttctcagtgtcaaagggacaataatgaatatgcaaacacctttggtctcaggattctgattttctgttatagacatctcagttcacactctgagaggacaccacaaacagtgataagggtgacagctgtcaccagcacctttatcacatgtgaaagtgtatgtatgcctgagaagtccacatgttttaagcaagagacagagatggaagtgagagctattggtggattttaaacatgcccgcaaagtaataccttatgcctatttgatttataaacg

SEQ ID NO: 65817 - DNA, 1228 bp, Homo sapiens
cttggctgaggtttgagattcaggtcagcctggctacacacccgcctcatgatggtgccaactttgcatcctcttgcacagtacggtgctggctaatggccttccttgatcttgattatgagggattcctgtgctttcccttctcaacctggtgtcctgcgtccctcctcatgtggggacagactgagctccttgtgggtgggtctttaaacttccccagaggcatcctcctcttgttgctgtgccttggccatttaccttctctctggtttattaaattctccagtcctccctgaagagaaatgggctgaaaaacagagttctgttttcatgctttcttttctttcccagttcttccggaacttcagacagattcagccgaatactcaagcacatcttgacccagaggaggtgagcttgccgctgggacccctgactgtggagagagtgccttggggtcatggagctatgacaagcatgactgtaagagccttcaccaggctaccagcagggaactttaccctgtgatgacaagcctgcattctgccccacacacacagagaaaaagtcggtctgtggatgccagcagcacgaaagccagtacctagggggactctgtctgagaagggggccccccggtcagctagtgctgacaatttctctctgtctctgtagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctccccaagagaacgagagcccagatgactaggaaggccctcaaatgagggctttcaccaggccacatagaggtgacctggggaagatttcatatgtacacttgcctgtcctctgcctcccaaattctgatatgacctccaagtgggctcagctgggaataccttgaagaagctattgggtcattttgatctctgccaccctttagccctgc

SEQ ID NO: 65818 - DNA, 1147 bp, Homo sapiens
acaaaaaaaattagccaggcgtggtggtgggcacctgcagtcccagctactcaggcgcaaacccgggaggcagagcttgcagtgagccgagattgcgccactgcactccagcctaggtgacagaacgagactccatctcaaaaaaaaaaaaaaaacttcccatggccggccacggtggctgacgcctgtaatcccagcactttgggaggccgaggcagttggatcacctgaggtcgggagttcgagaccagcctgaccaagatgaagaaaccccgtctctactaaaaatccaaaattaatcaggtgtggtggcgcatgcctgtaattccacctacttgggaggctgaggcaggaggatcgcttgaacccaggagacggaggttgcggtaagccagtattgcgccattgcactccagcctgggcaacaagagcgaaactctgtctcaaaaaaaaaaaaaaaaaaaaaaagcttcccacaaggtcacacaaataagcaacaacattttaatttaaactaggaggcgagtgtcaggacagaaccaccaataatgtgctcccagggtggccaatcagaggcaggagagggcatggctgcttgtggcatcagggcaaccttttggaagcatgctatttgatttggccatgtggcatggtggggaaagcatttcaggctaaggaaataacgtgaagcacaggggaaagatatcccaaagtatggaagggagcaggagcaggattatagcatgcttgaaaggcgttggtgaggaatgaggctggtgtgggtgggaccacgtcacagaggaggttctgggtggccttggccagtctcatcataggggagcttttggatgcacatatttctacccatgctaaccctcctgtccactcagcggatcctagaaccagatgacttcctggatgacctcgatgatgaagactatgaagaagatactcccaagcgtcggggaaaggggaaatccaaggtgaggggccagcgtgctgcctgcatcttgggacagggtggcctagggaattccttattttatttcaagtgagattagcggccacttccaaaagagtctaactcctcaggcccagctaccaaaataagggtgtctctttgctcttcttggcagggtaagggtgt

SEQ ID NO: 65819 - DNA, 1025 bp, Homo sapiens
aaaagagccccagaagctagagagccccacggcctgatgctcctggctgaggggaagtggccgtcactcaaggcctgtcccagagtggagctgctaggggaagggatggttgccctctgcctcaggtggagcccccacagcttgcagggatggggacatggcactcttgtatcctaacacctttctctgcaatcttcttcccactcagtttgtggaaaacgttacaagaaccgaccaggcctcagttaccactatgcccactcccacttggctgaggaggagggcgaggacaaggaagactctcaaccacccactcctgtttcccagaggtctgaggagcagaaatgtaagctgaggtgtcagaagtggtgggcaagcagaagttggcctggttatgaaaaccactccttgcatgggtgttgagtggctcagggacccccatgggtgtcatcaaaactctttctctctgtagccaaaaagggtcctgatggattggccttgcccaacaactactgtgacttctgcctgggggactcaaagattaacaagaagacgggacaacccgaggagctggtgtcctgttctgactgtggccgctcaggtactgcttcccgtgaaggctgctgctttgcccagtccccaaggggctcttggcttgctggcctctagggctgtcataaccagcccacctcgcttttcctaaccaagagaagatgtagccacaggcaggagctcctctcttccccccgcatttccgactgtctgtctcactcacttcccccactacagggcatccatcttgcctccaatttacccccgtgatgatggcggcagtgaagacataccgctggcagtgcatcgagtgcaaatgttgcaatatctgcggcacctccgagaatgacgtgtgtatccccgccccctcctcagcatggctccttctgggcttttactgctgtttgcacagttccctctaaagtgagctttcttttaaaaagggagcaggatccctcccacatgccacacgc

SEQ ID NO: 65820 - DNA, 1024 bp, Homo sapiens
accaccgcactctagcctgggcaacaaagcaagaccttgtctcaaaaagaaatagtcactgggcacggcgtctcacacctgtaatccaagcactttgggaggctgaggtgggaggattgcttgagcctgggatttcaggaccagcctgggcaacgtaaggagatcttgtctctccaaaaacattgaaaaattagctaggtgtggtggtgtgtgcctatagtcccagctacttgagaggctgaggtaggaggatcacttgggcccaggaggtcaaggctgcagtgagccgtgattgcaccactgcactccagcctgagtgacagcaataccctgtctcaaaaaaatataccatagagcttgggctttagggaaaaaaaaaaaaaaaaaaaagtggaggtgatttgatcaattaggagctctgaaaggacccaagtgagaaatgacagtgactggatctgcggtggagaggggcagcatggtttcccacataagattctcacatctgttcttacctgctacctacccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggtaagttgcccagatcttttactcagaacaattactttattagttacttggaaaatactgagttctatgttctttatgttatcacttacatattcttccaaattagggagtaaagcaccttgccttggctcagtttagaatgccttcctaacatttcaacttaaagggtttagtgtttgcacattatcagctacatttacaacagaaaatcaacagcccagaagaaagcagatgctgagccgagatcaggcacccagaaggaatgatttattttcttccaaccagtccagaaaactcaagtggtagattatctgatgtgaaacttctgcagtca

SEQ ID NO: 65821 - DNA, 1122 bp, Homo sapiens
cctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaac

SEQ ID NO: 65822 - DNA, 1060 bp, Homo sapiens
ctggcccgggcctccgtccccggctgggcgtgcgccttgccctgcctgggcatccaggtcgacccccggttcttgaccgtagcaacccgcacccctcccaccagcgcccggtctgcactcttggcccctccaggcagcgccgctcaaccttgcggacccagcctgggatcccttaccgtactcaccgagagcttgaggagacctccagccccccatccctggctcccggtaactgctgtttctctttgcctttgcagatggacgggacagaaggcagtgccgggcagcccggccccgctgagcgatcccaccgaagcagcgtgtcctccgtgggagcccgaggtgggtcccacccgcatctcctcttccacaccctcctgggaccccagccctggagaagtagctctggcttgtcttctttttcattaaagataatttatgtatcgactaagaaataataaggtacattcagatgtggaaaactcacagaagtcagaggctctgtcactagtttactggccaggttgggtcctcgctctcatttgtaaaatgagcttgtttaacatagctgtgaaattcaaatgagattatatgaatgaaaagtgaaggctgatgtggttcatgcttgtaatcccagaactttgggaggccaaggtgggcagaccacatgtgcccaggagttcgagaccagcctgggcaacatagacaaaaaagaaagtgacacgttcactttctttgtgtcatttctttttttctttctttcctttctttctttctttgacagagtctccctctgtcgcccaggctggagtgcagtggtgcgatctcagctcactgcaagccccgccttcggggttcacgccattctcctgcctcagcctcccgagtagctaggactacaggcgcccgccaccacgcctggctaattttttgcatttttagtagagacggggtttcatcgtgttagccaggatggtctcgatctcctgacctcgtgatctgcctgcctcagcctctcaaagtgctgggattacaggcgtgagccaccacacccggctgt

SEQ ID NO: 65823 - DNA, 1051 bp, Homo sapiens
caggagggacaggtggcagctcttctcaatgtttttttttttttttttttttgagatggagtctcgctctgttgcccaggctggagtgcagtggcacgatcttggctcactgcgagctccgcctcccaggttcacgccattttcctgcctcagcctccggagtagctgggattacaggtgcccaccaccatgcccggctaattttttttgtatttttagtagagatggggtttcaccctgttagccaggatggtctcaatctcctgacctcatgacccgcctgcctcggcctcccaaagtgctgagatcacaggcatgagccaccgcgcccagcctcttctcagttttgagccctggagccactcccctcacctcctcgtgcttcccagcaggtccctgctgctgaaaggtctccgcctggacagtggtcagcaggctctcctggccacctccagcagccctggcccccagaccaagtgccaaacccacgactggctttgctccacacctggggccacgcgcttccctccgcctgcagtgcccacccttctctgtgccatcaggcccttctccctccggtcgcacactgccagctcagatgctgccacccctacgaagcctccccttcatcccacctctgtttctcccttccctggggcgggtttcagtcacccaaacagcagaagttcctcagagcccaggttggggcctcgagcagcctccctcagcatttctggtgctggccggaggctgaccccagtcccctccccaggtgtgccttcttccacggtgaggttgacaagccggcccaaggctttttgcaccggggtgggcgcaagccagtttctgtggccatcagtctggaaggcgtgcacgtcatcgatagcagagagaaggtactgcccccagctcctccagggtggagaggatgggagggggctcctgactcaggtcttcctggttcctctgggcctgtgggggcctgggggcaaggtggatggactgtctgggagggaccctgcctccgttggatgtcctcgtagcccctgag

SEQ ID NO: 65824 - DNA, 1792 bp, Homo sapiens
tgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgt

SEQ ID NO: 65825 - DNA, 1052 bp, Homo sapiens
gtcctggctcctgactgccctgaccttcttcctgccactgggcccatgatgggggtccccaactttcaagaacacagggtaaggggtttgtttccctggtggtgggcgggggcattcctcagcttcgtgatgggtcctgagttttccaaaggtcaggatccatgtcctggaaacggattctgctgtagatgtgtgcttttctgtgaaatgacagcttagtaaaaatacttaaactggggctatttggagacatctaagaggtggagtgagcacaacctggcactagtcgcctccctcctgaggcagttgactgtccggcctctgcccctgggcccttcctccttcccagctgccctgagccctcttccagcacctcctgtccccacctcacacactaagtcttcctgctatttttaactatttgacataatttgcaaaagagagaataatagtcccagctcttcccaaggacttctttgtccggtgcccatctgaccttggcactttgttgtgggggtggcagtgaccctgacaagttctcccagccagcgagagcacaggcctcccatacagtatcgtcaaggtcagcagcctcccgggcaggggggttctactccccgcagaagccctggcaccatggccaacttgctcacagagggcactcagtcagaccaaggtgggttggggcagaaaaggctccttcagagattcaaggacagtcacaactggtgctgtgatggggccaccgggacaagcacagtgcaggccattcccatcagcagggacccaagaggaagtggtaggctctggcagtgggggcggctggcggtcctgaagacagagggctttgcaaacctaggggtggaggtagtgggatgtcagcacctgggctccctgctcagaggagctggcgccaggattcccagtgggtgggcttggggaggaggctggaaaggttagcacaggcgaaagtgtggggcctaggaaagctgggctcgcttatttggccaaggagggtggggagggttggaggaggtctaggggccgctgga

SEQ ID NO: 65826 - DNA, 2316 bp, Homo sapiens
gatccctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaa

SEQ ID NO: 65827 - DNA, 1894 bp, Homo sapiens
gtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgt

SEQ ID NO: 65828 - DNA, 2096 bp, Homo sapiens
tgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaac

SEQ ID NO: 65829 - DNA, 3586 bp, Homo sapiens
acaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagtt

SEQ ID NO: 65830 - DNA, 1221 bp, Homo sapiens
tgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccct

SEQ ID NO: 65831 - DNA, 2260 bp, Homo sapiens
gctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccc

SEQ ID NO: 65832 - DNA, 5611 bp, Homo sapiens
agtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtag

SEQ ID NO: 65833 - DNA, 1379 bp, Homo sapiens
ggggagggggcgggcagtgcctacgtggcgggcggagggaccgagggaccgacaggcggacagggccggggtcacgtgggcccggcgaagtgtccctaaggctgacctggggagagacctggctgcgggcccttgtcttccggccacacaacagctctgggaccatctcaggccccgctgccctcccctaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggaggtacctgctgccttgcctgcccgtctctgcccctcacgatgtcctggttacccactcctgtctcccctcctgccctgtttccaccctatgtgccccagcacccccagatttggtttcctcttccccatctctcccaacttcaagtcgcttatctctccttcctctctgcccctccgcccttgataaccctgtgtccccttccccagacagaaaaatgcctccacgtcgtgacagaggctgtgaccccgttgggaatatacctcaaggcgagagtggaggctggtggcctgaaggagctggagatctcctgggggctacaccagatcgtggtgaggtggggggcagtggtgatgagagcagggatggggggttgcaggtgctggggcgtgatggctccttttgcccccagaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtgggtgactgggggcagcgcgccccaacctgccctgtcctggaggcccctgcagcctcaggactcctagactagttggcactcccctgttccctgctgcctggctggggagggaatcagtgtcccaggagtgagggacactcctctgcccccagggtcctcagggcggtagggcgggatggacacagcattcggggttgggtgattctgaacttgaaagctctgtgacctggacagatgtgcctagttctctgaggcttggtttttttaatctgttaagtgaggctaatgaaacctgcctcttgggactgatggctcagctgagggacatagccaggccctggcatgcagtgggtgcctggtgcccaaggcaggctggaggcctgtgcaggtggttggtggggccctaag

SEQ ID NO: 65834 - DNA, 1047 bp, Homo sapiens
ttacaggctggtccattttggctcagtgggaggatgaggtctgggagtaaagtgtacctaatccttgccttcccacggcctaccaggaacttcctgcccaatccagccagggcagggaaaccaagtaagccccttcacctctttgatcttcagtttcctcctctgtgctcacatcctgggtggcgagcagtagaggcaacactgataaagggcctgatgcccttagtgatgcctctgctgtccctagtggctgctctcccagcaacaggtcaggtagccgcaatggcagcaacagtccctaacccaccgagcatctgccgtgtgccagcctgttctgcagcttttatgtgcattttctggttgaatcccagaactatcccgtagatggtagagctgttatcccattttacatggcaggtaagtgggacagttgggctttgaacccaggcagccaggctccagagcccataaggcccataagcatcacttctccttgtcctcacccatggctgggtttgggctgcaaccaggctgatctcttccccgggtcccgtcctcactcccccagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgagtggaactgtggggtccagaaggctggctgggtgcacaggaactgccaaagagaaggccctggggtagggcaggctgtttagggcagacccaagcccatatgagcaggagcttcctgccagtgtctataaacaggtacctgaccagctgtcccctggggaggagagactctgccgctaaaatccttttttccacaaacctctggcttcacaaccctcagcccttcctccatttctccgggtctgacctgtgcaccttggttcccagggcccaggggattacctactcaccaccccactttgccctcctccctcctg

SEQ ID NO: 65835 - DNA, 2103 bp, Homo sapiens
tgaaggggatataggagctgggtaggctccagtcaccctgtgggcttccttggtgccccttccccccagtagcccccttcccctagcagcctctgccctgtcccaagacccccctgaaagctcagtgagcctctgctccccaggagttcctgccccagcccccacccctgttcctgccacccctacaacctcaggccactgggagacgcaggaggaggacaaggacacagcagaggacagcagcactgctgacagatgggacgacgaagactggggcagcctggaggtgtgtggggctgagggagcctccccaggggaccccagctcaaatccacaggctgccattcagggagcttctgtggggcctggctggagttggcctgtcctcatcagcacagcatccctggcacgtaggcctcatggagtggccattgtaggccagagccagcagcaggccccattcaaccccagcggccccagggagcaggctaggcagatggtgcctggggcattccctgaacttcctcactcttacccacaccgtccccctttcccctcctccagtgcccacccagccatgggggtcagcaaggagaggccactcctgggtctagaaccagaccagttctgcttgggggatgggctcaggttgggctgagggaggactggggctgtcctcagaatggggcagagctgggggcccaatttccccatctggctgacagcagcagtttctggccctcaaggctgttggaaggggcatctagatctcattccccagccttaaagaggggtgagggcaggccagggtcagcgtccatttaatagatgggaaacagggcctgaggagcaaatgaggaggaaggcaaaagacagtggtggggcccgtggctgggatgatgctggggcgggctcacttgccctttagcatggggtgggagtcagtggtcccttcccacactgcagcaggaggccgagtctgtgctggcccagcaggacgactggagcaccgggggccaagtgagccgtgctagtcaggtgagctgggtctggtggggaggtgtgtgtatggggctctttcctccttgggcccagggctacttccccctcccgctcttctacaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtc

SEQ ID NO: 65836 - DNA, 1057 bp, Homo sapiens
gggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaagcaaattgatgttcacgtctgacgtgggcgcgggctgcgcagggcggcgccagaccccagccgcctcccaggggctagactgagcccggcacaaggggtgtgaaatagaatttattgtggctctgattatgtacacgtgagatggcctggctgggccggccgggctcacatggtttgtacaataaatacatctgtggggcgggctctccgcagccgggaagggccaccgccacggttcagtccagcttccgggctcccagcttcatggggcccttggccaccttcctctcggcgcgtttggcctccatctcccgccgccgctcctcgcgcttcttccgggccagctcagccttgacctgtcctggcgtcaggaaggggagccccggtctcagctctccagccagtgcctgccgggggcctgtaggggcgggctagtcggggagccctagtcttcagcccacccaggggaagcacttacgactgtcagtctcgaggccctcccagttgtcctcaccccaagagtctggcctcggctgtaaagagaagtgtgggctgcagtggggcccacttctggctgaggtccaccatctctaccctctcgccagacctgtgctgggtacctgggtgctgggacgtgcagacagggtagcgaaggggtcg

SEQ ID NO: 65837 - DNA, 1048 bp, Homo sapiens
gggaccggagccactgcgagggtgagggatcttagagctggggtgctgacctgtccctccctaccccaggacccccaccccccagggtccagtcctaatccagatctcagttggggcataggggcgtgggactgacccagggctctgggagaaagctttggctgcctcaggctggggttggtgatcagcccctgagattctccaccccttccatcccctacagacattgatgagtgtgacttccctgcagcctgcattgggggtgactgcatcaataccaatggctcctacagatgtctttgcccccaggggcatcggctggtgggtggcaggaaatgccaaggtatgggggactggctgagggttcctgagggatgtggcagggagcagtaattccctagacacactgtggcctttctccatccatccatccacccatccaaccatccttcatccatccatccatccatctatccatccatccatccatccatccatccatccatccatccatccttctatccatccatccttccattcatccttccactcacccacccatccatctgctcagccttccagtctttcacctagaataacaatgatcacagtaaacatgacagttagtgctatcgtggtgcttactatgtgccaggcactctgttaagctctttacagatattaatgtattggtcttccccatcaactcacccatacacatgcattcatccaacaaaagtttaggctgagtgcagtggctcaggctgggggcggtggctcatgcctgtaatcccagcactttgggaggctgaggcgggcggatcatgaggttaggagttcaagaccagcctggccaatatggtgaaaccccatctctactaaaaatacaaaaattagccgggcgtgatggcgcacgcctgtagtcccagctactcgggaggctgaggcagaagaatcgtttgaagatgggaagcggaggttgcagtgagccgagatcacgccactgtactccagcctgggcagagagtgagattccatctcaaaaaaa

SEQ ID NO: 65838 - DNA, 1032 bp, Homo sapiens
gtgagtatgggacagaaacagacagaggtcccatcctctccctcagtcattctttcattcattcccccgaaccccctgtgggacccagagctgaggccagcctggccctgccttccagagcaccctctataaggaggcagacagacaagaacatagccaagcaggtgccaggcagagctggccagtgggtggtaaggcaggagagggagctcaggggggccggataggaggaaagcctccctcctggtggagacactgagctaggaaggatgagatctgcatatatagagaggggggggacctggggccctgttgtggagggaagggcatggatgaggccaggaggcaggaggcaggcacatttgcaagagggagatgggtcctggggtgtgcagtacacagggaaggagcagagggggatgggctgaaaaggttctggtccatggagtgagcttctgcctgaggcaggtttctctgggacactgagattgtggaccagcaggagaggctggaagccaaggaggggtctgggtggccaggcctgggccagggcaggagcagtggccctagggaggaggggaggcaggttcatgggacattagaggctgtaactgggcaggggagagcaggagggacggagccgtcggggctcagctgtggatgcctggtggccaggtgaagaggaggtggggaggcaggatgctgacttctgacagtatgtcctgggcagaggtgcctgagagagccctggaaaggctgggggctgtgtctgtgtcttgagatgtggacatctttggcagtggtgaggtgggcgccccaggatggtgaagagggagagggtggagagcaggcagagaggactgaggcctgaaggagggaagggtttatgggagaagaggaggaggcgccagggacggagccaatacctttggaaggctcaaggggaaagccagatcaccataattatttgctaccacttattaagcaccctttgtgtaccaggccctggggtaagcatttgtacagccctta

SEQ ID NO: 65839 - DNA, 1001 bp, Homo sapiens
ttttccaaaagaagttggaaatatgagctgggcacagtggctcacacctgtaatcccaacactttgggaggctgaggcaggtggatcacttgaggtcaggagtttgagaacagcctggccaacatggcaaaaccccgtctctactaaaaacacaaaaattagccgggcatggtggtgcatgcctgtagtcccagctactcaggaggctgaggcaggagaattgctagaacccgggaggtggaggttgcagtgagccaagatcgcaccaccgcaccccagcctgggtgacagggtcagacaccgtttcaaaaaaaaaaaaagttggaaatacaaattccaattcaaaaaatactgagacactttgtggggcaaaaaatacgaaaacccagggctgtgggtctcattgctgcttttccctgggcctgtgcccacgcgatttctctgcaggactccctcatccctgtctgtgccctcctgatccacaagcatctcatgccgacttcctcccctatcttccctcactcccccacccgaggccatggtcctgatctgtccttcccaggttcattctatttgcttccatccaagaatccatcccactgtattgtatcccctatctggccacaggctgtggcatctgggcagctctcctgggtctcaaagggtgcctggggtgggactggggaggccacacccttcctggcagttgaagtggaggcaccagttggggtgtgttggtggggagccccagctgtgatgtcaggcctcacagggcctgggctccatctggctctttggggctgaaggaagggctgcatgaaccccaaagcccccagggagccatggcctcttggagccgcaccccccgacttggctgcctggctctcttacctgtggtggtgaggatgctggcagcgaagagcagggctgagggaaggtcccaggtcctgccctctgagctgttgcccagggtggagaccccatgggcctgggtggccagg

SEQ ID NO: 65840 - DNA, 1050 bp, Homo sapiens
cgttggaacgagtgtctccccgatctccctggggcagagtcggggcgggcgctgccgggattggtgccaggctgacctctccaccatcgctgtctcgggcgcaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcggtgagggccgggccccggggcgtcccccgccattggctgcgggggtgggggtggagccaggcctgtgtgctcaccgcgctgggattggtttagggtgttgtgggtgggcccgtgagatgaaggctgggaggggtggagccaggagtgttttttttctgtctgtgggcgggttctggcggaagtatttgcatgtcggtctgggagtgggaaggggtggggttcacgaaagttctgggaaggtctagtgggcggggccggccggcgccagggcatctccgactcagacgagtagctttccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagtgtaagaaacttcacctctcatgcccctctccgccccccagctccttattctctgtcagaccttattcttggaggcggagcccactcactatcccctcttcctccccgcccccaggctccctgc

SEQ ID NO: 65841 - DNA, 4926 bp, Homo sapiens
taaagggggcgggccgagaggggcgtgcttcggtagtgcagaactctcgctgctactaggggagtccacgcctccaccttttccccgcctcctgtaactcattggaagagctgtgcgccaattactttgccgttacccaatggctactcaactgtctctttggttccgcccagtcgtctaccctgggttggcaacgcctgggtctacgcatgcgcccaaacgcttttacgctcgaacttgctttagtcctggagtctgcgcacgcccaaagggcacccctcgcgtcctaccgcgccatcacctttctgcgcttgcgcattcatgccgtcaagttttccttttccgggtcccaattggaatcgttgggcgcatgcgccactgcaggctggcggttcgcggctccttcttccggcctcctccttaggccggcaccagcagaagccgggcgagcgcggagccccaagcaagtgacctgcgaccccgaaagtggaccccagatcctggggttctccctggtccggagactagggagctgtcgcctgcaccccgggagcacccaccccacgaccacctctggatgccgccgacgggtacccggcccgtgccccgcgcctgcctgccggctcggcccctcggagcaattctgggccaggagtggggacccggaccccgcccctgatgcagccccacccccgcgtccgggccttgcaccactgactgtcccggccggccccgccccctgctcgcaccctcgcgcggccgagcccccctcccccgctgggggaggccatggcgtgagcgtgaggccgggccccggggccctcaggcgccagacggggcatgggccgggggccgcccccatgagggtcccgggagggggggcgcgggcagcagcggcggggccatggggtcgcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtgagacgccacggccacctgtaactccagccgggagagggagggcagcctggcagggattcagggcagtgccctgggctctgggacgtggagagagaggaatcactgcagagtttgggtctgtgtggaagaggggccaaagtcttcctttcttggatcgagtgaccttgaaccctacacttaatctcatccagctaagcagaatacagagccctttgtcgaggtctgtgtactggttgtgtggagaggtgatgaaattttcttgtgagtctgtgaatcccagctatgatgttgatggcaggtacatcctgtgggggcgaggctttgtgaaaagggacctggcttactttcatcttcaggtcctgcctcccagcttgatggtggccggcgtgtactgcctcgtggtggctgtcatctttgctactatcaagactgtcaattatcggcttcatgccatgtttgaccagggcgagatcgtggagaagcgcagctctaccatgggggagctggaggaagagcctgcccagggggacagcaatccacccaggtgggtggggtaggggctgtgctggggattgagggtttttggtgcctgggccggaaccttgcagggtggagtaggggcttagggaacattggctctctgagtgattgtgaacacttgtcctgtgttagccctggaattgtaaagtgacttctgaaaaagaagcagtgacaaagatgggaggaagtagcatacacagaggagaggttagctcaaagctgctgctctttttcaccgccagggaccccggagtggagatgacagtgttccggaaagtcagttccacacccccggtgcgctgcagctcccagcactctgtgtttggcttcaaccaggtctcggtgagtgggcctggacctcagcttgtcctcctgtccctctgcgagccagtccctactgtgggtgcatcctgagcctacttcttgccttgtttgttccttcatggctctctgtctactcaggagctgctgccccgaatggaggactctgggccccttagaggtaggtggctgctcttcagggttggagcatagtgctgtggaacaggggctggcgtgctgtgccagggggtcctgctgacacctctggggccatggttgcagacatcaaggagctggtgcgggagcagggcagcaacaatgtgatcgtgacttctgccgaccgagagatgctgaagctcagctcgcaggagaaactgagtgcgtgggccttatggggccgaggcttgtgggctagaccagctgtttcgttgttgaatcccctcaactttggctccatcctgggtctcctctgtattcctctgtgggacctccccagtgtgctgctgtggctgggctctcagggaaagtacagggcataagacctcccttaaccactagtttgttttgcagaaaacccttttttcattttctgtttccctttattttggcagttggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccagcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggaggtgagtgcttgctctagaggcaggggctgggggacgtgagctacgggcttggggttgggcaaagggcaggtaagaatggacctggtcagtgtcagctcagcctcggttgtaggcagcagatggacgtgggcctggtggtgattgacattgtctgccaaacctcttagacatggggctcagccacctggctccacatccttgattagcacctgagtctctgtcccctgaggactctcatcatccacactcatcctcccaccaccagtggggtggggcagggccgatcagtgtcatccttgtttgcaagtaaggaaactgagcatggggctgtgtgacctggctgggcctcagagccggggcgtggttgtactaggcctttagctccctggcggaacaccgtccccaaccttactcccccagccttgtctgagcatctgtcacttacacttgggggcctctctctgggcagcggccgaggagactggcaggcgggaccgctcaagcagtgtgaggcggacccaggccattcggagacgccacaatgcaggcagcaaccccacccctccagcctctgtcatgggctcgccgcccaggtgagcaccttgccagctgtgccgaggggcaccgggggccggggagggcccgcaagctctagctggcgctgacctggggctgaccctctccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgctgtgcactatttctacgatgagagcggtgagcctttcccaagcccggtggcccagtgcctccccgccttcccccaacagcctgagtcctcctagcagtggtgctcgctcggccctgtggcaggtacactgctaatgctgccagacatcatccttgcagcctctttgaggcacggtgtctctgtcatcttttgctctgctgatgaggaaacagaggctcagcttacagtacaggggagatctaaagctaggacaggtgactgccgcgcccaggctcttgacctgtaggccctttcctctccagaggctgggctgccctctcagaggacacagcacaaggttctgcctcatttgatgggtctggtgcccacgtgagccgggccttggtgcttctgtctctgccacgctgcctcatctcccataccctgc

SEQ ID NO: 65842 - DNA, 1054 bp, Homo sapiens
aggcatgtcctcaaggctgagccctgcatgcacgctcggatggggtagtcagagtgacagtgacaggccctgtctgggaggagggtagcatttgtgccaggtcccaaaggacaagtggacttccttgagcttcagaagaggtgggagagtttgcctgactggggaagacaggcgtgggagcgggtgactctaggcagcccctgcagccactgggcgacgtcctgggaacctggagagaggaggagccctttcagatgaagggttctggtggggtccagggccgctagacaggggcctttatgtgctgatggaaatggtcaaccagaccggtgtgctgaaggggggtaacagtagaccatgtggggggtggcggggctgacggccgcggctgtggggactgcagtttgacctgctggaccaggactccctgcacgaatcccaggagcagacactgatggaagaagcgccaccccgggcccagcatagttacaagtactggcttctccctggccgctggacctctgtgcgctatgagcggcttgccctgctggctctgctggaccggtgagtgtcccgcagccttggcccccaattcttggaaagcccctggaccttggctccccagactctgtacctgtggaggcagtcatggcagcagagagcctgactcgggggaagctgagggcctgtcgttggctggagtctgcagtggtggtttctatggttcatttgtggtgtaaaggggtggccaagtgggtggtgctgtattaaatctgtttattccaaagtcctgctgaaaaaaactttttttgagacggagtctctctctgtcgtccaggctggagtgcagtggcatgatctcggctcactgcaagctccgcctcccaggttcacgccattctcctgcctcagcctcctgagtagctgggactacaggtgcccgccaccacacctggctaatttttgtatttttttttttttagtagagatggggtttcacagtgttagccaagatggtcttgatctcctgaccttgtgatctgcccgcctcggc

SEQ ID NO: 65843 - DNA, 1869 bp, Homo sapiens
tttctcagaggggacacagagtcccagaaaatccaatagagaagtcagatgacttctacccagtgtagagaacttgggcctagagcccatgtggcttcccgtccatctgggtttctctaggcacagggactgggtgctggtcctgtgtgcatagcgtggcacgcccaaggcagcatgcacgatgtagccacgtgcagttaactcagtctcagctggggatggatgaatcccgggagtaatggcaccctgagctctcagccctcaatgtccagagcaggcaaagattgggaaggagagagcaatacaatggtcgctggagcaggtgctgccgggccgcgtcgtcgcaaagttataggtgttcacatcttcagaggacaagggtctggcatgggcacagtcccagagctgggcctttagggcaagatccatcttccccactgccccactggaaggtgaggcaagacgggcacgccctgactaggctgtccctgcaggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaaggtcaggccgggctctctgtgtttccttccccacccgacttttcccaagattgcccttcccacaactccagttttaaggagtataagctgaaaggtagataatttgtctaaggttccctagagctggccagctcttttacaagcaagaaaactgaggctcaggacagttcgggggcctgacctggtcactcataactgcctagtggtggagctgaacaggtctggggcctctgaccatcccgtgggcatcggctctagttgccaacgtagccctgtctcttccagagcgtgcagcctgatgcggcgtcccccatgcacgtgagtacccatggagcagcgcctctggccaggaggccccgggaggggctgagaccaggtggggaggagggtagggtatggagggctggggctccctcaccacccccatcacccccacctggccaggctctccagcttggacccagggccaggcctggggcccttgagtgtgtgcatgtgtcagaggtgtggccagtcggggagacccagctcctcatgggctgacccctcagggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactggtgaggctggggcagggatgaggtggcccaggagagtgagtccccgagggtgggccgcggaaagccagcaggctgaccaggccttcgtgtcccctccctgccagtgttcaccctgtgcttccccttcgtcttcctcctgggcctcctgccccaggtcaacacctgcctcatgtacctgctggagcaaatagatatgcacggcttcgggggcacaggtatgatgcccacaggtggctcagggatggggcccgtgtggaggcccaggagggccctcggattgggtccttggctccacccttgcggaaccttctcctgcgtctgtactgcagactcaaggtttctgccttctcccctctccttccctccccaggcaagtggtttatatctgagaatcttggaagctctaaaggccgcttggggcttggggcagcagagaacaatgggctgggggtgcctttccagggaggccagcctctgggagttgaggggaagcgcggct

SEQ ID NO: 65844 - DNA, 1080 bp, Homo sapiens
cacaggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctagtgaggaccaccccaccctcaacgatcccatcatccgctttcccttttgatccgtggggaaactgaggcctagagagggaatgaatcatgtctaaggttgtttagcaagctaaagcaggaccccagctcctgacacgccatcccaggaagtggttgcttcttcaaaggcaaatgtgttcccaccactccctttggaagagcagagactaagagtcacgggcccaaaagagcagggaccagcccagcagagcagaggccaggggttgctctccggccagagtaggcgagggatgggacacctatacccactgccccggtcccctaccaagcacccgatgcctgccccttgcccacagctgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaaggtgagttggtggctgtggcccagaccccaggctgtccaatgggagcagagccaacttctgcctgggtgggaagagaatttcctgagggcctgtggccaccgctctgtatcagccccgtgggcctttgcagcagcctctcaaggaaggggttacttccaccctctacagagaggaagcaggctgaaggaggttgagggacttgcctcaggcttccagagaattggtggtcagccaggatttgaacccaggcctgtctgaccccacgaccacctcctcagaaatggttagggtaatcaggacctggccttatcctctggacgcagacctctgagttccacgctcttttgccaccctggatccagagcagtccgagctgagtttcagaagcccctagtg

SEQ ID NO: 65845 - DNA, 1048 bp, Homo sapiens
tttcttcctcacgtgggcattctgttcttgttttctggcctggcccaggatggcggtcatccacactgcgtaccctctgagggcagggcctgtggctgttctcaattttcagtactatagtctagcttcagcctcaccagtgacctagtggcgtgacctgaggaagtcatttatcttctctgtcttcactgaacctcaactttcccatctgtgaaaaggggccagcaataggaataagaagctcacagggtacttgtgtgaactaaatggccaccgccccctttgagctcaggcaggggttgctaatggcatcaggcgccttgagccatgtccagagcacaagggctggcagtgaccttgagtttggcccccgtgggccaagccagtgcgatgacccaagcctctgaatggggcctggcatccgggggcttccatgagtgaccctgcatgtcttttttcttctccctgttggccctgccagctgtgggacttgctgtacaagctgcgtttcgtgctgacctacatcgcgccctggcagatcacctggggctcggctttccacgcttttgcccagccgtttgccgtgccacgtatccagcctgtgtttgggtgggggtgtgcagggagggctgtggcctggggcagtggggggtggtggggggctgggaggtcctgttgcccgccgcctccttgactgtggctcagactcggccatgctgttcgtccaggccctgctctcggggctcttctccacgcctctcaacccactgctaggcagtgccgtcttcatcatgtcctacgctcggcccctcaagttctgggagcgcgactacaagtgagtctcacaggaggcgggagcatgcccagcagggcaggaagggagaggtttggagcccaggctggaggccacccacagaggggcccacagcaggtatgggagggcttggtcacagtggggacacatgaggcggcagatccaatgcagggagagcctgcaccaggccaaggcttcaggctcacagcttggggatagtggggtctggggatg

SEQ ID NO: 65846 - DNA, 1738 bp, Homo sapiens
atttgtttgagcctcaatttctcatacaaacggggcatattctagggcagaggcaggcagatgctgcttgtgagtgctagccccagcacaggacttcctgctctgtaagtgggtgcttcctggcggctttgtcactcctccctggtctaggggaaggagccaacttgcttggttgctcttgagagctgagatggctctaggagcggggcatcccagaaagcggacttcagctcagtcttggggaggagcctctgaacctccatgctttctcctccagtggccagggccgggaccccggcctgacgcctgcccctcctctcccagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccaggtcaggctccactacctgaggctgccacctggggctgtgggacctgggcttccctgctccccttctccccatttggtttcctctcactctgagcctcccttagcctgagccccagcccccactccaaggtccctgtcccaggtctgagctgggctctgggatgggggtccttatgccacagcccgtggaccaggattggaactccccgctggtcacgctgtgttttggcctgtgtgtgctgggccgccgggccctggggacagcctctcacagcatgtctgcaaggtgagtgctcgggtgtcccgcggggcctactgccgtccccaccccacctcttccacgaagagcactgtggtctctggccacagtggccacagaaactgcagtggcccttcctgttggggtacctcttctcccacgggcagggcacttcctggtcatgaccttgcctgctcctcagtgctctgtgagagacatgggcagagattggcctctttgtcaagatggggaaactgaggctcagcgtgaggaaaggcctctgcttggatcactctgaagccttacccctgggtcctcgacacccctctctcccctccctgtttttcctcccacttagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggttggggaggggtgtgcccagcagcatgggcaggtgggggatgaagcctctctccagggcaggggccactgacccctgttcccgtcttctctaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggttgggccggccccacctgccctaagccctgccccaaacccccttgggccggccccctgaccctggcgtgtggctctcaggtgaaccggga

SEQ ID NO: 65847 - DNA, 1032 bp, Homo sapiens
gccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttggttggcagtttctttttctacctgggaatgggtacatgatagtacaggcggctaagttgggatggacaagcacgcagaggggtgaaggatgtggggctgaagtctagtagagatcaagggcagaccaaggtggggttcaggtagaaccg

SEQ ID NO: 65848 - DNA, 1036 bp, Homo sapiens
acccaggcccccagcctggtcctccaccacccgtgttggcttccggccccctccgagaccatcaaagctgcttccgctttccaggccacttccttgtctgcctagggctaaagtttccagccccctccccagcttagctgggcaaggctagaggctgggctgttgggtcttggtcctgagggtcctggagcctgggcagccctgggactgccagggtcccccagtcgccacccacacaccttagctttggcctgggcccagagtaagggtcccaccaggacctagcccaaccggacagatgacttgtattggctgggacgggaaacccaggggccactggtgtctgggtcctgcccacttaacaaagggaggacgtcctgtccccagagaccttcctccttgcccctcccacttccttcagggtccctggagagctgatcacccagagaggtctgatctcagtgccctggacctcaaggcctcaataccacaaggacacatgggttcccagggaggcagcggcagggcagcaggaatggcaagaggacttccttcagcacaggaagtagccccaactgtgggcccagccctctgccaggcccccacatcctgaggaaggtgctggggtcacagcagctgtcatgggaccccagtcaccctgccctgaaggacaggccaactcaccttcttgcaggctactgtgcccaggcttgggggcaagaggagtcacaatgacagggacccatagggacctctgcctacctggtctcactgatgcagacagggaggtctgaaccccatgtgacagatggtcagatgaggtccagaggagatgctcttgcctgaagcaattccgtgtcagagctaggatgtgagcctgggtctgcccatctccaggccctaagcagggctgcacctgcccactgctgtctgtgtgcgtaggttttggggggtgggtgttgggctgaggttcaaggtctcacaggatgcaagattgagacacccaaagccccagggacctgctaagtgcggaaac

SEQ ID NO: 65849 - DNA, 1048 bp, Homo sapiens
ctgaaggctattgcagttgcccaggctagacacagtggcagcgatagtggaggtgaagaggaggtgacagtccaggaaggactgggtagtcatgtggctgactggaaggggtgaagtgctaggatttcccagcttcttggcccccaggagtggtggtttaaggaggaggagcagggtgggggagtcacagcaaggtgagacattaggcagccggagaaaaaggcccggggtttggtaggccggtctgaatgggaggcggagatgggggtgtcatccttgctgcagccagggagggggaggagcatgggtggagaagaggcccaggcagaagagggcggggttcctggggccctaggcaaggtgagtttccagctatccccagtgccacctatggctgagagggtaccaggatgaggccacatctggggaccatatggggagtggggggtgcagggggttgggaggaatgaaatcgaagtggggactgtaagtgcagacaagtttagttgtagaaaagggaggtgaccgctggaggggagcctgtgctgtttggaggagttcagagcaccttgagctgggcatggttatccagttatccgcagagggaagagccgggaagagggcacagaaatgggagcatggggggcagaggtggtgcctggcctgcaggggctggggtgggggtgccttggattcaggggtgcagaggacagtccagccttgagataaggaggatgataatgtgtatgtttattggaagggtcctttctgtgaatcaccttctctactgccacatgggaaccagcctcctcccatcccttcctacctgtgcactcccaagcacgaggagcacaacagactgtactcacctgacaggcaagggcacaagtggctcagagagggctggtgctcagccccaggccagcgtcccatccattccctaagagctggtggggtggggctgcaggggactgagacctatgccttctgtctcccacccacagctgagcttccaacgcaaggtgggcatcctgtactgccgggcggg

SEQ ID NO: 65850 - DNA, 1032 bp, Homo sapiens
aaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctagagatccgctttttttcagcaaacactgagcacacattttgctagtcacatcaggccagacattggtggtagagagctgggtgaatgcgtgcactgtcctctgagagcttgcagtctgagaatgcccttggaaaccccgagttaccgtccagtggatgaaaacgggcagctaaggcaagagtcctagcacactgagagcctagtagagcccgctggctgtggggatggagcagtttcaggagtcttccaagaggccccattagctccaggtcttagatcagctgagagtggatgtcaaagagggactagccagcgtcagaggtaagagaaacgatgttcgaaagatgtgatggggccaaattccttgggtggcccagggagtgtgtgcttctcttggggaatgtgtggtgccaggtaaagatctacccggcccaccgatgctttgatactctgttctgggaggaacggtgaaatcttcaatc

SEQ ID NO: 65851 - DNA, 1050 bp, Homo sapiens
tgtgagcagtgcaggaaggtgtgagctggaggctggggccccccaggtctcctctttgcccagagcatggcccctgtactcggcctcaccatgtggtcttagaggggcagattcagccaacagaggcctccaaaagctgtgggattctcagaactgctgagtgtcacacatcccttctcattggcagagaaggttgggagaatgggtcttgggaaagcctggctcctccccttcctcctgagggacctttgagagcgtcggggacccacctgaggagagcaagtcccacttctcccccttactttcccagacgatcgtcaccggattgaggagaaacgtaaaaggacatatgagaccttcaagagcatcatgaagaagagtcctttcagcggtgagatggggactgggaaagccagagaggaaggcagcgggcagggaggggacaccctggggctgagaactgacctagcccttgccctacaggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcctgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgcagaatctctgctctcatctctcacttgaattgggggaacaaaaatcacctctaaattagcaagatgtgtgtgcctgtgcgaggctcaaaaactgacaagctctgcacttcaggccgctgctcacttggtgctccatgggctcattgcctctcaggacttagtttttcagctgtaaactgaggagtccagcttatctctccaagtgtcccttcctctaaaaggctggaagagtttcgtgggcttgagtagtcagggaggact

SEQ ID NO: 65852 - DNA, 1020 bp, Homo sapiens
tctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaaaagcaattcc

SEQ ID NO: 65853 - DNA, 1004 bp, Homo sapiens
ggagccgctggagcgggacttcgtgagcaaagggatagggttgaaagggggtgcgggcgggagctgtagtcccgatgctgagccaggccccttccccaggaccgcttcattggagccactgccaacttcagccgcttcaccctgtggggtctggagaccatccctggcccggatgccaaagtgcgtggggccttaacttggcccagccttgcggcagcggtgagtagacgaggagttccgtcttgcccccgggtggatgggctggggagcacaattgcgcagacggagcctggaggattctactgggtagtgtgtgggaagcgtagctccctgaccactcttcctagcatgtctagaagcggttattctgaacagctgggtccttcctcgggtatgggggccagcttgccgccctgtcttacaagtccaacagtagaggcgactcctgttgcagattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctgggcctgtggccagctgaccttggagttggtctgagcccggagctcgccttggtgctgggcaccagtgggcccctgccaggcctgtcctctcctttttgagctgtcctcagccccatctcccttagagtgctttgt

SEQ ID NO: 65854 - DNA, 1322 bp, Homo sapiens
tggcacacctggcagcacccaagttgggggtggccctgggcccctcgcttgccgcacctgcactggcctcttcactggtggccgagaaccagggctttgtggcagcactgatggtgcaggaggcaccggccctggtacggctgagcctggggtcccatcgggtcaagggcccactcccagtgttgaagctccagccggaggcgctggagcccatctactctctggagctgcgcttccgtgtggaaggacagctgtatgcacccctggaggctgtccatgtgccctgcctgtgtcctggccgccctgcccgccctctgctcctgcctctgcagccccgatgcccggcccccgcacggctggatgtccatgccctttacaccacatccactggtctcacgtgccatgcccacttgccacccctgttcgtgaactttgccgacctctttctgcctttcccgcagcctccagagggggccgggctgggcttctttgaggagctctgggattcctgcctgccagagggtgctgagagtcgtgtgtggtgtccacttgggccacagggcctggagggcttggtgtcccgccacctggagccttttgtggtggtggcccagcctcctaccagctactgtgtagcaatccacctgcccccggactcaaagctgctgctgcggctggaggcggccctggcagatggagtgcctgtggccctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagagctctggaggctgggaagtccatagtggagggcccagagcccagtgaggacccttctgcatcttcccatgacagaggacagagtgacaggagtgaggggagagagcgaacccactcccaagataacggcctgagtccacgcaggagggcagagccctcgtggcctgaccacctcttagggtctaatcttatactgttacagtggcaatcgcatttcaacgtgagcgtgggaggggacaaacattcaaaccatagcagggtcataggccccaagaaggcttccagacagaacccggcactgtaga

SEQ ID NO: 65855 - DNA, 1074 bp, Homo sapiens
tgtgtgtctgtgtatctgtgtgtgtttctatgtgtgtctgtgtgtgcgtgtgtctgtgtttgtctcgtgtgtctgtgtgtgtgtatgtgcccatgtgtctctgtgtgtatgtgtgtgtctgcgcaagtgagagaaaggagacttgagcaagggagtggggagcctctgtggcacctgtgtgcggactgatgaggatgccaagggaggcagggttttgcctttgtccttacagatggaaagggacccgtcactgtcactcttaccctccccaagaccaactcaggctgtcttgatgggggtaggtgggtagggggtgggaggtgagggcggggaggagggcaggatgttagggattgagcagaggctggcatcctcttctcctttcccaaggcgagagaatcctgttcagccctaatggcttcacttgtgttctgagttcatgtaatgataagaccatttcttccttttgacttccttcagcaaagagttgtcgagcatccacgttgtgccaaggatggttagagcatggagaggtgcacccttttgggagatggaggcatatgcatagtgggccgtggctgaggatgaggatggagcagctgtggtccacctttgaggcccatctccctcaagcagctaccaagcagtgtaggtcagagtagagatactaaggcaggaggaaagaggctggggactaggggacctgctgcaccagttagccagactgcatgtgtttggggtctggggcaaggggagagcctgccttgggagtgtcagagaagccaagaaatgaggagcggggttcaagtggtttagaggggcaagaggggctgagagacacaaagcatggaacagaatggtctgcttcaatgtttatctatgtatgttcatcttcatggttaaaggagttaacatatataaaatgcttagggcatatacatgaaatggttagagtggtgcctagcatattgtaagggccaacataagggttagctattatattattattattgttatattatttttgctgtatgttctgaggatgtgctgagctattgaacagatggatgcacc

SEQ ID NO: 65856 - DNA, 1135 bp, Homo sapiens
tgctccagccactgcctccctcccctgctttgcccaagtgccctccctgaactaaagtttccctgaacacatagccgggcttgcacagctgccaagccctcagcgccctctgtccagctcttactcagtccccgagatccagactagatcccacttcctctgtgaagccttccctggcctgcacccctcaacaccagacctgacctggaacagttacctaaggcttctttgctggatatttagatgaagaggtgcctcccaccccttagctgcccctctgacaagctcccttcccagtgcccacctttctgatgcagaagctggagggccgggtggcttccgatgaggacctgaagctgtcagacatgctgaggtactacatgcgtgactcacaggcagccaaggtgagaggcagccccagcgcagcgctcaggcccggatgccaggacagggcagcagtgaccctgtgcccatggtcctaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaaggtgagcccgcagcccccagccccagcctggggccacatgccctgccctgcccggatccccatgcctcttcccctcctctccagagctcatggacttcaagtcccgccgggtctcctcttttcgaaagaatctcattgagctggcagagctggagctcaaacacgccaaggtgagccctcccacctcactgggcccttgtgaagcctcccacctcccacctccctccctcccccaggcaccagggtgtgcgtgcatgtgagggtgtgcacgcatgtatgcgcgtgtgtgtgcatgagaggagccccagctaaggcttggggccatgcttccctggctcaggacccgtgccttctgggtaggaaggcccaattaacagcagctgttattgcagagagcaggggtgtggggagcgagggagcatctaaggtgcagaaagaatggcagcctgactcagggagcaggggacttcaaggacctgtttctcctctgcagg

SEQ ID NO: 65857 - DNA, 4533 bp, Homo sapiens
ccaggctaatcaatagttgcttcgattcagaaatgcaaaaccctaacctcactcaaaaatttcaggccaagggatccagataataccagatgggtcttaagaaagccgttttgctgtgggataaagagccgcttagtcggggatcgttttcgggtcattttactgagcgccgcctcgccgggctcagagcggttcctgggaaattggaccaatgggctcgcgctgcgcgctgcggtgccgcccaggacctgggcctacatttccctacatgcactgcagctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggtgagcggcaggccacggcgcctgagggaggcggctgcgggtcggtcgcctgcgcgcgggaagcgactggggagcgacgtccgcaccccctcccccagcgccccgggcgggatgagggtctcgcacgaaggggcgggcggtgccggaatgcgcgtgcgcgcccgtgggcgccggggagggccggtctggacgtcgctcgcgctccgcctgggctcccctcccccacccgctggtgcgcccgcgcggacaccggccgcggggggaggggttcggggcgcgcgctggggcgcccctcgcggaacggccggcgtcgcgcctttcttcttaggggcgcgctctcgactggagcatgcggcgtccaaacccggcccgggggcggcgaggaaaaagcgcgcgagaggtctcggcgcgcgcgccccacccaaggctgttcctgtctgcgcgtcaccctccctcggcagccgggtccgtctcgggagcaggtggcagggatgcctgcgcccgggaggggcgggtgctggcgcggcgaggggtgatgctgggaagacggggtcccggttggggcgtgggtgcctgcgattaaggccttgcaccgcaaggcttggagggggcatcgcagagaccgcggcccgttcgggagcgcatctaacgagctgcgttctcacccgtgcatcgggcgagggctggaacggcgctgtctgtcggcgcgtgcgcgcacgctcaggcccggccgccggtgccgaagccctgggccagcgaggccttcccggatgggcctgagtgagggtggagccgagtttagggaagtgacccaggcgggcaccgcccggaaaccaccccgccccctgtatacggcccgagggctgagaaaaccgaaggttatgtagcttgcccaggctcctgcctgcaggagatgggtctgatacacccgttgttttagggcgattccacagggttagggacctggagatgctgctgcctctcggatacgcgtttctgcattggtgagggggccgggcccagccgatctcctgtccccgcccactccggatgcggccgagtcacgtggccggcttcttctgcagttccggggagtttgggggaccagatttaccttggattgcccctccctctcctggctcgggcaccccgaagcacgacgcagagtaggaagagtttaaagacctcgaggcctctgggcacttgagtttggcatgttaatttttatcagcgacttctggggcctagcaccattcccggaagaagggagttgtcgggcagggtccttaatgggggttgcaattcttgtcttggttgggaaagagcctagctgggaacaggggtcgtttgtgtagtaactgtattaagcagttctggtgggtttgttgtaactgttcggtgtccttggggtcccatctagcattgtggggtcttggctctttctgaagaggagtcttggctcaggtgtttgggtcctccatatccgaagttctaaatcaccagttttatccaaaggctgagagcaagtactgtgagtagcaaatgagtcagtagccggtggatcttttaattctgggttcacattttggtcaaggttctgcttttcacgagttttgcatttctatcctgtaaaatgagggaaggggttgttgaactaggtgatcagaggccatggctgccattctgaggttgtgtcccatctggttctttgacagtgacttgggtgggaaaactagtgacttgccttgggaagggcactagtgaccactcgggacgtggactgagatcttctgaaaaaacaaggggcagttccctagaatccttttcttgacgtatacgtggcatgtctcctaggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctggtgagctcattctggcacttcttcctgtcacctgccccctttctcatgatgggaacttctgtggctcctggtcaacccagatgtgtgggtttggagggggagggggttgtaacaaaagactcctcactgccagcccaagggtttctcaaagtcacctgtggctttgctgttgctgggagttgcctgacgcgtgtttctgtccagggcccccgagtctgcgccccttaagagcaaaatgatttatgccagctccaaggacgccatcaagaagaagctgacaggtaagggccagcattggtgctgagtgcccttctgctctggccttggctgcagggcagggtgaatggcacgcagagggggtctgcccccttgtcttcgctgcctgcttgttccttccatctgctttgattggctccttcccagccacagaaactacccccaccccagtgcttcctgctcacagatgctcccctttcttctttatagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatgggatgtgtttttcaaggttgggacacaggagacttcaggattgggggtgcactgggataatggtgctatctctctcctctgtactccacacccaaccagcccctgcacacccttatctggctccaatgactggctgagacgcctttctgatggtcaccattattctgttggtgctgtgattgacactggactggctgtttaaggagtgggtgctggctacaggggtcttccagcggaagtgatttatgcctgaactgggtgctctgtagccttgcctggatggacagtgaggtccatctgatattctgttctgtccctttctaggtgtgggctgataggcaagtcagaggtagctcaaaggttctgtttggtctgctgtcttccctggatggctgactcaagtttatgagggtcaggttcagtggctgctgtgagtcaggccaagttgagcctttgacctcctctagatgtggctggagtgcattcagggtggggccagccaggtggagcccgggacttcagaccccggtgtcttgagcactgcctccctgtgtttaaccaaaagggtgttgccggtaccctgagccttttgccagcattgtcaagggctgtttccagcctgtactttgggctttttcctgcccagcaggcaaagacatacaagaaatctggccctagggtgaggtgaactgggagtggtaatgtggcat

SEQ ID NO: 65858 - DNA, 1033 bp, Homo sapiens
cgggatgccctagatgtccttattaggacaagagactcgagggggcggggccagcccgacagccggcttgaggctccttataaggccgcggcgggcgggaggcgggagccggagcccattggtccaatttagcttggctggggctactgcgccgtgggctaggcacagtcctgaggggcgggactggagctctggcgcccacctctcccttcctcgcaggctggagacctgcgtgttgcgacttccggcatagcagctagaggccgggtgctgcttcaaaccctggcgggtcgcctgtgtccaactcagctatacgtgtctttcaggcttctcaggttgaagccctttgtagggtttccatcttcaacctccctgagggtctcccacttccgattagccacaaaaatgacgaagtgttctcccctctacctgtgtctgggcttcttaacccgcagcctgctcctccgctcccaaacccaaccgcgtgcccatctcaggcctccccaactgccaggatgcccaagcacctcttacttacagtcctccttcctctaggcctctgacccccgacattccgagttctattttgggccttctcggcacgtccccgacttcctctccaccacacactctttgccctgtatcccggggatgaggatcaccatttcctccaagggtcctgcagctcctcctgccttacctttgtgtcctcatccccggcacccatttctgggtgtccctcccaccaatacgtttgcacccgtttgtctcctagcccccgcctctcctggactcttttcaagaccagtctccatctccagcctccttcaagcttgaggctgaagctgacaatcttaagagaccttagagccgccaagctcaggttagtccgttaagcgccgcccagccagtcctccccgtcacagggggcgctgtccgccttcctctcgcctacacaaagaccccgctctcgaatctggggtgacaggaaggagccggtccaggctccgggggctgggaaagggcgcgtctc

SEQ ID NO: 65859 - DNA, 1039 bp, Homo sapiens
agggctggatcagtgggggtctgggccaggccatgtctgagaagctaggcagagacagtaccttattcttgatggctcctgcgttgaagtcactgaaggtgaggagtgagcagagagggtttggagaggtcatggcccctgattcagggttcccaggggttccccaggggcggctgcgtagggtgtggccctgagggaagaagggactgaggccaggctggagctcgaaggaacaactccagccagcccctgcccagtcctcagccttggggggccagcctgagaaatggggatctcacccaccttgcttcttttggggatgcacagggcccaggcaaggtgaattccttgtgggctctgtcccgacactgggaaaggggcctctgctcacctggtagagtctctgcaggccccgcgtcaagagggccaggtaggcggctgactccttaatgtctgctgtgcgcttcacaaaaaagccatcaatgacctggggaagaggacccaagagagggaaggtggctcctggcctagaccatgaaccatggaccacaggggcccctgcctgcctgcctggccctgccctcccagctcacctgagtgttggtgacagcctgcagcagtgtgctctcaggaaggctgaggttgtggacggaaccatgctcttccaccaggtatacccggcgctccagaccacagcgcttcagccggaactagggaagtgtacagagtggacagggagggtcaggctggatgaccacatgcctgggcatccatgatgtcacactcaaaatggtgccgggaccctgttcccaccagttagcctctgcatcctccctagcctctccacctgcctcacaggggcctccgcagctttgctcatgctgacactcttgtctagaaagccttttctccatctctcaacactgcccatccttcaagcctcccctgggccggcacatggcctctgtgactaggggtccacccagcagcaagtaccaaggtacagcctctgtatttccactcctggaggtttatgcct

SEQ ID NO: 65860 - DNA, 1050 bp, Homo sapiens
caaatctctgggccggggcctggagtccgccctcctcgttacctcctctcctctcggggtgactgaagctcgtggtgcagagctcccagctcctgtcaatgggggcccctgggcctgaacatatagagacccccatttaggtgaacttggcctgcccccccaagtgccaccctgccccagcctgaggcttcctgcagtgtgacccgcccacctcagccaccaggactttctttctccctttattgcctttctcattctgcccctcacaacaggctcctcagctagggtagctgcagggagggtggctccctcctgctcctcagaaggtgtaggcccctacaaagacggtgagcctcagtacagagctggcccggtagctcatgagggaattcatggtgaccatctccaggtccagcacgtactcccgggggcccgtcaccggccgggcgaggaccagcatggcgctgacgttgttgatttgctgcagggcagtgggtggggggacatatatattgtgtcagcctgtgtgctaggcccctgccccagcgtcacctccctgccccgtggccgtgaggcagaggaacagccctggccaggctgccaccccagcctctcatgcagctctttgacaccctcgatgtctctcctccccacccaggctcctgccctcagaaatctcctgctggggctcttctcaccctctccagcctgctctgtctgacccaggctaactgacgattcaaggccacatgtggctcttgggactggtgggacctttggtgacccaaagtgagcagactcccttcagagcattcaatttcaaaaagaaagagaagggctggtactagacaaaccccttctcctgctgagacccatgcatgcggctgccagtcactgtgagcagctcactgtgagccgcccctggccccctcccacctaacagatccactagcaaggagtggactttctgaccccagggccctgcacacgccattcccttggtttgtgggtgaagaaactgagatcaatatggaaaaccagtaccaggac

SEQ ID NO: 65861 - DNA, 1050 bp, Homo sapiens
ccagcgccatctcacccatcaaggaccaggtatctgccgctacccagctggctctaattcagctaagtggtgggagggagaggggcacggcccgaacacctagccccgccccaccctctcgccctccagaaaaactgcaactgctgctgggccatggcagcggcaggcaacatagagaccctgtggcgcatcagtttctgggattttgtggatgtctccgtgcagggtagggttgggagagggtgcgcgtgtgacaggggagggaggcctaggggcctggtcacccacactgtcccttcttgcaccagaactgctggactgtggccgctgtggggatggctgccacggtggcttcgtctgggacgcgttcataactgtcctcaacaacagtgagtgcactgccccgccactctggacatctgcagggggacagggtgggcaggagcggaacctcctcccttgtcttgcttatctgcaggcggcctggccagtgaaaaggactacccgttccagggcaaagtcagagcccacaggtgccaccccaagaagtaccagaaggtggcctggatccaggacttcatcatgctgcagaacaacgagcacagtgcgggcagggcagggacacgggcggatggcagggacagacaccggggcagaggcagacacgctgggctactgggctagaagacaagagggggtggggggagcgaaggagcgagagacccacacacccacatgccaagggtctgatgatgttcctgtccccaggaattgcgcagtacctggccacttatggccccatcaccgtgaccatcaacatgaagccccttcaggtgagatgggggagctgatggggaaggggcatacaggagacttggccccacactcagcccctcggcccccaccccctgcagctataccggaaaggtgtgatcaaggccacacccaccacctgtgacccccagcttgtggaccactctgtcctgctggtgggttttggcagcgtcaagtcagaggaggggatatgggcagagacagtctcatcgcagt

SEQ ID NO: 65862 - DNA, 1174 bp, Homo sapiens
actgctctccggggaaagctgggcgtcttctctgagatggaagccaacttcaaggtctgtggtcccatccagcctctgacccttggcatcttcagcctccagttcgccacccctaccgggcagctctgcccctgccagggattggccggcaggtggcactgctgctccctctggtggccgctgacgggagcagctcataaacaatggggacttggttgatggagggaggtggatggatctggggaggggcctgctcctcctcccccagcttctgtgctcagctgccaacttctggggcagaaagcagagctccaaggatccctgccccacagaacctgtcccgggggctggtgaacgtggccgccaagctgacccacaataaagatgtcagagacctgtttgtggacctcgtggagaaggtgagctgtcgtgctctctgacacccaacctggtctgtccctggcctatacaagtgctaagtattctcttgggcccgcagtttgtggaaccctgccgctccgaccactggccactcagcgacgtgcggttcttcctgaatcagtattcagcgtctgtccactccctcgatggcttccggtgagcagccctgtcctcctgtccagcttggctttgccccagcctgccacctgccaggacctcgcctcctgcagactcaaggttccccattctgctaccctgggggtgggaccaaagtctctggaccaaagctctggctctccctcttagaagctgtgtgatttggggcaggtttcttaacctctccatgcctcagtttcctcatgtacaaactagggttcatcatgagaagaattgtaaggattttctaagggcaaaatgaatgaaggtgtagaaagcacgcagggcagggcctccatcacggtgagtgttgtgaaaactcagctgtcactgttcatgttcttacagacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctcc

SEQ ID NO: 65863 - DNA, 1009 bp, Homo sapiens
tcttccaactcaaacttgtgaagatctggagagcatggtgctaaaatggggttggatttagagataagattgagtaaacatttatccaaggcaagatacagcaggagttgctaagcatttgatttgataacaagtactaataactaatagttggttgaaggaataacaaatgctaaatcagcatctgctgactggataggtggatggggaagggagagatgttcaataagtggtttattgggtgagcgacacagtgtacactctgaccagtcctctcttctaccctaactgccctgcagtttgacaactttaaacgggtcttcaaggtggtagaggaaatgcggggctccctggtggacaatattcagcaacacttcctcctctctgaccggttggccaggtgaggagctagccacctccccatcccgcacactacttcctgggcccggaggctcgtccaccttccctaccccaaaccttctgacctcctgagtatgctgggggaatgattatcccacttttggtctgtactttttttttttttttttttttaatgagacggagtttcactcttgttgcccaggctggaatgcaatggtgcaatcttggctcactgcaacctctgcctcctggttcaagcaattctgcctcagcctcccgagtagctgggattacaggcttgagccaccgcacccagcttggtctgtactttggaccagactgacctggattcaaagcacagtccagcgatttccagctgggctgttgagaggtaccatatgtaaagcccatggcacagccctggcacttaggaagtgctcagtagatagtaactgttacccttatggtctcccactgtatccactagtaaacttgagctggaaccttctcttcgcacagatggggaagggtcatagagaagtgacttgagacacgtcacacagtgacttgaggcagagagaggccagaactcggacacccagctgaggttgcaggtgggagctgcttc

SEQ ID NO: 65864 - DNA, 1050 bp, Homo sapiens
aggcctccccctctcttccctcgccgctcccgccccgtcccctccccgactggctgtgtcccggaagtggtcataagctgggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcgggtccgtgaggggcgtgtggggaagccagtcggcggagcggttgtgttgaatgggagagggggcggggctaagacttgggcatcctttagggaagtgggcgagcgcctgggaataagaggtgttataggggtctgggatggaaacccttaagggcctctggcgtcggcggggcggggcctgatgctagcgtccgctttccagtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtgctcaccctctgggatggtggagacatcaaccagtctgactgtatacccattttgccggctgaaacaggcccagggagggatgggatttacccagccatcagaaagttgagagtggaaggggtcagacctaggccctgctaggccccgccagactccctttcctgtcttttatggagggtcaatggtgttctctgactccacaaggtactatgcctttgatgaggcctttgttcgggaggtgctgggcaagaagctgtccaaaggcaccaagaaagacctggatgacatcagcaccaaaacaggcatcaccctcaagagctgccggagacaggtatgcactgcatccacacggacacagcatcccatcta

SEQ ID NO: 65865 - DNA, 1053 bp, Homo sapiens
ttgtcagttccctctactttgagccttctgttagcttccagtgagacagcgtggcttggtgattagttttgggggttttattttattttgttttttcggtagagacagggtctctctatgttgcccaacctagtcttgaactcctggcctcaagtgatcctcctgcctaggtctctcaaagtgctgggattacaggcatgagctactgcacctggccctggtttggtggttaggatctgactttagagttgtatagacctggggccaaggccagtcctgtgtcattactcactacttgtgtgatcttgggcaagtgactacccttctgtgccttcatttctttggtggaagatggggaaaaccagagtacattccccagagagattttgtgaggattaaatgagacagggaaactgagactgagggagtagctgaagggaaccctcttgttcctgttctctcccagacaacataagcgccccctctatgcatgtcagcaggtggagaccccctcaccattccgtgtgcgcaccttacatgttcttgcctccgcctccatccttgctcctgccacccccgctacctggaatgtcctttccttcctctctgcctctgccagtcctacccatccttctaggctaatatgccaccttttccaggaagctttccctgatctggaagtgactgttgtaccctctgggcctcccgtggggctcctatcactttcagccttgggcagtagtcacctgtagcctaccttaccccctcctaagcctgtgctctcctttctggcaggagcttctctgcaccctagcactcctgggcggggtcggaaccactgcaatgcctctgtgccttacctgttcacaaggccttcgacgtacccctggaggcggccccagggcccggatgactcctggccggggttgtggggggctgtactgagggtaggtcagaggcctggggtaactgctgggccccaggaaatgaggctgtaccatccactgcagctcctgactgccactcatggtgttgatgcttggcaccaggtgg

SEQ ID NO: 65866 - DNA, 1650 bp, Homo sapiens
gcgatggccccgcccccgagtcagcacctccccgtcggccccgccccttcccctgccggccccgccccacagcgcggccgctgcggccgctgaggcccgcggctccgccctgtggctgcgcctgtctataaagttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggtgactgcgggcggcgggaggggcagggcagggccggggcgggagcacagctcgggcccgtgggcgttaatggcggcgggcgcggcacggccggagcctggctctcctgcaggctctaacaagccctggttcgagtctgggaaccgccccattggcctcggaacggcctgtaacctctctggacttcagcgtcctcgtctgtaagtgggcccgataacgcctgcctgggaggcctggccttacagagccggcctcgggagctgcgcgaacgtgcgcttctttgcgttcctctattaaatgccagcgcaccggatacctgccaggaaaagggggccttggcagggccgggaggtgtagctggggctggttgctcccacgcctggattcacccttcggccctgccacgcactgcaggtgtgaccttgggcaagtcctttttctcagcctcagtttccttttctgtaagtcaaggagaatagtaataactgcagcaacccttctggagcgctgactcctcaggcatctaattttcatagcagatctacgggacaggaacagttgttatcccattgtaaagatgaggcaactgaggcgcatcgacagtaactcttactcaaggccacagtttaatccagtgcctggcatctgtagttattgtctcagaccctgccctgactcggttccctcacagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactc

SEQ ID NO: 65867 - DNA, 1050 bp, Homo sapiens
cacccaagcggtccgtgaagtcgtccgtgtaaacacagatgacctggcgcccaccctccttggcacgtgggctcaccttggccacctgaagctggccttcaaccacggcccgggcaatgccagcccaggcgtggtccagcttgaagcccggtgccagatgcataagccacttgcccgagagcacgtggtgggtgatggcgagctggcgcagggtacccggtgtgatgggccgcccactggtctgcagagcttcccaggctgcctgcaggccctgcacgtccccggagttggggctgtagccctgcccatacactgcaatccagcccacaggctctgagttgggtgaaccggggtccccatagcgggtaacttgggatggtgggtacttggccagccaggcatccagctcagtggcaggcgttgtgcgggcatcaaacactagccaggggtccatgtcagctgccatggcctctgcagccaggtgctcggcggtgaagccatcctcacggccacctggagagccctcctcttccagctcctcacctggttccatcctgctgtgagggaaccgagtcagggcagggtctgagacaataactacagatgccaggcactggattaaactgtggccttgagtaagagttactgtcgatgcgcctcagttgcctcatctttacaatgggataacaactgttcctgtcccgtagatctgctatgaaaattagatgcctgaggagtcagcgctccagaagggttgctgcagttattactattctccttgacttacagaaaaggaaactgaggctgagaaaaaggacttgcccaaggtcacacctgcagtgcgtggcagggccgaagggtgaatccaggcgtgggagcaaccagccccagctacacctcccggccctgccaaggcccccttttcctggcaggtatccggtgcgctggcatttaatagaggaacgcaaagaagcgcacgttcgcgcagctcccgaggccggctctgtaaggccaggcctcccaggcaggcgttatcgggcccacttacag

SEQ ID NO: 65868 - DNA, 1097 bp, Homo sapiens
cgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggtgagcacgtggcagagcccggcaggagtgggcccggctcccgggtggcttgggcccagttcccgctgggcaggcgggcgcgccgcggtgttcgggggcctggacgccccgccccctccatgccctccccgcgtccgtgtcccccgccccctttctccggggatgccccttcctcccccagcacccccttaggggacggtggcgacggggtctgaactctgctcccccacccgcaggcgcggatcaagaagatcatgcagacggacgaagagattgggaaggtggcggcggcggtgcctgtcatcatctgtatcctgccgggggcggaccgggtcgaggggcgtgggggagggaggcagcgggtcgccctctcctgccccggagttctccttgacgctcctcagcccgggcgctcgagctcttcctagagtcgctgttgaagaaggcctgccaggtgacccagtcgcggaacgcgaagaccatgaccacatcccacctgtgagcggcgaggagccgggaggggccggcgggtttggcgcggggagttcacacactgaggaaggcagagcctgggtggcgagggaggtgggcggcagccgggacaccagcaaggccacagactggcagaggagaggctgggcttccaggcagagggagccacctgagtaaagcagggcaggcccgggagcggagatcggcccgggctccagcctgacatctggggccccttgctgccacccactgcgggtttgggtgtctgggcccctcttgagtgccagcccctcctcacctcttccaggaagcagtgcatcgagctggagcagcagtttgacttcttgaag

SEQ ID NO: 65869 - DNA, 1034 bp, Homo sapiens
gacatgcagggggacggggaagacaaccacatggatggggacaagggcgcccgcaggtggggccagggcctggcatacagtggggaaggccaaggccacagggcttgggggtggccaaggagtagggagcactccgggcagatggactgtaccttcccaaaggggccggaagccaggcagcggcggccggaagaacggtgggatgggaacgaaaagcaaggacaagaagctgtccgggacagactcggagcaggaggtgagtgaggccccagcccttcgccctgcccttggtgatgggacaggcagcctcgccccaggctgaactggcaggaggccagctctcatccttttctgcaacctgtttgctcactggtttatttgtaaattggggctatgagggtctactgctgtccctgccactcccagtgatgggttcgtgtcttttcttgtcaactctgacctctgcggtgctcacaggatgaatctgaggacacagatactgatggggaagaggagacatcacaacccccaccccaggccagccacccctctgcccactttcagaggtgagcagcccagaggcatgggagggtgctggcagactccccagagccaacttacccctcttgttctccctggccccttggtcttgttgattgtggcagatttgtggggtggaaggagaataactgaggagggcttgaaggcaggagactgttctcccgaaagatcctgctccaccctgccagggcccgtgggtggggcctgggcctgccctgcgtgagctgccctgggccttggccgcatggatctggagggtggtggtgggagggtcagatgggggagggagggtcttggcagctgcccctgtggagggcacggtggggctcaggcctgactctctcctgccttctgccctgcagccccccgacacccttcctgcccttcgcctctactctgcctttgcccccagcgcccccgggcccctcagcacctgatgaagaggacgaagaagattacgactcctagcgcct

SEQ ID NO: 65870 - DNA, 1080 bp, Homo sapiens
aaggcaaggccagggttgtcattcctacttctcaatgaggaaactaaggacctgaggggaagggccttctttaaggacgcaggagcgaacaagcagcagaaccagtctgggactctgcaaccatctgagcggccacacaccaagtccctcattaggggctggcaccaccacgctggtcaccccatgccttagaataacctggtacagagcagcgattatgaagcccacttgacaataaggaaagtgagactcgagaagagtcactttgcccaggatcacacagcaagccggcactgaagcagggtttgaagccacattgtcagtggtttccttgggcatgggggtgggagctgcagagtcaggggcctctatctgtgtcttgaaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggcaaacacagtatgagatttctggtggtgggggtggtggaagctacgggttggaagttggaggtggcaggtgggtgggcagcaggcttagctctgtccccgcaccccctccccaccaggagctttggctcttttggttccccccacccagtacacacagccccttctctgctcctgaggagtggggacatctcaaagagcaagagctgtgacttctccaccccatctccaatgtatatgttgggtcctataaattcaagcatgaataagatgaaatgactcctgcctctgaggacgcccagtgagtgggagagggggtggatccttaaaggggcgcatacaacatagcctaacacatgctgagttgtgccacacagggagccacagactgagcaaccactgggtgaggggaggggtttcaggagagattgggattgtgtgcactgcgctttttttttttttttttaagacagagtctcgctctgtcaccaggccggagtgcaatggtgtgatctcaactcactgcaacctctgcctcccaggttcaagcg

SEQ ID NO: 65871 - DNA, 1199 bp, Homo sapiens
aggcagagccctccgagcggcgcgtgaagcgggagaagcgcgatgacggctacgaggccggtgaggaggcggggcctgcgcagggggcgggtcgggcgggggtcccggaacgcgtgggtctgggtgtgcgcgcagtgtcagcgaagctcttcaggccaggaaacccccaagctgtttaccagctctattaaatagtctttctacgggatcccttgagcccaggagttagaggctgcagtgagctgcggtcccgccagtgtactccagcctgggcaacaaagcgagactctgtctcaaaaagaaaaaagtctttctacggttgtttaggattagaggttgactttctccactcagctgcttgaggacagagggcttctgttttcctcagttgtctggtacaatcagattctcaataaatatgttgaatgagtgaatgaagtagtgtcagcatatacagaggcaagaaaaacctggtattggacgaatcgtgtagggcgcatggtagagaaatgagggagtaagatagacagggatgtgaacacaaaggaccctgtactgtagtctctgttaagaactgtagattgtcttgaggatagtagggagccatggatgtgagttgaggagtgagttgctcagatccgtattttgtaaacatcactggattgagaatttagtcaaaggtagtcaggactggagaccaggaaaccaggagggctataggccaggggagggctgatggtggcctgcaccaaggcagcagcagtgggattgagagaagtggacaggttggagaggtgttttggaggaggaatgaacagaactcagcacttgtatgagggtgggaagaaggaatggaggatgactccttgaattttggcttgagcagccagataggtagtgggtgtcatttctactgaaattgaggagtagggaagagaagcagatttggagcgggggtggggggagatagttcacttttggggttgtcaaggttgatggtaatggggaaatccagagtttggactggataaagccattgggagtcagtatctgggtggccagtgaagcccctgaaagactgtgacatgagaagagggggtcaggactagaacctgagaaatgcccttatgttagtagtaggcagagaaagatgttaccaaaaaaaggagacagagtaaccaaaaaggcaggaaaacctt

SEQ ID NO: 65872 - DNA, 2647 bp, Homo sapiens
tcagcagctttcctgcaaggcctgccctttttgcactccgcttggtagagccctgagtgttttctggtgatgctgagtggcctgaagtcctaggtcacccctccctgtcccgtaggccaagttactggaggagatggaccaagagtttggtgtcagcactctggtggaggaggagttcgggcagaggcggcaggtgaggctgcagcaggggtggtacaggggacactggtggccttgctaccggaatcccgaggttgggtgcgtggagggaggttcctgactcgccgattcttcccttaggacctgtacagtgcccgggacctgcagggcctcaccgtggagcatgccattgattccttccgagaaggggagacaatgattcttaccctcaaggacaaaggtaatgcgagctgggtgccctgggtgggggcacagcctctgctgagttgcggacaagtgtgaatggccactgctctgtgctgcccccaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcaggcacggcctgggcaggctgggtggcgggggctgaggtggagaatgtcgggaatgggggctctgaggaggtggtggctcagtggcttttcaggagccagcctgggtcccaacctgtacctcttgccttgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgagccctcccgtgccttatactcggggtcaagattctccctccctctggggctcctgccctgcccgcaggcactgagaagacagggcgagtatttgtgttcacaaagcgcttggcctcgcgggtgagcactaaatggcaaccgggggaggcaccaggtgtggatgggtcagggctgctgagccagatgggccccagtctgtttcggctctgccatgctgccagctcgtgccttggataaaccatttaactgtgagcctggggcaccccatctggaatggcagtgacaggagccgcctcctgaggttgctgtgaggatgagtgacagcgtgggtgaggggtgactggagaggtgtgcgtggattctgtccacagggtgactgtgtgaacgtgaggtagacagctggcgcggtaggcgtcttcctcagtgggtaagagcaggactctggagccagactgcccagctctcccacctaggagctgggcaaccttggggaaggtacttaacctccctgtgccccagtttccctagctcaccagtggaattgagatagtaaccaccccacatgttgctcatgtgtgggaagcgctcaggacgctggctagcacagaggaacaccaaagaagtgttcaccctcgagggcttgtggcgacctgcctttctgtggcccccgctccatgtctcgcccctcttcccttaaggtgacctttaaaaagaccaagcggagggtgaagaaaatccgcaagaaggagaaggaggtagtagtgcgggcagatgacttgctgcctctcggggaccagactcaggatggggactttggttccaggtgggcttggacacggtggtggggcgagatggctgggctggggtggcctggggaccggtgctcaccagagaggcctccttccctcagactgcggggacggggtcgccgccgagtgtccgaagtggaggaggagaaggagcctgtgcctcagcccctgccgtcggacgacacccgagtggagaacatggacatcagtgatgagggtgagggcccggccagggggtgggaggggcagggacaggagccgcgggttggaggagatggtctgagcaggcatcccctgtgtttcccccagaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtgaggctgggcatgggcagggtgactgcgtcagcagtcacctgtcctcacgagcacctgtgtcataggcgacagccacattcctgtctgaagcctcttttccatttgttttttgttttctgggtttgttttttttttttttttttgagacagagtttcgctctttcgcccaggctggaatgcagtggcgcagcctcagctcactgcaacctccgcctcccaggctcaagtgattcttattcctcagcctcctgagtagctgggattacaggcgcacgccaccagacccggctaatttttatatttttagtagagacggggtttcactatgttggccaggctggtctccaactcctgacctcatgatctgcctgcctctgcctccgaaaatgctaaaattacaggtgtgtgc

SEQ ID NO: 65873 - DNA, 1032 bp, Homo sapiens
ctcaccaccctgcgggttctagaagtgctgtctagagtcctgaaaccggagtttgtcgggggaggggcaggtggcaggagggagcctggaggaaggagtttgaggctgaggtagtgtgtgaggggctttggagggggattggcacaggcctggtcaggaaggccctgtaggatgttgggtattcattcaaagggcatccaaacccattgatgggtttggagcagaagagtgaccccagtgaaagaggtgcagagtggagttaggcggcagatagcagctgggcctgcatgggctgtgggcgtggcctgtctggctgctgccagggaggacccttaggttcctgggtctcaatggcatcaccccagaaactgctgggtttgcccacagccgctccctcccccaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggtgcgtctggggcggccccgccctctgcttccctcggctgggtgggctggctggggcctgggccgaccctggtcttttgtgccccaggactttgaacgggatgaggagcgctcagccaacggtggctccgaatctgacggggaggagaacatcggctggagcacggtgaacctggacgaggagaagcagcagcaggatgtgagggccgcgccgctggggggtgggcgtttgggggtgctcaagctggagatgagcaccgggctcggtgtccagagcctcagcctcctcatccagagtgggctctgcagacctcccagggcgatctgaggagtaaatgaggaaattaaatgttgtggagggctggtgcctggcaggtggtgaccagtgggtggggctgagaagagccggtatggcctgctaaccacccccgccacgtgtcccgtagttctctgctt

SEQ ID NO: 65874 - DNA, 1156 bp, Homo sapiens
ccactccttcccctccactgtggcatctgtccgtctgctctgcctttgaggctccacacctgcttggggaaggagaggggagttgaaactgttccagctgtggcacagagagccctggtgttaggaccccagctctgccatttccctggccagtgacccttggcaaggggctcatttctgcatctttgctttgcctgtagaacaggcctgatggctttccagaggcaaggaaagggaggtgcccccacagggcctgctctgccttctcaggcggccctggagctgtggctctcgaggggttgggagtctcacaacccctccatccctagggctgctggagaccacagtgcagaaggtggcccgggtgaaggcccccaacaagtcgctgccctcagccgtgtactgcatcgaggataagatgtgagtgtggtggggcctgtgcagggctgaggggcctgtgccagcttggagcttcgggaccacagcaggcggcagctcctcacactaaggcctcctctgtctcgggccagggccatcgatgacaagtacagccggagggaggaataccgaggcttcacacaggacttcaaggagaaggacggctacaaacccgacgttaagatcgaatacgtggatgagacgggccggaaactcacacccaaggaggtgagcagggccttttgcaggcggaggcccggcctgccacagggaggccaagcccagggccatgcaatgccccgggccatgcaatgccccagggtcctggctccaccagcctctggctgggggcctggtgaatgccacggatggggagggggccctcagggctgaggaaggctgtgcctcagtttgtctctagtgggcacagcagtctctttgcaagcctggcaggagggtcagacaggcactcgggacctctgccctcctgtcctcacctgcgtgagcccttcactggctttcctggcccgcagggccattccagcgtccaggcccttccagcactctcgtaggccgcccgaccgtcctgccctaccactcagctgcccccttgctctctggggtttgtctccctgcagccccagccccagccccagcgtccaggcccagcccctgcgtggcaggtctccaggttccccatgctctgcccccatggcag

SEQ ID NO: 65875 - DNA, 2158 bp, Homo sapiens
ggagacagcccaagggcagcgcttcctggtgagcatgccctccaaataccgcaagaacatctggatcaagagaggtgagaggattactcctgtaatcctggcactttgagaggctgagatgggaggatcgcttgagaccagcctgggcagcataatgagaccttgtctctacaaaaagaaaaaaattagttgggcacgtgcctgtgatcccagctactcaggaggctgaggcctgagaatcacttgagcctgggaggtggaggctgcagtcagctatgatcatgctattgcttgccagcctgggcaacagagcaagaccctgtctcaaaaaaaagaaaaaagagagaggtgagagaggcagccctctctaggagatagaaccccttcctatggctttggctttccttattgcaagcaggcctgactttgccttttctcttcttatctacaggggactttctcattgttgaccccattgaagagggagaaaaggtgaaggctgaaatctcgtttgtgctctgcaaggaccacgtgcgctctctgcagaaggaggggttttggtaggtggtccccttgatcattggctgtctggcttctggaggcattgccttcctagcttgggaattaggggagggaaggtcatggcatcccaggcagacacagctggaagcagctcttttgtgagaaatttatttgtcctttctgactttggctcatctcttggcataggcctgaggccttctctgaagtggctgagaaacacaacaacaggaacaggtgaggaacaagccttggggtggggtacatggaaaataaggggttcatgctttggtgccttgagggaaaaatagagccttctttcctccttacatagggtatctgttgagagctcctaagcatgtggtataacatggttatgaatggggtttgaaggtcagatgctctgggttaaaatcttggctttgccacttaaagctgaatgactttaagcacgttatttaattccttcaaactctattttcttatatgtaaaatgggagctttgtgaggattaaagaagtggatggcttgtaaaattgcttagtgcagtatctgttatgtgatatgggtccattaagtgttagttggtggtcgtagaatcattatttctaactaaaacaaatggctgtggcacacgtttggggagtggggtcagtctttagcctgtttctttggccacgtttccccactgtttgctctcctgtgtcccttgtttgagtctttaaagggtgctgtagggccctgactgctgggccggatggtcctttttttggaactccttgattgtagatattattttcccagaaggcgctgggctaaccctgctctcttcccttcgtgcagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccgcctttctagtcaccctgtgtacgggagtgctcacctccagctactgtgtccatccccacatacgacctcatctctcccactctgcaccatctatcacttccagaaggtggc

SEQ ID NO: 65876 - DNA, 1752 bp, Homo sapiens
taggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagtagggaagagtctccctggaactgttttctcctttcaggatgagggggatcgagcaagccactgtaacccctggcttggcttcctcttactatgagattgctcgtgggcccttagaagttccaggtcttcagccctaatctgccttttttttgggattcctagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggtgtggggtggctgcgtgtacctagtgcaagcggggggtggaagggaagtgattccatctgctgggggatggacagtaaggtataatctgaagaggctgccagagcctgggcacctggtggagaggagaggggggcaaaacccgcgctgcttcctgggcttgtgtgctctgaatggcacaggaatggctgtcttgctcttatctctcactgagcactgagcagcacgctccttccttttccctgttttgcaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcatgactgggctttgtgcactgaaaagcaagtgggctgggagttgcctctccttcagggactgaccatgtttccctcactccttatcagtagagaccgaaactggcagcttcccttccactcccagagggcagccaccctagccatgtaggcctcaggcaggtgacttttgtctcaatccccgagtgatgtgggagagggtgtgggtggatcttttcctgggagccagatggactgtgctccagatgtcagttaagtcaacagctgggctaggcagcacctggtggaaaagtcagtgggagtcagaggtaccagacagggtgggccggatgtgggtgagagttcacctgccagtcatcatctgctctcccggcctctgtaagggtgggcagggtgcttgccatcttccatgatctcttagggag

SEQ ID NO: 65877 - DNA, 1049 bp, Homo sapiens
cgggactccctgggagcgtaagcgttcgaggatctgaccggagggccgggccggaaagcttgagagccttcgctcccgcaggtgaggcgcagaaaacactccctcggggaagtgccagccctcctcgcagccccgccctccggcccgccgccggccttcggggccgtagcggcgcgcagggcccgcagagaccgagacctgcgcactacaactcccaggaggcctcgcgaccagaccgccgaggggccactagagaaaggtgcgtctgcggcgaatcccgtcgcccagcgcacggcagcgggtgtgcctgagtgcgcgtcgcctcccaaccagagaggacgtggcatacggcgccaccggaagttccggcaagtgggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtgaggaacacaggaagtcgaggggcctttacgggcctgcggagaagcggagcctggttacccgggagactcgggtgcgaggggcggaggcaggccgctggggcctgacctggccgggctggcctgccccattgatcgtgtactttgccctgcaggtaatcgcgaggagctggtggagcggctgcagagctacacccgccaggtaggtgttggcggcgggacgtcaggataggccgagcttctccaggagaccttatataccccatcacggctcggtcttcattctttctttatctcggcacagcaaggcggaggcttgccctttttagcttgttcttgcctttgccagcttagttgtaatttcttgtatccatcttggtcctcttcagtgcccagccagagcgctggcagacaggcactgggtacgttttgttgaatgaattgggagcgaacgtcgtttagtgaaacagctagttttggactgac

SEQ ID NO: 65878 - DNA, 3569 bp, Homo sapiens
aaaagggcatatatagtaaatatatagtttaatggttttttacacactgaacacacctgtacaaccagcacctggaccatgatccaaaacattaccagcattccaaaagccacgccacgtgccctcctcccctgcaggtttaccatcaccctttcagcaagagaggtaattttttacgtgagtgttttgcctcttctgacattggatttctttttcccgtctcttagtagctgctccagtgggcccagtgggccccactcctacagttttgcccatgggagcccctgttccccggcctcgtggtcccccaccgccccctggagatgagaacagagaggtgagactgatgatttattcctagggataagagagtggtagtttaggatgggactatttttggatttttagagaaaggttctgtgagaagatggggggacttaaattcctgggggtagtggggagcccttcttatttaaactaagggtatggcagagggactggggagacattactgaggcagagtcttggggtccctctgaggaacactaaaccccactgagcccagttggtgttgcccactctctgctgcttacatcacctgggcagcagcctttctagtccaagaggtggaagttggtggaaaaagggcactgtgggctgggtgcggtggctcacacctgtaatcccagcactttgggaggccgaggcgggcggatcacctgaggtcaggagttctagaccagcctcaacatggagaaaccccatctctactaaaaatacaaaattggccaggtgtggtggtgcatgcctgtaatcccagctactcgggaggctgaggcaggagaattgcttgaacctgggaggcggaggttgtggtgggccgagatcgcgccattgcactccagcctgggcaacaagagcaaaactccgtctcaaaaaaaaaaaaaagaaagaaagaaaaaaaaaagaaaaagggcactgtgatttgccttctctgactgggtgtctctggcagatggatgacccctctgtgggccccaagatcccccaggctttggagaagatcctgcagctgaaggagagccgccaggaagagatgaattctcagcagggtgagtgccaggcgttctgatgctgtagccacagaacctggagaggctgagctgagtcctcatccctctgtccctttccctggctcttggtaaaggcaggttactgtgaacgagtgcagggcagtggcaccgtgaagactcatcaccaccttcttccttacagaggaagaggaaatggaaacagatgctcgctcgtccctgggccagtcagcgtcagagactgaggaggacacagtgtccgtatctaaaaaggaggtagggattggagctgagtgtggaaggaaagccaggagatgggacttgggtacggaaataacacaatttgtaagtgttcagtaagtaatagcttctattttgtgccaatttccgccctcagcatcttatagatatttttcatttaattgctttgagttccaagtactatacgtgcctacattttacagctgaaaaagcagaggttctgagacgcacagtaatttacccaaaggcatacagcttgtgagtggcagaactttggagtctgactccaaggccccttcgcagctacttcatgagatggcctccttgggaaaagcctgactgttgaactgtgggggagaatgggggaggagtttaggggttggggtgctggcacagtgcttggattccctgacccagctggttttcctcctcttgacagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaaggtacaaggagagcacactaggaaggggcagtgccaaacagggaaggggctcagaggtgggtgagaggcagcggtgaacaggcatcttttagtgctggccttaggaactgggaaggggctcagagggcaggggtttcaccttgtctgcctccttagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggtcaggcccagccctcctggtgggaagcagggactctgggcacaggtggctgagatgcatccagagagggaccatggtgaactcttacagagctttggtggcttaaggttggggtgggttgggcagtttcattcacatctgagtcctgcttaaaagggctgattgttctgttctaggaaaagaagccagaagcccccaagctgtccaagaagaagttgcgccgaatgaaccgcttcactgtggctgaactcaagcaggtaagacctgagaggatcctgcaggccctggagcccagctgggagaccacctggggagccagggaggtgaaaaggagttctttgaaggaggtgtgggtgatttgggtttgggtcctttgaggaagaagagcttcagaactgagaagtcggggctctcgagaacacgcattactatgtgttttccagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggtgagggcctggcagggctcagacctgcccccgggtgtccccatccttcatagcagtgtgcttcaaaatgggaatctggtttgaaacccacctaccacctacttgttacttgtctaattatccttttgttttcctcctctgctcttcctcccctctgccttcactttgccagctcacctggtgactcctttctcagatgtactttgtggctagagattcgtggtggttgtgtaacttcttaattttaaagcttttagttaaatgctttgaattcaggaggtagaaaagaacatggggaagtctctgctttccagagaactgttgagattcatctcttgatgagatggtttaaaaactagttattgatatacacggctgaggctgatattgtatagtctgttttgttcagtatggattatgtaattttgaaaggttttagcaggaaggattttgatgactttcagggtgagataattgaggcttcccatgatctcatttggagttgggagctggattctctacatgaatttggtgagtacttgttaaggcttgtttgctgccattctccacaggaagaacagaagaccatgaagtcaaa

SEQ ID NO: 65879 - DNA, 1067 bp, Homo sapiens
atctggtggcttctttccctgatagactcttcgtatcctgtcttagaaatgataatagtttgtggtaggtggtttagggatggaggggccaaggggcagatgcttttaggaaacttttaatattgggagtggtagagaaattgctggttttttctgatccttgaaatcgtagtcaccatgatgtcatggaatttatgaggtggaagaattttgcatatcttcctgtcgagtgccctcattttacagatgaggaggcaggtcctaacgttggccgtgttctcatagtgggttattgacagcactgtgagtctggcctggtttttattccttccccgactttggccagggaaagaagtgatgagaatcagagtgggagccaggtagccctcactgggattttatatctgatgtgcgttaggattgtgctcccactgagtgtctgggtctacaatgtagcatgctctgcttttccctcaggggaaggagttcgagacacgactgaaggagaagaagccaggagatctgtctgatgagctaaggatttccttggggatgccagtaggaccagtgagtgtcagttagctgtctggggaagcagcgaagaggctggtggggattggagtggaaggcagagacagggatagggtttggcagatggtatcctgttctctttttcctgcagaatgcccacaaggtccctcccccatggctgattgccatgcagcgatatggaccacccccatcgtatcccaacctgaaaatccctgggctgaactcgcccatccctgaggtgagcattgtcctttcgttcattcttggccatttctgcttttgaactggaaggtaatttgtttgttttccttctctaactccaccatgtgtctctttatttacttaaaaaatattttattgacataatatttgtcatataccatgtgtatgtgtagaaaaacaaataatggtttttgttttttaaagaaactgacatgctcatcataaaatattcagtcagaattgacaagtacaaagatgaaagcaagtcacaattttaccactcagaaatagcc

SEQ ID NO: 65880 - DNA, 1490 bp, Homo sapiens
tttgcagctaaggagtgaactgattgtgctcactgtcttgcagagctgttcctttgggtaccatgctggtggctggggcaaacctccagtggatgagactgggaaaccgctctatggggacgtgtttggaaccaatgctgctgaatttcaggtatgggccatgtactagcgatcttggttttacttaatgtcatgaaggttagattgttggtttatagcttcattatcagggagttgtgtgttctgacacagcagagcctggaaaagggcatacattttcctgagatgttaatgtaagctcctcactagaatttgagctctaggtaggtagggattattgtgttttgactcttacaccccttcagcttaaaacagcctggcacataataggtacttagaaaacatttgttgaatgataaagtgatctctttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacaggtgggggaagcagagaatgcctcttggaagtgggctatctttggggtccttctctttactccagagcttgttcctctctttacagtggccttatcactcctggaggcttttcatcagtgcctgctggaatggagacccctgaactcattgagctgaggaagaagaagattgaggaggcgatggacgggtaagggtaccagacagggctgagaggggaggaccttcacttccctttggctggctggctgactgttgttcctttctccctcatccttttttaaacaattattgaaccaactctctgccaggcactactgtaggcagtgaggagtcagcagttgaggtaaactggtaatcagagaacaagatactttcagatgtagataaggatgttgaagcagaggaaactgggtaatgggatggggtggcagggaggcctttgggaaggcctcactggggaggtggtgcttgaactaagacccgaatgaaaaagcgccagccacaggatcatctgggtcagaagtaacagtaaatgcaagcaagtgcaaaggcactgagacagggatgggctagtattttgaagctccatttttaggtagttgaatgtgtagtgttgttaggtcttcatgaattgacccctttatcatgaaatgaccctctctttatccattctgctctttgttccctttttcctgtttttctaccttcttttggattacttgaacaatttttatgatttcattttatctccagtgttggttaattagctgttaagtttttgctttgttattttagttgttgctctggggtttatagatcatgtctttatcaggatctaccttctcttgatgttacactgcttccagatagtattaagagccattatagtatacttcatttctctcctcccaat

SEQ ID NO: 65881 - DNA, 1997 bp, Homo sapiens
tgcatgtgggagtcctggtctgtgatcccttgacttgattcagggggccccttagctccatctgtgttccctggagtcagcactgtgccacccccccgcccaattcttttctgtcatgggcagaactgcagaggctgcatccttggggagctcagaagctctccaaggcgctgagtggaggtgccacctgtatcttttgtttccgcttctggagacccttttgtcccttgctttttgggcctgatcccattgtccttcgcagaagtgagacacctcagctcttcactgtgttgccagagaagagaacagccactgttggaggggccatgatgggatcaacccacatttatgacatgtccacggtgagtacttggaggatactgcttttggaggctgagaaaggcagcagaagctagggcttctctgactctttggagatgaccaggccctgatctcctttccaggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaaggtaggcgcttccaggggcgctgggctgggtgagagccagggaccctggcctgccgttttcagtggcatggtgccctctagtggtgagagtgagggtggcctctgcttgctgctctgtgcttccttagatttggaagtcttagaaatcctccagtgggctgccctctttaaggacgatgagggggaggaactcagccaagtctgagagggagctcgaagagaattcagattcagcgcctttcccacagacttctatgtctatgtcaggctgcccacccttgttttgggggtccgggggtggttcaacctgtcttaacctgtgtctctttctccctatacagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggagtaaaaatagccagattagcgccctagcgcggcagaggaagtaacagtgggcttgggaagtaggccagggcaggccttcccaactgaccttgtgaccagaagttcaagtccttacctgtgcgacaacatagctcaaaagctaaattgtcttgagtccatatgaacccttgggttcaagcaacactagtcgctggggtttgggatttgtatgtgggatggggggacttactttctccaggttgtaatctggtcctgagcagcctttctgacagactagagcaggctggatcactggctcccatgggcatttgccagcctgtggggagggtagtcatgcgctgctgttgtactactgttggtgtttaagtgcaccagtggaggcgctcacttgccggagggttcaagatggtctcggggttgtggggggcatgatccagataggacgtggcagctgagctaggccttaggaggaatggaattttagaaatttggtaagcaacaaagcactggcactctaaagaggcatttg

SEQ ID NO: 65882 - DNA, 2337 bp, Homo sapiens
cgtgcagctcgctggctgctcgcgctcgggcaggcgggctgaggaggctgccgcgcccccgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggtgagcgcgggagggtgcggcggggcgccgggggagcggggtggccgccggggcccagccctccccgccccagcgcccatggggtccccgccctccatctccccgactgtcccgcggcccggcctggctccagccaggcctcccgggactcctgccacggggacccgccctctcctggcagccccaccttctgcctggggccgggaccacccttctgtcctccccgagggaccttctggcctcggccccgggctttctccgattgggctgaccgaatccggccttcctggcagtcagtttccctgagtaagtcactctcctgcctcgccggcgccgggagctgtacatacatggatgtggtatagatctcttgatattattatttcccaatagactcagcatgtgccaaactcgattgtcacctcttgcaggtaaagctcatataatcaccctaggggcttctcattagccttcggcacacatgttcatttgaacttcatattacacacgttctgtcccaagcgctaggctcttagttttggggccctatttaatgtgtcctcaagtgtatttttacctcccctcccccactaaaactggtcccagaatctcccagctctgcagggctgtatgaaattactgccttgttcctaaattcaatccattgctctctgtctgttggaaccatctggggactttccttccattggcaaaataggcctgagtttgggaatattttctgtttttgtattggcaaggcagtctgtctccaactctggggacagggtgctgtgtcttacagtttgccacttgaataagacggtgtgtggagctggtttcacccagaaagcccagagaagtgcctggaggtgttcttttttgtcaccttgtagctgagttgattctgttgccttgaagtcttgggctgtctcctcactgttggttaggcagacggatgtgtaagtcagagttagagaggattgctgggctcccccctcgactgtcttcctttccccacctttattctggataatattgttttatatatatatcccagataggaatgatgagagtacatctttctgtttcgctcagcttaaggaacagagcattatcgcttctgttgaagctctcagggtgccccttcctgactgtctcccctcttccttctacaaaggtaaacactattttgaattgtgtttatcatttcccttgttagaaaaaaattagttttactacataatgcatctctatatattttatagttctgaatgttcttgaagtttgtgtacatggtgtcatcctgtatgtgttctgtgacttgattggtttttttatttttttttaaatcagcattaggtttgtgagaatcatccatgtggtatggtagccatagtttaaatattttcatgatgggtagtattctgttgtgtgaatgaatataccgtaattctcttgaatatgtaggttgtttcctgtttaacacccacagtaatgcacacatttccccccaggactcctagtgctcttgtgcagaagtttctttaggttgtattcatatggaggggtgggattgccgctcgcagggtatagatctgggacttcactaggcaaaagtagattgtttccacaggctgcttccactctgtgtttccacatcacttaacagatttacacattgttttttttttctctgtcctttctctagggaaatcaggagccacattaatttagtttgctgtggccagatccatagcacaacaccaagctcaagcgagagttgagtatgtgatggtgttcctctcttgatcctaagcaggcctctctctttctatacaggccca

SEQ ID NO: 65883 - DNA, 1104 bp, Homo sapiens
gtagagacggggtttcaccatgttggccaggctggtctcgaactcctgacctcaggtgattcacctacctcagcctcccaaggtgctgggattacagttgtaagcaaccatgcctggccaactgtaaggtttttaaggtacaacaaaggttggaatatttgagtttagtgctagcttcaacaatttttctgaatctcaaatatcgttcttcctcttttctccttgtgagtaatgatctgtgtccactctcagatcaacctgggctcccttcatcctttcaacactttcagtacttttagttttgtaaatacagtggtatccacaggtcattttggcaaaaacactttttagaactgtatgcgtcttagaaattgtgatgtgggtaatttgctgtgtatgttttttagtgacctcgtataaatataggtagatgtgaaaggagtgacgccttaaatttgctccctactgtaacacctgttcccttctttgtagtctgtgtaactcctccaaatgacagatcttttggacacattagtggttatgtgatttctttctaaactagttttccaaactacctctcaaaactttattatgagtaggatttcccccagctaacattttgggtatgactggcatgttaattgtctctgaaggattttagactggttattttgtttttgattttgagataggctctcactctgttgcccaaactggaatgcagtggcatgaacacagctcactctgttcagcctcaacctcctgggttcaagtgatcctccctccttagactcccaagtagctggaaccacaggcacatgccaacatgccctgctaactttttaattttttgcagagacaaggtcccactatgctgcccaggctgatctcaaactcctgggctcaagcaatcctcccgcctcagcctaccatagtgttgggattataggcgtaagccaccgcacccaggctaggctggttattgtgctgagatataggaaggcgttttttcttttcagctgttttcttttctttttctttttgagacagagtcttgctctcttgcccaggctggagtgcagtggcgctatcttggctcactgc

SEQ ID NO: 65884 - DNA, 1051 bp, Homo sapiens
ttgttcctgcggtgggtcaccctcgccttagggcttttgcacttgctgttccctctacctgtgataccctttccctggatccttggatcgctgagactagctcctgggtatcattcagctcttcactgacctgctaccttggaaggctgtcctcacctgcccaaccccttctgggagtttataaagctacttcacacctactcgccattactggaaataatcttgttcctttatttagttactttatagatgctcaataactacatttgtcaaatcaatgacactgattttcctatagtgttttataatgtttattgaatgactatctgttatgcacaattcatccattcaccaaatatttactgagtgtttctgtgtgccaagcactgatctaggctctggagaagcagcagcagacaggctgacaaagtccattctctcccggggtgtgctttctggtgggggtgacagatgaggaacaattatattgttatatctgtgataaatggtcagatagcgagtagggtcacaaagaatagtgtggtggggaactgagtgtggggggaaaggctgtcttggtgagggagggcctctggtaaggtgacagttgcgctgatgctcgctgcagtgaagctgatgaccagagcatttactgtgtgccacaaaactgccagagccaggtgctacgatcccttttctcagaagggaaaattgaggccctgtgaggtgaaggcatttttttaagactacacagtttaaaagtgggcggggctggaatttgtctcatgactcatgattgccagacaccagagccgtttctgtgtttaaacttggtcccccaagccctgtctggttctcatagctgacaaataatatttaatgccttattctttgccagctggaattacaaaacactgctcaatttccatcatagacagcgagaggctgtgtggtatagtggctgtgagtgtgggttctggagccagtcaggtcagattttactatttgagtgactctggacaagtttttaacctctataatgcttcaactt

SEQ ID NO: 65885 - DNA, 1050 bp, Homo sapiens
tgcgcatcaggccgggcgctgtggctcacgcctgtaatcccagcactttgggaggccgaggtgggtggattacctgaggtcaggagttacctggccaacatggtgaaactccatctttactaaaaatacaaaaaaattagccgggcgtgtggcggtcgcctgtaatctcagctacttgggaggctgagacaggagaatcgcttgaacccgagaggcagaggttgcagtgagccaagatcatgccattgcactccagcctgggcagcaagagcaaaactctgtttcaaaaaatataaaataaaatgtctgagcatctatgttcatagaaatcatgaccttcacatctttgaggagtgtcagtgaaactatgaatatgatggtataatatttatactgcagcagctctcatatcagccaccttttacattgtcttcacaagcaggtttttgtttggtactttaaatcacaggcgatggaatggggcagtgtaatatgccttaagtctattgtttatgaaattatgtcctcagagttaaaatatgtagaaagtagttgacagcattctgtcatctctcccatgcactgcttttgctgtggatgaaaatgaataagcaactctggaaaccaaggtcctctgggaacataaaaactcctgtggctattaatggatttaattgtatttcctctctgccaccaagatatgcaataaattgtttatgcccttgccgttagtggggagaattgttcattaaacgcatgtaatgtcattattgctttgtttttattacttgtaggtagtcctatctctccttttaaaaaaagtataaaaagaatggccgtaattattaaacactggccattaatccctttggttgactttttcctccatggagaaaaaggaaagtatcatctcactggggaagcaagcttgggctggaaatgggtcatggtctcccaaatctaagatctggcagaaggttggttttgtatgctttggacttgggccaagtgatatgtttacttaggctccagaagggcctggttctaagg

SEQ ID NO: 65886 - DNA, 1587 bp, Homo sapiens
aaagttttaaacacttacatctactggtatataggtatgcttgccccatttccttttcttttcactttctctttttacagaaccctgctgcaagctaactcatgtatgcgtccgttcatgcttttgttcattcttgtgtgatacagaaatgtatatacacatacatacagtgggttgggaatcttgtttttaaaaaatagaatcacattgaaactaatttttgcatcctgtttttctgaacaccttggagaaatccctataaatcaagaggtttcattctaatttgttctttttagatgctgcacatactctgttttctgatttggttatttgatcatgacggggtaggaatagagagggacaggcttcaaagaaagggtagtcaggaaagagaaagaggaggagtgctaggtattcctggggtcttcaacctgatgtgtcatcgaagtgggtgggaagttgggaaaatggtggtggggaggtgtgttggttggttttagcggggaaatgagtatttttttatatgcactaaaattacctaccaggcagttgaatacataggagcagggagtgagtccaaggataggactggagttgatagacaaagctataaagggagacggttactggggggagagctctgtctcgcttagcatcacttgctgttagtggtgggcccagacagtgactgaaatattttcattccagaccagggtccagtgtatttatacttgatgcattaagttctgatctttaaaaagctgccagttttttagaaggagagtttttattttcattttatatggtgtgggctgaaggaatcttttgctaaatataacaatgtgagtttgctagtctttctgaggcattgaaggcatttaaaatttgaaaccagagctacctgatgggaacatccttgatctcttctccaagtcaaaccaacctaggccacgtgtaataattagttcaattgaatggctgaagaaggatttatttgccccttttatgttacagaggagatccacagtacagctagaaaagggatgcagaatgaacaggacagacacgtgattctgaccctgataaccactctgcatccatcggatttactattattattattattattattattttattttttattttgagacgggtctcactctctcacccaggctggagggcagtggtgcgatctcggctcactgcaacctccgcctcccaggttcaagcgagtctcctgtctcagcctcccaagcagctgggactacaggtgcataccaccacgccaggctaatttttctgtttttagtacagaaggggtttcaccatgttggccaggctggtctgggattcctgacctcaagtgatctgtctaccttggcctcctaaaatgctgagattacaggcctgaatcactgtgcccagccaagtttactattattattaaaaatactggtggccttgaaatcagtgtaaaataataatgtcatctttttaggaataaaaatactgctctccccatgccccactggctgtaggaaaattgagggaaatggttgttattttctctttgtaggttggatt

SEQ ID NO: 65887 - DNA, 1056 bp, Homo sapiens
aattgaggctgcagtgagccatgattgtgccactgcactctagcctgagtgacagagagaggccttgtctcaaaaagaaagagagaaagagagaagagagagaaagagaaagaaagaaagaatgaatgagttagctgggtgtgctgatgtgtctgtagtcctagctacttggggctgaggtaggagaattgcttgagcccaagagttcagggctgcaatgagctatgtttgtgccactgtactccagcctggatgacagagcagcaagaccctgtctctaaaaacaaaacaaaactaagaattttaggatgacacaactcagtccatagcaagtgatacctctttgactggaacaaataaccttatgcttcaggtgcaatatctcacacagacactatggccttcgttcactttttaaactagcatttattgaagacaaaactatgtgccaagttttatgccagctgcaggggatatcccgtaccctccaccagtagaggagacagagccagtttcagagaagggtggtgagtacctggggatggatggatgtgtcaggaaaagtttcattgagaaggtcgcatatggccaggcgtggtggctcacgcatgtaatcccagtactttgagaggctgaggtggatcacttgagccaaggagtttgagaccagcatgggcaacatagtgagaccccatctctattttaacaaaaagtaaaagaaaaagagaaggtcgcatatggtctttcaggtctgtgaagaagtgtgtgcatagtttaccacacaacagcatatgagtcatgtcaccatcattattgtcatcacccatctttatagtaacaagaaggtagttccttcacactctaacctaagccctttttcttcatcttcacctggctttggttcttttgctacagttactccagcctctctccccagcctttatcttccacattttctgctgtgttgtttcaacagccagtgacttttctgttcatactctattgatgatgaagtaaaaattgattttgatttgtttctgatttcttttccttagt

SEQ ID NO: 65888 - DNA, 1031 bp, Homo sapiens
tttcttaaagatatgagaacctagctctaacataagcatgaaatgcctattcctgaggcattgatcacattgtcattgttccaggttcctctctgtgctccctgaaatccccattagcgtaattccccaccatccccttgtgcggagtccactgccccactgtgctgctgccctcgactgttgtgaggccggctgagtttcagtaacagggactcggtgattaaatttctttttctttttctttttctttttttttttttttttttttttttgagacggagtctcgctctgtcccccaagctggagtgcagtggagcaatctcgctcggctcactgcaacctctgcctcccaggttcaagtgattcttgtgcctcagcctccctagtagctgggacctacaggtgcctgccactacacctggctaggtgatgaaatttcttcagctttctctggccctccctacttctaggatccaaatgacacgctacgtatcgttgccatttctgatttggatgtacaaatatagggacagatgggtttgtgtttgtttttgatgtatttttttttctctcttaatctggctgtaaaagcatttccaatggcttatagtttagtatgtgttcccaaagtgggagcagcctgtacatatggaagtccagttgggtagggctccctgtaccctggcgccagggcgttgttctgaccgatggtgccccctgatggccagtgtagaaacttggtcacggtgtcatctttttctcactatcactggggattcccttcactccccagcaattactcacttttattctgtcttgaatcttagataattatgccggagataatccttcttatctcctctttgggtttcttgtttcttccttatttattgctctcttacctcaaaaatatcttatttcagccaagtgcagtggctcacgcctgtaatcccagcattttgggaggctgaggtaggtggatcacctgaggtcaggagttcgagaccagcctggccatcatggtgaaaccc

SEQ ID NO: 65889 - DNA, 1042 bp, Homo sapiens
gttaccgcacttcccattcgcatctgcctgtcatgttctaccactaacccccaggaagaaatgaatgggaaatttagtttgccatgatttttgccctgatttaacatacggtacttagtttgggaagccatttgctgttgaagaccttctttcttgtttttttaagacagagtcttactctgttgcccaggctggagtgcagtggcacaatctcggctcattgcaacctctgcctcctgggttcaggcgatcttcatgtctcagcctcccaagaacctgggtttacaggctcacaccaccatgcctggctaattattgtatttttagtagaaatggggttttgctatgttggccaggctggtttccaactcctgacctcaagtgatctgcccgccttggcctcccaaagtgctgagattacagaggtgaaccactgcacctggcccctgttgaagacttttgtgaaacaaagcattttttaaagtttcttaagtaatattggaattaacttagagtggactgtgtgaagtaaatgtgttgtcacaaacttaacggtgtcaacatggtaacaatattgaaaaatgcttttaattttgtgagatgcgtattcatagaactaagagtcagaagttcttgaaccttgattcctgtttgcctcttactgataatggactatatttagccttttcttgggttgggtccttatcaaagaatgagaagactaactaatagtaacaataatatgtgtttgctgtatgacaagagctagccaggtgatttgcagttttagtagggtaaggtacagcactatgaaccatttctataacaaaaaggaaatgtatcatgtcaaaagagtaaacaaagttttttagagaagaggaaaacaaatcttgaatttgttatttgtacaaatatacatagaaggctatcagggctgtctgagttttctttcatgtgtgagaatgaaggtaaaacttgctccaggtgcttagataagacttgaaggaaacacaggcatttatttggtttattgttagatcaa

SEQ ID NO: 65890 - DNA, 1083 bp, Homo sapiens
gccaacatggtgaaatgccatctctaccaaacaatacggaaattagttgggtgtggtggtgcgtgcctgtagtcttagctgctcagggaggctaaggtgagagaactgcttgaacgaggtgagcagaggttgcagtgagctgagattgctccactgcactccagcatgggcgacagagtgagaccctgtctcaaaaaaaaaaaaaaaaaaaaaagttattggtagtctgacctgatgctgtcctatcccagtatctcagtcacacccagcatttataattacctggaaaccatgctttgtttttgtattgctgctaacatttctgatacaaagctagatgattattcagatcttaggtctaaaatttatacttcctgtattgaggtctcaacagtagacttaaagatgctcattcatatcccagaattcttctttacaaggtggaagatctttgaataggtagctatgatgtgacgtgtattgttatttgaatcaaagtcttctggtttcaaacagtaagataatggtattttctgtctgtgaagtcctttatcaggaatgtctaaggattattttgttttctctttctgagtgcagctgtttgtttctaaagcaaaatataggtcttgccttgaggtgggatagatagggagatcagagaaagatggaattatctctggtcaaaaaaccccagctgattatacaatgctttaaaatgtaccatttaaaggtaaaatagcaagttgtttcggcctctgtgacctatttttaaaaaatgttaattgtctttgtagataaagacatcttgagtccaaattgcagttttcttactctgtttaagcattgtaagactgtcagaagctgaactttgtgggaggggagtcaagtgaggagagaatgcaagtaagaaaggaaaaagagtgaaatcacaagttggtgtttcccgtcctggcttttcggttcatgggaagtggcagaatctggatttaatgcctccataattgggaaaaagagcagaaatcttcatatttagtctctgggtattactgtgcagctttcgaactctacagagttaatgatttc

SEQ ID NO: 65891 - DNA, 1070 bp, Homo sapiens
agtccccagacagtcctctaacccagagactgttttatcccagagcccccattccccaacttgggcaggaatgaataaaagtcacctggaggtttatggctggcctggagggccaaagcaaccctttagccagtgacggtaagggtgtggagacctgggtaggcaccgtggccccttcccttcctctgccttggctaacactgttagccatctgctgcaccacatcacatctccttagtgatcctcgcacaccccgtggactgtgccaccatcagcctccacgtcgggatctccgtccttcccctctactccgtatccctcctagtcggtgtccctctcatcgtaattccagtaattcaatgcccaaattgaaacacatggagaaaacacctgataaagtggcaagggaagagacagttctctgaataggtgtggaccccagagctgtggcgtagaagccaggcatcaagccgaatcagctccaccagcagcaacttcatggctctcctttcaaccctgactgcccccttttagagacaggaagaattgaagcacagaaagactgtgtgtcctccagaacccctcaaggacccagctgcccattaaccacgctcgactctgttttgtatttcgtagtaccctcatttccttaagcgagatgccaacaagctgcagatcatgctgcaaaggagaaaacgttacaagaatcggaccatcttgggctataagaccttggccgtgggactcatcaacatggcagaggtgagaggaacacagtctccagactgttggcctttgagtcacagagcccaagggacaccccagcccagccagttgagccttccagatgattttcccagcctgctggctaggtgcttaattctgttttacgagttaattatttgctggaaattcagagtatacttgtttttatcaaatactgtctccttcatgaaaagttttaatttttaaacaggtaaaactcaaaaaattacataaaatttcaaactttcagaaaagttacaagaatagtacaaagagttcccatatgtggattcatccaagttctt

SEQ ID NO: 65892 - DNA, 1085 bp, Homo sapiens
tgtgaggtggaaatgtccttgttggtcagccctggaataaccaggaatggggctgctgagagagaagcagtcttttccctgggctccgggaggggcccgtttccacaggcctctcagtgggctaacagagggataaagatgaaaattgttgagagcgattgcttcgccttcctgtgagctgtaaggagggtaggaagaacccacatgggcgatgggcctcgggattcctcagctgtccctcctggcacagcttcacagtgtggagcggtggcaggaactggggggaaggtggcctcaccatgtccccgccctcaggctggatcatggaaatgacgtgaaggttactccagccagtgtgaagctctggcatgtcccttaagcaggactataagggcagcccaggagaaaggagctgctcatcaaccaaaattgttaatagggatgaccctaaattcagagactcctttttccctgcaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagtgagcccccctctctgtagctggcctccagactctccttcctggccatagcagtctcctgacccctccctcgctgtcccctctattaccagagaatcttggtccttcatcctttctgaacctctggctgtcttggagaaggtcactgttttgcctctcactgacagaagtcctataggactctcaggaagtaccccctctcctgacccgcccctcctcttcaccctgcacttccctgctcaccgggcgttctggacacctgtagcttgttgacccaccctgaatgccagctccattcaactctcccagcatgctgttctgagccctggcagcactgaccctggctgtgctcttcaccacaggcctttctttgaggggatgtcgcagtccagctcccagacggagattggcagcctcaacagcaaaggcagcctcggaaaagacacc

SEQ ID NO: 65893 - DNA, 1037 bp, Homo sapiens
ccagacatatggcaatgattggagacatttttgtttgtcacaaatgagggagtggagagttgccactaccagcacctagtgagtagaggccagggatgctgccagacatcccacagtacacaggacaggcccccacaataagaatgagccagccccaaatgtcaatcgtgccaaggtggaggaaccctggtttagagtgtgacatagggagcctgctgtggtgatccttgttccatagtttactaggtgaccctgaacttactagcctgatgcttctcagtattatatgattgactcagagaaaggactttgagtcattgggaggaagtgggatatcatttatatttttctgcctcctatggttccctacaagaaacaaaaagattcactaaagccagtaccttccctgcatctaagacctacaacccacacgtcactgctggtgactttgagttgctgtctgcacagcaagaagcaatattaacaaatacgaaaatctggttatgtgtctatatttgcaaaggaaatttttaatatttatgagaaatgctaataagagttggggacaaatggagaattaatttacacctaaatggcttaacattgggtgtctttctgcttagtatatcctgttagagggttttctggatgttcccaccaagcaaaaagcatttggctaccatggatgtctttagtctcaaaatcaaagacctgaacctagcatactcctttctctggcaagcaaaggaggcctcccctctatgtccttcctgggcaagtgtattcactggatccagggtcaaagacttcatggatgcaatagcaaagccatctaaattttgagcttctcttgcctagtgacacctcgtggagtcagaatttctgggttctgaatctccgtgttattgacttgatgacaaagataactgatccctccaaaacctggttttcacagaaatgtacccgcctccccggcccacataagaaaaaagccctgaagattttatgaggtttgagattaaatgaaagtattttaa

SEQ ID NO: 65894 - DNA, 1051 bp, Homo sapiens
ctgcgtgtctcgtgggtcggccccaccccctccttactggcagtccggagacctggctgcctttgcccagcttcggtctgaactgcagaggacaggggccctgcagctcggtctgggtctcacttgcctcttggcccttgtgaaggagtgatgtgttctcacctgtgtccctgctctcctccctccctatcccagtatgtggctgagctgctccaggaccagcggaagcctgtggtgtgcacctgctccaccgtggaggtccaggccgtgctgtccgccctgctcacccggatccagcgctagtaagggctctggcctcccttctcctgcccttagagattccctctgacctcatcttccaaccctgacttctaagcaatgatagaccctcctggcctcatcagaccaagaatttgcagaggggcgtatgtttaggggggtggcggcagcaggctgtagggcttgaggccccggcagaccccagaggatcgggggtggaaatatcaattcctgtgctccctgcctccctgcctggacccccgccatgccttgacttgctttatcctcttaaacccatgatgaaggagaggacacactggttttaaaaagatcttttattccttccatctgcaacatgctgctagacactcaggagtcagtgcttcccctaccctcagggccttcttaaaaggcccaagtcccttgcccttgtgaaagagaactatggattccaggcctgggggcacacaccctgcgggcatcccaggcacactgccgagtcctacgttagcctcagctgttccgtctgcttcatgggcaatgccctctgaccctggatttttctcttggttgtgaaagcactgtggcttattccctgtatgatcctctctgttttattttgtggattggtttgcttttcccctgtgggttgttgagatcacagaaagtcagctctgggcctcccccgggcaggatcctggcacccctgagcactgctatgacgctccccttcctccccagctgcaactgcaactcttccatgccgaggcca

SEQ ID NO: 65895 - DNA, 1070 bp, Homo sapiens
ccattctttcctccaggataagcgccgggacagcgccccctatggggaatacggcagctggtacaaggcctgtaaagtagacaggtgagtggggcggggctgggctggggagcagggcacggcagggcgggctccacattccatactctcacccccaacacacccctcctctgctgctcatctggcaaggcccaactcacaggtcacctgtcccaagaaggctctgtctcccaattctcagcctaattctctggctctgggtctcccagcttttggtcctggtgacaacatcccatgagggccctggggccaggtccccagccctggggtgatttccccaggacagaagaggctgggtgggcccagcacagggcttgacatgggaaggaatggattctggctaccccggaggtccatgcttcctcagggcccactgtgggctgggtgccaggatgggccctgggtctgggggaacatggagtttgagactgtcccatccacagccccacagtcaacaccaccctgcgcagcttgggggccctataccggcgccagggcaagctggaagccgcgcacacactagaggactgtgccagccgtaaccgcaagcaggtggggctccatgcaggagggggtgggcagacacctgtgtggccctgggtgtggtccattcactgcctgatgcccctgcccctccctcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggtgagtccggggcctgggccgggtcgggctgggagcctaggtggccagcggggcctagaggcaagcctgtccacctgcaggatggcagtggctccttgaggcgcagcggttcctttgggaaactccgggatgccctgaggcgcagcagtgagatgctggtaaagaagctgcaggggggcaccccccaggagccccctaaccccaggtga

SEQ ID NO: 65896 - DNA, 1049 bp, Homo sapiens
taaatcctgtgtgcttccctggctcagtgcacgttctcttccctgagttattccagccattcccagttggtctctatcttgctattctgatctgggctctgcctcctgtcaggactagcataggtgtgatcctgttgcttctggcctaagaaacgcccactggctcctggtctaagtccaagacttagccatgctaagacagtctgtgctctggcctctccccaatcccccctctttcctcccctcttccccctctcccctcttgcctttctcctccccactcccccattccccctccctgtcccccctccctgttgagtgtctgcatcccagcaacattccatttcctcccattccccagacacaccatgcccctcccgttcagtgacctggcacatgctggctccccagctggcacctctcctgcacaaggccagttcccacctgcaggcttaggtccactgttgctcccacctcaagcagaggtggtctgggggctccccagcccctgccttctaacctgttttgcccttgtgtgtggcctggtctattcatctactgtcccgtgaatgtgttagggcagggcccaagtatgatttccccctttgtccccagcacttagcacaggacccaacttggaacatggcaagaggtctaagtttgagccagtgtgatatgaccaggcttctggctcctaaggagtataagtggccctagcttgagcactttcctgaaagtcctgtcctttgtgtgtggggtaggggcgcaagtgctgggagagtctgaagccaagtaatgaggctgttggtgccaaaagtaggatgaattttaggctgttcccaggattcctgtctccccacaggccagggccacctctgagaggaccctcgaactcctgtgctccaaggcttcaaaccttaaagggattttcaggccacggtgggaactgtggctcttgcggacccgttactctctgttcctatctcccgtccgctctctctttgcttctcacatgtggttagggcctgcaagtgtctcagggagagaga

SEQ ID NO: 65897 - DNA, 1231 bp, Homo sapiens
ctgttctgggtctcggatggaagagggcagggaggaaggttcagcctggagcagagggcttcctctgcatctctgcatcgctgagcccaggacttaaggggcccggagctgtactgttcccctcagagaaggtcttctccaggcctggggtaggggtgacagttgggagcaaaataactttggcccctggccccctttaggaatcctacgccaacgtgaagcagtggctgcaggagattgaccgctatgccagcgagaacgtcaataagctcctggtgggcaacaagagcgacctcaccaccaagaaggtggtggacaacaccacagccaaggtagcagacgggccggtctgcccggggtcggggcgctggggcctgctgcccctcacctgctctcccctcctcttctctcccctcctcttctctcctctcccttgtcaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctga

SEQ ID NO: 65898 - DNA, 1238 bp, Homo sapiens
cggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacgtaaggccgggctggggctggggctgggggcggggtggggggcaggggccacgcggagctggagggacccagggcgggtggtctcagagcccaggggaaacttgctatcccccagccgtcggcttgtcggcttcgcccccattaacaccccccgtggtcggctttcttcccggggccccccttcctccgccgcccccgcctgtctgtgtgtatgtcagtcggtctctgaccccctcctctgccctcgtcctctgctcccatgcagcccgtgaggtggggggtggaattctggcatttttgttgctttatcttctatgtccccccccaccaccatccagccgcctccattagtccgtcgggcagtttgtctgtctgctgcccccccccccccgcctttgtgggtttttccagccagagtgatggagctggttgctatggcaactgcatctgtttacaggacccacagatctcagagtccattaaccctttgccttcccagccccctccctgaccaagcagcagttggctctcatcagcccccagagacctagcccccaccaccggctcaccttgggtttccctacccctcctgttgggggcttcccagccccccaggtttcctctccattttccagcttccctcctcttcctgtcccccttcccctttgtctctcacataccccttggtctgtccctcgccctggcctagcctcacacctggttcttcaaaatgtccattcctcatcctgcatccgacccatcgcttcccccaggctccctcctcctcccctcccgctcctctcctccagggcctcctctgcctggctcccgtcccctcactacagaactatcaatcagcctccagctggttgttgggggcccctggccccactttactgccctccgtccccacccccacccaaaccccgtgcctgtttctgtaacagcctgcccagctcggccctggctggctcagctcagcatcctctgctcacacctcccgcgc

SEQ ID NO: 65899 - DNA, 1045 bp, Homo sapiens
gggtctcagatccaggtcctggggctgagtcctgggccttccatatccctttggggtctgggtccctgtggggacagattgagagtaaaaggtgctgtgggaggtggggtctagctgggctctgggcgttgggggtagggccaatctcaggcctagacccctgggggtcaccaaccctttcctcctcccacccccagaatgatcctcagtgtgctcacggggctgctgttcggcagcgatggctactacgtggcgctggcctggacctcatcggcgctcatgtacttcattgtgagtctggtgcacccccccattcccctgccttcacttgagggcaaacctccccctcctggccaggcttcagttctcctttcttccaggtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttgactttgtctgacccttgttcctggggcctgatggggagctacagatacctctgcgcctctgcattgcccaggggatcgggcttggggccgtctaggaagaaggtggacccagggagggcttcatgactttggtgaccttgatactgccttgtaagggtttcagcagcctcagctgggaaagagaagatggaaggaggctgctgaggggacctggaaggcgtctgatccctctggggggctccagcagggtctgtgggctagtggggtgagacaagccaggctggggattcagcttagggctgccccctatacagtccctgtaatcggcccccatctcctcttcaagctttccaggagcagaaccggggcccacatatttgcagtagtttattcatattttgtcacaaatggccggggagggggtgccggactcctccaggcgacatagaaaataggtccaag

SEQ ID NO: 65900 - DNA, 1300 bp, Homo sapiens
gcagagcctagaggggaggaggggaagaggaagggaggcgcctgggtaccccttctccttgtcctcgaggtgaggattgagggcccattctgctggctgggacccccgacggcccctcctcagccctagccaggaaggtctgcaggacctggggccccgagtgatgtgtggggtgatagggtggtgagtggggctgtgcatgcatttgggtgaatgtagcctgcttctgtgtgtgtgttgtgtgggtgtgtgaattgggtgtgtgcgccctgtagtcaggtgaggggcgagtgggtgcctggctcgggttgtcacccagtggtctaggtgtgcgcatgtgagtgagtccctttgtgggcaggtctctccctgtggagtctgaggagcctgggggtcagtttgcagtggggggtggggagatgtgcactgtggtcaggtgaaggtctggtatgtctctgggcttcactgcacgtgcaacgtgtatgtgcacgtgtgtgtcctgtggtggatgggtatgtggtgtgtgcgtgtgtgtgtgtatgtgtgtgtaccatgctacggttctgggagtctgtgccctggggacaggcgagggtctggagtttcctgggtgacaggcagtgtggccctccacggtgggtgggtctgtgatgagcatgtgttggaggggcgtggacaagtgtgtgtgcacctgacaggccttgcaggtcagctggcgctgtgctcccatgctgggtgatggggacaggctgtatctgggctgggctagggggtggttcctctcctcttgggcctctggaggcctggtaggtctggggtaggagaggtggccccttaaccccccttttgttgtttccacttttttcctcccctttttacccttcccctcgccccactttatccctacctgcttctctctccatggcacctgagggtgaggtggctaggctggcagccctgccagggagggtgtggcaagccctctgagccagggagtggcccctgctgcccagtagctgtgtcccacccccttgctcagcacagatggggagtggaggatggccctccatctgctccccaccccaagactcgcacctcccccgttcttgaggctccctctttctcatcaactcaaaagcctctgccgagacttctgagtccctatggaacaagggaccagagggagtctcagggtaatggtgatcatatttattcccatggccagaccctgtgctcacttcttcacacatatgatcttgttgaatcctcacaatagaaccagtttacagatgaggaaatt

SEQ ID NO: 65901 - DNA, 1039 bp, Homo sapiens
agtctcagggtcccacagggaggtgtgtgtcaccaaggagaccctcagctgggaggggccggtgctgaccttagtctggcttctgctagcacctccctccctccctccaccctccgccctccacccctccacccccactgcggcctctgccccactttgaagtcctaacataaataccatgtctgcttgggttccccttcccggcctggtcacagcccccagacctggcttccaccccagccagccccgtgggagtgtggtgccagcagacaagagggaggtctggaccacccagggaaggtggcgagccagagaccctgagacagagacagggagacaccggtggtggagggggagaccaaagtgagcagagaatggagagacagaccccagaaaccaagcaggggacgatcctgagggcaggagaggagagagacagagactccagagacagagagggaagagaggggagcagagagaaagagacccctgcagccagagagagacggagtgagaccctggggacagtaaggggcaggaggaagagggcacaagacaggaagcaaaggggaaagtaagaaccttcagagaaggttccagagatggggtggggggaggcagggacaggggtagcagggggaaggatgtggtggaaagagaagtgtccctggcaagtgggaccagccatctcgatttcctgggattggcaggggtgttgagggtgtcccaggacatgggactttcagtgctgaaaccaagaaagtggtcagcaaacctggacgagttggttgccctgggtggtaggcctctggcagacaccacggggaccacagtgtccactccacaggcaccccttgcacaggtgaggaacctgtgaccctgagaagggctgctcctacactggggcaggaggcctgggcccttctagctctgacacgtgctctgggactccctttcttgtgggcagatggggccagatgttcaggtcaggcttctgccacgagagggaagtggggtcccagctgggcccaggttggac

SEQ ID NO: 65902 - DNA, 1033 bp, Homo sapiens
tcatgtctgcacctgtcccagttgcctggcagattggcaaggcaggctggcagagcctgcgtgcgtgggaggcagccggcagcaccgccatgtgctgacgacctcacagccagactccccctggttagcactgagtgtcagaaccacccccagaacctcagttaagcaaataggttggtttccatggagacatggcatattttctccatggcaacctaaaatcctaaaacccaggttcaggaatgagtcatctatggacagtagagggtgctctcccacaaggctgacctgaggccaggggcagatgagcaactgaccacagagccaaaggtgcccccagagcatggctggggcctgtggggactgaggccgcttaaccacttcccgcccacgtgtgcaatgtgagtagctggtgaggctgcaggaggccgtgtgtggaggtggcatcccccagctggggccctcagagcagggctagcatggaggggacccctgacccccaaagcagggtccagaacagaggaggcgggcactggccaggcagggtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagttagtgaagttggcagggcagccaggtggggcagggaggggctgcgagaggagggcctatccggggatagagaaagtgggaaacccgggagtggggaagaggagagcaagggtcccagcccctggctccctgctcagatctgggtgcctgcccccaggccagcccaggacccactgtatgacgtgcccaatgccagcggcgggcaggcaggcgggccgcagcggccggggcgcgttgtgagcctgcgggagcgcctgctgctcacccggcccgt

SEQ ID NO: 65903 - DNA, 1020 bp, Homo sapiens
ctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtg

SEQ ID NO: 65904 - DNA, 1044 bp, Homo sapiens
acttcatcaccttcatgctgctctttgccgtttctaatggctacctggtgtccctcaccatgtgcctggcgcccaggtccggggcaatggggtggggtggggggctgggagtagggaggtgggttcagtctttgggaagggaccgcctgcaatggagggacggcccatcctgcttctggccagcccaaccctagctgtctgcaggccttgctggcgccccctactgggccaagccttaactgcaggggagagaactgggctagggaggtacccgcccaaccaagtagcccaggcactggttctggggccgcctcaatgtgcctcagtttccccatctgtaaaaaaaaatgggttgaactgtcatccctcagggcccatctaactgtaaaattctcagttgaaggagagctaaggttttgaccaaaaacaaggtcatgggctatttcctcaaggggcaatggagtggagaatccagagagaatgaagctggcagggcagacaggctgagagcactgtggaaagggcaggctgtggaatctggaatcccatcatgttagactcagaggccctgagagacatccttatccagcagcctcatttacagaccaggaaactgaggcccggaaagaaggggccagttatggtgacagaggggttgggtcagagcccagactggatgggcagagggcagtggagctgggtccagatttagacccagcattttctaagagctcctgttcccgggtgttctaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaaga

SEQ ID NO: 65905 - DNA, 2078 bp, Homo sapiens
acctcaggtgatccacccgccttttcctcccaaagtgctgggattataggcatgaaccactgcgcctgaccccgatttatttttttcttgtgattctgtggtctttttgagggatgccattggaaagtgagatgaaggaagcagggggcaagacattagaagttccctgggatggggcagtaggaagagagaatctcatatttcttttttctgttaagcctgacaggacatttgaaattaagattggacagcccactgtttcctacttcctgaaggcagcagctgggattgaaaagggggcccggcaaacaggtgagggccagggtaagcatctgagattctgggggctccagaaggaagcagtaacacctgaagagccacttgttccttcctcccagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggagtaagtatcctggcatgtgcagtgtgacgagagggcccagaaagctctggactcgggcagagctgagagggcccattgcagtgggaaagtcagcttttaagtcaagggaccctagattctagaggatggggtgggggtgggaggccacattcattgatctggaatactcttattgggcacctgttatgtattagacgttgttctgcaaatgttctaagaaatggaaagatctccatgaaggatccaagtgggagaagttcagtgtgacctgggtctgtcgtcctagaggcaagtggagaatggtatgagggaaggaccagtgcgaaggacttttgagctgtgtcaggttcatgcttgctcctgaggcaaacagggacccctgtcatggggcttcggatgacttcaggaattgtttcattgaagtaagatgttgggtgggagggtgtctggcctagacaaccgccgggacagagatagcattcaaccctttactggcctcttgctgctgtgttacatcccatgtcaaggctgacaattgattatttcccaagaagaatggggttaagcatggagcagacacagacttgaattttctcaaatctttttttttttactgggagcatggagatgggtaaatctgacccctgtcctgggagagacacacatgctcagccccgtgacgtcattgtacagcatattctggggcacagagtaccccagttaatctggactggggcctggctgatgcctcaaaggatgagtagggatttaataagggaacaaaagataggggtgttgggggttgggagatgttgtccctggagaggaaatgagcaaaggtatggaggctgggaagtcagggaggcagaaggggccaggcaagctgggcttggagacaggggccccttcaagcccctgcaagacatagggtcctgtgagctcccactggtgaccaatcatgcgccaaccatttgtcttttttcacttgcagcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgt

SEQ ID NO: 65906 - DNA, 1035 bp, Homo sapiens
cgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagtgagtgagccccaggaagggaccaactcttcatctgtgaggcaaggggtaggcttgggaggtgcagcatcttgaggtgatgaaccagcccacagtaatccaaatggtggtcctggcagttagcaaccccacctaactgatgagcaaagtgaggcccagagagacgctcaagtcatgcagcttcaatgccagtcctctctgggccgcctctgaacttgaaggtagcgggggcagtgcctctggcacatggcctgctggggggcccctgggggatgtgatctgatccctcatgtggtcccaggagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtaggtggcccgctccattccccacccctatccttgccaggccctcacaagctgcccatccccctgcccaagccaggagatgatctccagtccttctgccccagggagccccaacaggctccatatcagggaatcccaggcccagggggttcttagcatgagccacttgtcccacagacaggcagacagaccagggtccccaagcatagcatgcataccactggaggtccagggggtgatgcgatcaaggcacacacagacatactgtgcagtcccaggtggcttcaaggctgctggcagcttaaaaaaaatcacaccttcttatgagagtgacacttggcccatgtgtgagcagt

SEQ ID NO: 65907 - DNA, 1030 bp, Homo sapiens
ggcaatgctgctccccactgcaggcctcagttttgtcatctgtagaatggtaagcatgttgggtcgaatgctttctgaatgccctcccagatctgacattctgtacacaggatgccatgtgctgatggagggaaggagaggaaggctggaggtggagggagctgaggaggggatggcagggaaggaggggggtcccaggtttcccacctctggaggccacatccgttgcatgggatgaggaccttggcaagccttaggggtgggccagccagagagaggcctgggcagagctgcagcaacactggagatgagcatgtttgtttgttttataactttttcccctggaggtagatggaggggtaaggggtagaggctgctgaaaggagggaggggcgggaagcctgggaatatgacgtccctgcagccctgaccttggcaactcctctttctcatgtcccctgtcttccccaacagggaatcaccacctatttctctgggaattgtaccatggaagatgccaaattggcccaggactttctggactcacaggtttggggttaggggagctcaaggtagcagaggtttggtggggttcctagtcccagccccctcacaactggtgaccactcctgggtctctgcttgactactccctgtgtactagggaaggcgcgacccctgcccaccccaggctatagagcctaatgacagcctcagggcagggcgaggaaccaggacctcaggccacaggggtgtgaggctccggggtccatgtgtcagtggtgctcccagctcagccactcaccagccatgtgatcagtttccatgtctgtgaagtggtacccacctccagtagccctgggttcgcagaggccgtgcagtgcctggcacagtggttgcagtcagtgcttagtagaagtgcacagtgtcctgagcagagcaggagagtcggccctgggctgcccactcccactctctcccactcctgctcccagccaacccagaaggcccagcctgctttgcctccatgc

SEQ ID NO: 65908 - DNA, 1047 bp, Homo sapiens
cccagctaattttgtattttgagtagagacagggtttcaccatgttggccagactggtcacgaacttcagacctcaggcgatctgcccgtctcagcctcccaaagtgctgggattacaggcgtaagccaccatgcccggctgatatatatttttttgaagttgagagtttatgctcatgtctgttggctacagggagccattgaaaatcttagagtgaaagagtgctatggggaaaagccggctgaggtgtcttactcaggccttttctctgagtgaggcctcttactccagccttttctcttgaatgacaccttctttccccagagccttccctggactctgaggtgacttccaagctgaagagctatgaattccggggaagccctttccaggtgacccggggggactacgcgcccatcctccagaaggtggtggagcagctggagaaagccaaggttggactggctgggggctgaggggtgcgggctgaggacccctctgggcagcagagcgggtgtggaggtgggtgggtggcccgaggctgaccgacccccgctcacctcaggcctatgcagccaacagccaccaggggcagatgctggcccagtatatagagagcttcacccagggctccatcgaggcccacaagaggggctcccgcttctggatccaggacaaaggccccatcgtggagaggtgaggcgccagctccaccccacctgccccctcctgcctgcccctcctccacctctgcccttctctcccccagttacatcgggttcatcgagagctaccgcgacccctttggttcccgaggagaatttgaaggtaacttcctcagggaggaggtcagtcacagtcccttcccccacatccaagtccacgtttccagtgtcccctgatggttctccccacccccgctcagccataaccataacagtaagaacagccatggtaaataaacaccgtttacaatgtattgggcactgttgtaagaagcttagctatattaactaatttagagtccatcatcccatgaggatatt

SEQ ID NO: 65909 - DNA, 1048 bp, Homo sapiens
ggcgcctttccctcacccaccgtgtgttctgcaggacgaaaaaggagcattcaactttgaccaggaaacagtgatcaacccagagacgggcgagcaggtgagggaggcctcagcagagccccagggtactgggagggtgggcacaggtggggcagtggccaccttaagcccgacagtggagctccttttccagattcagagctggtatcggagcggggagacctgggatagcaagttcagcaccatcgcctccagctacgaagagtgccgggctgagagcgtgggtctctacctctgtctccacccgcaagtgctggagtaagagcagcagggccgaggggcgggctgtcccgctgcagtggccagccctgggggcgtggagggtgggtggtagtggccagtgggatggggacagggcagcctctgaccatcctgccacctgcctgcccctctcacaggatctttggctttgagggggctgatgcggaggacgtgatctacgtgaactggctcaacatggttcgggccgggctgctcgctctggagttctacacacctgaggccttcaactggcgacaggtagggcctaggtggagccccctggaggcggaagggagcctgcagtgggtgccaagatcagggtgcaaggatgggaccactgtacctttaaggcagatgaactgggtttaatgctagactccactgtttgggaggcaagtcacatcactcttgtgagccccagagttcctctctgtgaaatgggagtaggactctccccggccaccatttcacggtgaatcagatgaggtgactttattaggactcctcgcagttgacgcactctctgccacacacaattctaaacgccctccatgaattaactaccccaggaggtaggtgctattgttaccctcattttagagatgaggaagtcgaggcacaaggagatgaagcaacttgccactaagtggcagagccaggattcgcatccatacagtgcctacagggccattcagtgccacggctcagttatgtgtcctttggatat

SEQ ID NO: 65910 - DNA, 1231 bp, Homo sapiens
gatctcctgaccttgtgatccgcccgcctcggcctcccaaagtgctgggattacaggtgtgagccaccgcatcccaccagcaatagaaactttttgacaaaatcaaataggtgtggtttgaggaggcgatgtgacgtcattcagggtccagaaatgtgggtctgagtcctggctcttccgttattagctgtgtgcccctaaggaagtccctttacctctctgggcctctgttttatcatctgtaaactggggataatgatgcctacttggttccccttttgagcacaaacaaggttgtggaggagaaagtgtttggggaccctggagggggtagctgctgtcctcagcaggggatctggagcagcagggatcacagtgggtgacatggggagcatgggcaccaggtcccgcctggaaatggcctccctgtctcctagggcagcctgccctctctgtgagaagaggaaggaggaagcatttgaggggaggagaataagcagaaaaggacccgcagggttggggagaatgacaataacagttgccagttaatgggcaactgggaccaaggaccaagcctgggaccaaggaccaagccaaggaccaagcctaggaccaagcacttgatacgggctacaaatgctgtctttcccctgctccggcaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtaagcaaaggcctctcgtctggatgggtccccaccaacctctccaggggcactgagtgttaccaggcacggagaataagctgtgagcagtttcttatgctgcagtgaggaaaggtagccagtaaacatgtaagcgcaccgggtgcctcacgcctgtgatcccagcactgtgggaggccaaggagggcagatcacttgagctcaggagttcgagactagcctgggcaacatggcaaaacctcgtctctacaaaaaatacaaaaattagccaggtatggtagtgcgcacctgtagttccagctactctggaggcggaagtgggaggatcacttgagcctgaggggtcgaggctgcagtaagccatgattgcaccactacactccagcctg

SEQ ID NO: 65911 - DNA, 1015 bp, Homo sapiens
agacagatgaagtcgttgctgaattgtgagcttcaggacaccaaggactgtatctgtttcacctagtgtggcacctggtgtcttttattatttatttatttatttatttattttgaggtggaatctcactgtcacccaggctggagtgcagtggcacgatctctgctcaccgcaacctctgccacccgggttcaagcaattctccagcctcagcctcccgagtagctgggactacaggctcatgccaccacgcccagctaatttttttgtatgtttagtataaacagtgtttcatcatgttggccaagctggtctcaaactcctgacctcaggtgatcctcccacctcagcctaccaaggtgctaggattacaggcatgagccaccatgcccagcctaaatctttatttgattgactgaatgaacgaaagcagcaatgcatttaatactccccctgtagtatttccttcctcacagggttactgtaaagagtaaattaagtaattaacctaaaacgtagagcacaggtttttttggcagagctcagtaagaaacagctgctgctgtaattgtgattattaagatttttatgatgattcagtttccctattcagacctttccctgctgttttctctccatctcctccccaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgt

SEQ ID NO: 65912 - DNA, 1060 bp, Homo sapiens
gtcagatagggaaaccgaggcctaagatgtgcatatgtgtgtctggaggtcgctcggtgagccagtggcggagcctggacttgtacccagacgttctgtaccttatgttcagagtgacctgtaccagcttcctcaaagtttttttttcccctcccatgggactcactccccaactgtctttcccccacttccagcaatgaggccaattcgaagtggttggatgcgcactacgacccaatggccaatatccacaccttttctgcctgcctaggtgagtctctggaaccaggaaccctgggttctagtgggatggggagtcagacaatggtcctgtagtgaagcctctgggattctgagactctggttttggcccttttgttttccagcgctggcagatttacatggggatggggaatacaaggtaagcatatcaccctagccaggagagttgagggtaggggggtgtacccagaaatgagatttcctgacggctgaaaataggcccagcatactctggaattcacatatactgtgaaaaagcacatttagcgttaaattttgtttttatatggaaagtgaagagaacttattgatttcataatacagactgcagaaagtaaagcagatcaaatatttctggggattctactaagacaaagcctcttagttaacctgatttctttgttggaagggcaaatcccttggttgggggtgggcactagaatctggagggaaagtaaaaaggagggaagtgaacgtttgatgtttatcaaaagattttaagatgggccatgagctgtcaatttttgaagctggataatgggatatatggggactcattatatgagtctctctacttttgtatgtgaatgaaaattttccatagtaaaaatgttacattttaaatttaattttaaggccagcaatcccagcactttgggaggctgaggtgggtggatcgcttgagcttaggcattcgagaccagcctgtccaacatggtgaaacaccatctctactaaaaatacaaaaattagccgggcatggtgatgggcacctgta

SEQ ID NO: 65913 - DNA, 1029 bp, Homo sapiens
tacttgggaggctgaggcagaagaatcacttgaacctgggaggcaaaggttgcagtgaactgagatcgcgccactgcactccagcctgggccacagagcaagactctgtctcaaaacaaaaaaacaaaacaacaaaaataaataaataattacaaatacaaatagaaaaattagccaagcatggtggtgcatgcctataatcgcatctactgggaaggccgaggcagaatcacttgaacccaggaggcagaggttgcagtgagctggagatcacaccactgcactccagcctgggcaatgaagtgagactccatctcaaaaaaaaagtatgtcacaagtgaaactgtgtatgtgtgtgtaaattgtcctgtgtcacagtataaaatttgcaaacaactggcttgggccataggtgctgggagggccggtggtatgctcgttgaaagaagggtaaagaggagagaactgacagaaaaggcgggttggagtcaaatgtggaaggccttcagtgtcctaagaaagagaacaaaagccattggaggttttctatcagagaccagacatatttgtgtttttgaaaggtagcaaaggcagcattgtgaagggcagactggggagaaagacccgaaagacgagtctgggagatctattaggaggttgaccccaaaagtgagggccagtgatatttggtctggaactgaggtagtgagattggaggggagatgagaaatataggaaatatttcagaggcagcgattccccaggcctgtctctatcacttctcacctattatatctggggcctcccctacccatcccctgtcttgctttcctctccaagatatttccccaactaaactctgacgtctccacataggatgcagtgaccagcctttgctttggccggtacgggcgggaggacaacaccctcatcatgaccactcgaggtgagtggagtcagacctggcaagggctttgaagtcgggagtgaagggacaggcctgcttctggggaaagaggaggaggtgga

SEQ ID NO: 65914 - DNA, 1141 bp, Homo sapiens
cccagcctcctgagtagctgggattacaggcgcctgccaccacgtctggctaatttttgtattttttagtagagacggggttttaccgtgttgtcaaggctggtctcaaattcctgacctcaggtgatctatctgcttcgcccccccaaagtgctgggattacaggtgtgagccaccgcatccagccaagaatggcctctttaatgtctgtgagctccccaagggcagagacaccctctagtgcctggcaccgcctccagggctgaggaggtgctcaccaagtctgtgatgcaggaatgaagccgtatcccaagtagggggctgcgtctgcccagtttaccagtgcgttcttgtcacccagcacgggctggccagcgagtatcgacacagggtttgctgagcggaggaatgagccctgctttgtggtggaggggagcaggtggcaggaaagccggaccccactgcccctccctgaccctctctgctcttttattgcaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcct

SEQ ID NO: 65915 - DNA, 1020 bp, Homo sapiens
tggcttgagagaggtctcaggactggggatgttagggctggaagagacctcagacctgtagtgctagaactagaagggcctgggacatcttgtttagcctgcatttacttgtaaagaaattgaggcttagccagggcaaatggctgttgccacttccgcaggatgggctctggggcagccctgtgcacaatatggggcatctgagctgctgggggaactgacgctgtggttccttcctgcagttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggtggggagcctgggaggcctctgcacagaggcaggggccctggtattgggctggggagtacagcccattctggtgggagacgggctttctggcctgggggacccagccccagtgtcagtgatggccagtaagggcagcttggtattcacccgggggtgcagtatggaaactggtgtgttgagacaagtgcagcgttctggctggagaattgggagattcctggagttgttgagagaggagaaagactcgtgggagtctctgcatggcgggatgtggaagtgcattctaggagcatttctaagtgagagaagcaataggaacaaaggcttggagagtgggcagggaattgtgagaattaaggccagattggtaggggaggcctggctggtggggtcctgagaactggtgtgaggagatggctcctatttgactggacagtggggagccagtgaaagtgacaggcaggagaaggcccagttatgggaagctggggagggcag

SEQ ID NO: 65916 - DNA, 1029 bp, Homo sapiens
tctccccaccccagccctactggctctcccaaccctgctaaccccaagcgtgggcctgcagagcctccctctgctcagagtagccctggcttcctcccagcctcctcctgtccatccccacccatcacctgcccttctgccaacccatgctcctgtcagtcattgattcactcatcattcatccatttacttctgcatcgatccattcacttgtatttaagtagtcacatggccctctgctctgtgccaacctatactagcccctggactcagaaatcaaccatcccacttcttctctgacttgtggggactaccccatcctgctttcgtagttgtcaaagtcacccccacctacactctggccacagcctgggtgtgggtggagaggggtgggtgagctgggcaggtcagcgcagagctgtctgccttgcccctgcctggccctgtcagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggtgagctctacacacattccctaggtgaccttgaggtccgtatcccatctgtacaatgggcaaaccgtgatggagcgcacccctgcctgctccacaggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggtaggtagacctacctcatggggctggactgtctcttggggtggagattggtgtgcaggggcaggaggggaggttcttggcaaaatgcacaggacaagggtag

SEQ ID NO: 65917 - DNA, 1267 bp, Homo sapiens
tcaaccgcggccgggctgcggggacgcgggccgtgctgggccttgtgcgcggccgcgtccgccgggtgaggacgcgccgggggcgggggcgccaggcccgggtccaagggataggagctttgacctaacattgggatggggcctgcccgctggacgaaccgatctctggtgatggggaatgggcagcgccgcacgggcggggccttgggcgccgtcaagggccgactgtgcccgcctcacctactcctctctccaggcgggtcaggggtcgctgtactccctggaggccaccctggaggagccaccctgcaacgaccccatggtgtgccggctccccgtgtccaagaaaaccctggtgagtgatgaggctcttggggttccccgccccgaggccgagtaaagcagcagttggatgatgacgggtcaggtcaagacgcagggatctgaggtagctgctgccccaccttgagccacttcccaggccccgagggctggaaaccaagatgctatgaaggggaggatgccccggtgcaggccgtgcctcactgtccactgtgatggggtgattgccttaggggtggctctcatctgaggagcctccagctccatcttggccagatcttgctccccagatccagatccaggcccccagagcagcttcttcctctccctccagctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggtgaggagccctcagcttgaggagccctcagcttgaggagccagccgctgcctcatcacccttctcccttccctctggagtgggtttctctggtcagcctaaagactggtctgcctatccaggacttgcctgtgaagatggcttcaatcttcaagaactttgtcattacctataaccggacatatgagtcaaaggaaggtgaggacccagccttggctgtacctgttcctatcagaacaggactttccccccaacttggcaccttggtgtgtgggaggagaaagacaagaggcagtgtacctgttcaaggaccccataattcctgagctctccctaagccttcccagcctggcagccaccctgagtacctgg

SEQ ID NO: 65918 - DNA, 1016 bp, Homo sapiens
agtcgggcctcaggaggcactcccgctgctatcccgctgccggccagcagcttggccacctggctgcacagcgacgccaccgtcagcttcgccagagggaaggactgcagaatccggccctcctgcggggggcgcttctgaggctctggggacgtcgtcctagtggggaagagcgacagcggacgcagcagccggtggtaaaaccgctggagctcaggctcgggcttcgggggctccatcatagagccggcggccgccaccgtccaggaacagaaagccgaggggttactaaggcaaccaggagcccgacggcccgagtgcgcctgcgcggccgccacccggtggctgacgaagcagggccttgcgtgcgcacgcactaggaggaggagttaagggtggctttagaggctcagtccccgcgacgccgcgctggttggtgctcctgcgccggaggagttctgcgtctcggggtggtgactgggtccagaatggcttcggattcggggaaccaggggaccctctgcacggtgagggtcgaggcttcgtgtggagcctcgccgggcagagagcctcggcccctgggatgatcgttaccttgggaagaggagaaggagtgggcacttgggttggggcctggggccatgggatgaaactagggtgcgagggtagcaggggccctgcgtgagtgttggggggtgactcccatggtcctggaatggtcatgagagatcatgaagaaggtgcttgaagaggggttaagtggggcttgttcccagacccttgcggtggtcatagggtaggtggtgaaacaaagtcataccaaggcacttccccagcgatcatcggttggtccctgccgcccttgcagttggagttcgcggtgcagatgacctgtcagagctgtgtggacgcggtgcgcaaatccctgcaaggggtggcaggtaagaacagggtaaacttttctgcagacagtccagaagcctctgggagggaccaggcgaatctattaggcgaac

SEQ ID NO: 65919 - DNA, 1051 bp, Homo sapiens
catgggaagtttggtggaaatggggatggagaattgctgtctgtttttctgttccctgctgccagcactgggtgccagcctctgttgccctcttccctctctttcttgccaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaact

SEQ ID NO: 65920 - DNA, 1048 bp, Homo sapiens
actgagctaactggaggctgagaagcagagctgggcaattgcctcgccggaaaaacagtctgatccaatgggaatgactgcacaggcaggggaaacttccactggctcttttcagcccactgtcatcctgcccaggatttcagttccagggagggagtgttcagatggtccgggacttcctggaccactttccacttccagacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctgaaggtaaggtggaaaagaaggtgggcacccttcctaacagggtccatcatctgaagctgtcgtctcccctcaaaggtgtgggatgtgattggccgcagcctgattattgatgagggagaagatgacctgggccggggaggccatcccttatccaagatcacagggaactccggggagaggtgagtggtgtcggcccctgtaggaggctgtgctctgcggatggtgcatgaggaacccaggggtgggggccaaacaggtacccacccctgaccacacattcttctgcaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaa

SEQ ID NO: 65921 - DNA, 5067 bp, Homo sapiens
cgcggcaacccccaggcgcgggtttggacagggcttccagaatgggaggagccctgacttccaattgtacaaagttttcctgggagcccgccggtcccagccccacccgggccagagaccgccttacagactaggcctctctgccgccggcgccgctcgcgcgcgttctcctctcttcagccctccctcttcttcccaaccccctctcccgccacgggctgtggcggttggtcgtccctttcccaccccctcagctaacgagcgggctctaggccctctgggattggctgtgcctgagcacatcttccctcagcgtttctgattggtcgctggacgcgcgggatgcgagtccccattggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtaacgcggaggcgcgctcgggggcgggggcgcgctcggggcactctgcctgttagccacgccccttacccgggggtcggtcactgcgcggttgggaggggtggggaagtgcgcgggagcaggtcggaggtgttgggggcgcgttgggtagagccaccctcctcccctgcggtccaggaaccgtccaccaagtaggaggaagcggctctgggtgggtgcggcggccactgcgagccaagctacggggccggggacgcgcctgagagccttgcgagtgttccgggggcgcgccttctcctggtctcctgggcctggcacccagcggaaattgggaagtgacgggcacaagccggatcatgaagcggggaagatttctccacttccccacttcctctccagacgtcggtcagagcaagggaagagggaaaaggtgggggctgacgccccaaggccgccctcctgttccctcccgatgaatgtgctcaagcggaaggtaacggggcccttggacgtttctcgggctggggtcttttagtcttgtctggcatgggtctactcatgggcacagttacacgtgggtacgagaggggccccttccgaatcactttggcctttcaatattaggtaggttaggcgtggcagctctgtgcttttctcctccctcaaacttggggtttttctttgggctcgattttacatctgtcaactggaaaccccagccttttgcatgtgcaagaaagcttgttttatgaagtccccttctgcgtagtctttacatgccaagccagtgccctagggcagtgtcattcttttataagcttggtgactttgcaggggggcatactctggctgagggggtcctggggaggggtctgtgagagctcttcattaaacagtggctaaacacggtttactgaatcagtagtagtcattgcttgagtagtctgattctcagggcagatcccggtgccttttcttcgagaaaaatgtgtcaccataatttaagcctgactagggacccagttgactttttcatagcttgagtttttatcccttaagctctttatcttttacattggcaagatttggtgggacagccgttgtgtatgtggccagtctctgctccacttgggaacagatcagagttaactttgccctgtcattttggaagatgcagcctgggagtatctgatgccctactcctggtgggttcatacctgctcataccctgtgtgagaagtttcagggataggaaataaatgtgggtgcaagtgcttatttatcccaccaagatatttcatttgctgtcctggaaaggcacatgtttggggccattcctagtcctttaagtgggggaaatataaagggtcatagtgtccactactaggaacaagtccttgttctgcattaatactgcattctattttcctcaactcaggttatacaagtccacgactatccggaatcgggctttcctgctgggtgctctgaggcaggctgtatggtgcatggatttttgcttttgtttagagtaaaagagtggtgggggagggtctcagattgggtacttgtccagcaaaagggtggggtatatgagtctcatttgtgagagttttgtgtttaattgacttaccaagtttcttttgtggttgttaggtagagtggctactaggttgagagtctagagtcaaacatctgaagggacagtctccctggaactcaggcttcttgctggctttcaggtggtagagaaagtcaaaaatttgcctgaaatttgcttgggacccaacaccaagtgacgatgcgggtgaagtgcataactgcacatgaatttttagaactcctggctgactccttgtgagagttagacggagttttgtgcatcttgttcctttgtaaacatttgattagcaaaaatgcattgacttactccgggagtggtggtcaactatttgcagttacattgttgtgtaacagagctcctgacatacttcgatgtaagagactgggaaagatttgaacatcatatcctccactgatgtctttttatctgtttgtgatgacggaaagtgagggttgaaagttgggagtgtagtagaagcgactggctctctaaagagcgtactcatttcttatgctgggaatggtcatttgattgagtctccttgtgttggctgacagggctttgaaaagcacagaagcttggtgttgcaccagacaaccagctctgttttatttcacaggaaaaaaaaacaacatagttgcttggttactccaggagcttagataggatttgtagaacagaaatctcaatagcaacagtggattgtaaccactccacagcttcctcctattgggtgttcaaagatgaacagcttccggaaacatgtacagacttgtggggagatctgaaagacaaaagaggaaaatatcttctcttcatttttgtgagtgactgtttcttcttcctatacagagctctgtagtttcaagtttaagattttttctttttctttttttttttttttagacggagtctggctctgtcgcccaggctggagtgcactggcgccatctcggctcactgcaagctccgcctcctgggttcacgccattctcctgcctcagcctcccgagtagctgggactacaggcgcccgccaccacacccagctaattttttgtatttttagtagagacggggtttcactgtgttagccaggatggtctcgatctcctgaccttgtgatccgcctgcctcagcctcccaaagtgctgggattacaggcgcaagccaccgcgcctagccctcaagtttaagatttttagtcttaagataggagaacttgtttttctggattcacttaactttgttactggaggacttgtgatgccaccagaccatttggagatctctgtaaaacattacttgatagtcccaatgcagtgatttccttcagagtttccttgaattagatctgtgggcaagaaggttcctggaatttttcagatctctggttttaatggtcttaggagtacttgggtgttagggcatctttaatctagctaggtctgtgctttgcacttactgtgatggggcttatcactacaggatgcagttgagttagctgggcaacctattcacacttttcccctccagtgtcaggcttagaaacttcctgatacaatttggttataattgtatcagatggatttttaaattttgtatttatttttatgttatttatatatttattatttttttttatgagacagagtctcattctgttgcccaggctggagtgcagtggtgagatcttggctcactgcaacctccgtctcctgggttcaagcaattctcctgcctcagcctctcaagtagctgggtctacaggccaccacacctggctaatttttgaatttttagtagagacagggtttcactatgttggccaggctggtcttgaactcctgacctcaggtgatcttcctgcctcggcctcccaaagtgttgggattacaggtgtgagccaccatgcccggcttggatttttaaattttttgatcagttataaaactcatttgggtagtcatttgaatcatacatgtgaaatctcaattttcagatttcaccacttggtctgaataaaactcactaaggagggaaacagacagtgggatgtccaaatgctcttgtaagcccatggaagtttttgtctcattctagtgtcaggaagttgtggatagaataatcaggactgttagaattgttccttaatattccctcagaatgtctggaggcccctccctgcaacaagtgcctatgagctccagcaactctgcttccccttcactttgggcctttctgcttgccatctccaggtggttttgctattcccgaggattacctcagcctctggttttatttttattttttatttaaagattttttaaaatatttattcattctttagggtctcgctttgttgctcaggccagagtgcagtggcgtgattgtggctcactgtagtcttgacctcctgagctcaagccatccttccacctcagtctcccaaagtattaggattacaggagggagccaccattcctggcccagcctctgcttttaaagggctcttaggccacatgctggttttttgtgttttttttttaagcttactctattcaaagtggagatgaaggatcacaggacaactttagtgccttatgcctaggcc

SEQ ID NO: 65922 - DNA, 3795 bp, Homo sapiens
ttcatcctttttgcccaggctggagtacagtggcacgatcttggctcactgcaacctccgcctcccgggttaaagtgattctcctgcctcggcttcttgagtagctgggattacaggcacatgccaccacagccggctaatttaatatttttagtaaagacggcgtttcaccttgttggtcaggctggtcttgaactcctgacctcaggtggtccgcctgcctcggcctccccaaagtgctgggattatggtgtgagtcattgcgcctggtctcattgtgttcttttatcgtctgtgccagcttctaagtttgcatggcattgtgttttgcttgagatgaaagataatattctatagggaaataaatctctggttatttctaggtttgaataatcataattccttattctgtagctgttcatatcttacaaggcacttttgtcttttctcttgaacctcttaactttgaggtaggtaggatagatgtgtcggaggaaatacatggtaagtttctttttattttttttgagacggagttttgcgcttgtcacccaggctggagtgcagtgatcttggctcactgcagcctccttctttttcttccgggttcaagtgattctcctccctcagcctctggagtagctgggattacaggtgccagccaccacgccctggtaatttttgtatttttagtagagacgtggtttcaccatgttggccaggctggtctggaattcctgacctcaggtgatccacccacctgggcttcctaaagtgttgggattacatgcgtgagccaccgtgcttggctagtttcttttctttttttctttttttttttttttgaaatggagtcttgctgtgtcacccagactggagtacggtggtgccatttcggctcactgcaacttccacctcccaggttcaagtgattctcctgccccagagcctcctgagtagctggaattataggtgtgcaccaccacacctagctaatttttgtatttttagtagagacagggtttcaccatgttggtcaggctgatcttgaactcctgatctcaggtgatctgcctgccttggcctcccaaagccctggcatgagcccctgtacctgcctaaatggtaagtttcctaagatcttataacaagtcagtgatacctgggtctggaactgagaccattgaatttctaattaaggatcccttttgtgctatgccacacttctgacttctacttattgattgcattttttccccattatccttagtcttgtgtcattgtcttcaaatccagggaaatgacttgttctgtaggagcagctagataaggcatcccagtacgaaagtttctaaaaatgaggacccttgtttggaggttattaagaatgtttcttatcttagtattgtcatctgggtagctctttgtttcttaagctgatgtgacagatagcatcctggtacttggatgctatctaagagtagccacaggtcgagaatggagctaagcttagagccttatttcctaggggcaggattctctccttcagattctgcctgtgctttgtgagtgtggacatgagaatttctttccattccttcattccctgaagttttctccttctgtgtagtagataagtatagctttgagaccggcatcctgtcttctcctaccacagcttattcaggtcataatgagagctgcaggggtaacctggttagcagagcctgttagctgcagtaattgcagcttcataccttataggtgagaaaccagatctttctggtaagcagtctgctctgtgaacagaagcccaaggtgtaaggtatacctctgtcccttaaagaggaaacagtggaggatgcagtgtggtctgggacagggggattgggcatgaactcagccagtgggcttagtttctattcccatacctcattggcttacacagggtccatcttctctgcttctaagcctaaatttttagtcatattacacagtcctgccttataccttgacttctcagggatagattatgtagcaaaggggcattggaagagctgtgattctggtcctgactctaacacactttgagtggggcaagccatataaaaactcttgagcatgtatgtccacctgttaaatggaggtaatgattctttgccctgcctacctcacaggattgtgaggcccaaatgaggtcctcctgtacctaagagtgctttgaaaacttgggaagtactgtgaaaaagcggagagatcatattggaatgttgtgaactgcttgcttgttgcagtctatctctcttgccttaattggacatgggctgagagatgggtcataccaaaacgtgagtggtcatttccagtgtttgagagttaggcctcaaaagtgagctaggcctcaaaggtgtttggtgagtttgggttgagaacactgaagaactgagtgatctaggaacgctttctgcattttgttctgctggtttgtacttacaggagatgtgaagatttttatcctgtgttgcagttcatctttgctccttcttctctcaccaggaagttgggtgagatggcagggtttgtaaaggggagaatgggaagaaggctgtaggcaaagatgactgcttgggacagtcagaagctttgttatatgggagctacattttatgacatactcctggagaggagggtttggaggccttggaggtagctggcaacagctgggtgctgttgtgtgtccaatttgggacccatcaggtagcatgccctgcccccctaattgctaaccctctgtctgctgctttatcagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcc

SEQ ID NO: 65923 - DNA, 4645 bp, Homo sapiens
agacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtagtccctttggcattcactggctaaaggcaagtttacgaggtgcgtccactctgggaagttggggacctcgctttcatccgccgttctgttgataaacaaccaaggtctttctctgcagggcccaggggcggagatagtttgctgtggtgtgggaatgtagaccaaaatccaccttggctagttcagaggggaggacttcagtggagggtttgatttcccactgagttgaagccaggcttgatttttttggcctggatagggtgatgagccttctgacaaaaggagaccaatctcttggagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctggttgtcattgtcttgattgcattcagtgtcaaaggagccaatttgacatccaggaagacatgatagctaaagggaaggcagtcagagaacccaggactggtgaggaaaggggtttgaatgtcggaattagaaggattgccctgtggcccagaaggatttagctcatcgtcgtcctgctagcctgccatctttcagactttccagggcaggtggcctggtcctcagccctcaacttgagttagtcacaccaaaatgcagtaaatgatgcccattttcctctgcctgtgcttgaccattttcactgacttttctccagttcaggaataacctgtgttccaatgggatggttctggggtttggcctcttaggaagtggggaatgggctgctgtggtatttacaggctagtagatcctttaggcagtaggctggaatgagtgctggggctgggacccagaaaggaaccagtagtggagtgggggtaatggcgttgcctgatactgccctatggttggaataaggaagggcagagaaaacttgaagcaggtatggggcattctggccatagagctcgtattttgcctgttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaa

SEQ ID NO: 65924 - DNA, 1056 bp, Homo sapiens
cgaactcccgacctcaggtgatctgcccatctcagcctcccaaagtgatgggattacaggcatgagccactgcgcccggattaattggccttttagttaaaaatattttttttaaggggcaagcattaagttcttttagtactcagtaaaatacaggtaggtgtatatcagtatgaagacacttgaactacaaacttctctacccaaagcttcattttgttccagttgtcaaagtggtgatcaaaatctgttagcttgggttacctctggctgttgggtacctgcttttctgtttgaggaagactggaacatgtactaggtgatgagtaaaggtgcgtgttttcagtactgataagtgtccaggtttttaacctgatagtgactgaagatccgaagtcatttccctcctttcggctatcaagaagttaactcatacattcattcattcatttacttgttaacttagtcaacaaatatttgagggtcttaccatgtgccaagtacagttctaacactgaggatataatatagaattaataacaggcttttttagaataagtataggatttcaagtggtagtaagtattcagaaagacaacatggagtcataggatagagttccaaggtagggttggggtgggtgatgtttttagatcggtggctggtgtaagaacctgaataaagaatattctagtctaaatgagcttgggataaggccagtatgtctgaagggagcacagctggtggtcaagggcggtggttgttagaaacatattgggaaattccggcaagaaccagattggggtaaggtcttaacggtgcaaggagaggagtttgaatttatttatttatttattttttgagatggagtttcactcttgtagcccaggctggagtgcaatggcgcgatctcggctcacagcaatctccgcctcccggttcaagccattctcctgcctcagcctctggagtagctgggattacaggcatgcgccaccacgtccacctaattttgtatttttagtagagacggggtttctccatgttggtcaggct

SEQ ID NO: 65925 - DNA, 11875 bp, Homo sapiens
gcgcaggcatttcagaccggtctgggcaacaaagagttcgtctctataataaattaaaaaaatagagaggcctggtggcacacacgtgtagtcacagctacttgggaggctgaggagttccaggctgcagtgagctatggatagtgccactgtactccactctgggtgacactgcaagaactgtctcaaaaaaaggcagggagattatttaatgcggttcattcaggatgagcttgtaaagtgttacatagctaactagacctagttgggtttcagaggtcaaatcaagtaattaggttttgggctgcatgcagaggtggttagtagttttgatgtccgcacactgggcttgaactgtgatcctgagatttatgttcccagtctccttcaatctggagagattattacttacaatgagttgatccttgttatactttggtattttggaagaaagttttatccccagacatgttgagacaagagatctaactgaaggagatgagaggatttctataccatatgcgttaccttctaatgctggccacctctgaagggcacgtggcagctgagacgaaattgattttcttcatcactgatcccgtggcctttacacaggctcagaggtgcatcagaatccacaatgaagtggacaagattagtgaccaacacatctgtaaatgttatattttctttttttagttccttagctttttctaccctaggataaattattgaccagttttctgcagtcagattcctgaatcatgttgggttttttttttttttagtttcactcttgtcgtccaggccactcttgtcttgcctcactgcaacctctgcctcccgggttcaagcgattctcctgcctcagcctcctgagtagctgggattacaggggcctgccaccacattgggctaatttttgtatttttagtggagatggcgttcaccatgttggctaggctggtcttgaactcctgacctcaggtgatccgcccgcctcggcctcccaaagtgctgggattacaggcgtgggccaccgcacctggccctcgtgttgggttttaaaacccactcttttttttcccccccaaactctgacttcacctttctctttatgaaaccgttctctttttggggcgggggtggtggtgaagaagctgctttggatggtggtgtgtggtacttgtgtcatcttcactcctgatgatccctttcctcataaactctgcactgcttttagcctgttttgttcgtgttataagttcttccatccagtccctgcactccaccttttaacccttttcaaaagctgcttcgcaaagggtcttgactaaagttgcttgcttaatgaatatgaagcagcctaaggatgagagaaaacgaggcagcagctggaccctctggagaatgttactttgtattttgtttacagctggttgtgactaagctctgtcctctaaagtcggttctaggggattaaaacagctctggctgatggcgcccaataaaataaaacaaaaaaacctttgctgctccagttttttctcagggtggggtcggggtatactttaaatctccatggtctcagaaaggtttcttcatcgcggaccctgggaggctggttcccagagggaacttgtcctcagcgtctcctggacagtgcagcctcctgccgggcctacttctggaaggccattacagaggtcctttcaccacctgtgagaggtttgattttgggggagctccgggactctcaaggctacagtgtggactgctggcccaaggagaaggttggtttcctgaagtggtgggtggtgggttggggggggtcttcgttgtttttcttccctggcatgtgcctgcataagctatttccacagcgtcctggccgcgagggggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgagggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggtaagccgggagcagcccttcccccaccgccccctgagaataccttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaattatggagtatttccgtgactccttgctatatttcaaacctgtgttctgacagtgtagtttgccgattctttttctgggtactacctttgttaagagtcattgctgcctttggcgtccatttcccttaaattgggcttttttagagctgagagtctgatcattatttcccctagtaatgggtgccctgtgtcatgggcattgctgtgcgttagtaaagaaaagtgacacaggtctctcaggtctagtttgctttcttttttttaattggcaagttgagaattattttgtcaacaacttaattgagagcaaaggttgctcttgtggagggtttatggtgtgatacctaatttttggactgtttcccacacttcagcccagtcagaagaggtggtgtctgcttgtagcagttaggtttaaggagaggacagtgtggtcttgattcaggacaaattatccttatataaaactctgggtgtctgaaccctaggtcccctgacactaacctatgcttagttatttttaccttattttatgtaatattggcgtttctcatttcttaatactgttctggtagaattatagatgtatattgatgagcagtagttattagggtggtcttttttcctttccgtttctcagtgttgggtatcttctctattgcttgcccacttaaaatctcttttagatattttttaaaatttaacttctttttctggcgttagaaccaacagatccttagattaaggcgtttattaatgatctttatgtctggaatgtgcatagttgcttgcttagttgcacttgttttctctggttttgttaggtgccaaagtggccccctgggcaaatgccagagacaagctagcactttaaggcacttaagtgcataattgcatatctactctcttttaataacctgcaacctaaacttccagctgtgtagacctccttgatattttgttccttccacccccgtttccctattgtgttttctggtctcccagaatctaacattaattttgcaaggaaaattgtgtgtttaccactttctctaatgttagaggatccatttgttgactctcccttgcttttgaccatttactcctttgacaggtgtatgtttaggtgcatcataaccaattgcattgggaagtttttgcaggatttggatctcttctgaattttgcttaccagtaagctggtagatcatgttaggtagaaattgcttctgtagagacttactaaaacttagttttaacttttctagaaaagtttctgcttttattacattttcagaagtaatacttttcatttccagaatgcaaattttaattttcaggaaaaatattaggtgtatgttcttagttacgctctcagatatgtagttgcaggagaagtactttaattctgcttaaactgagcagtttggtccactgactagtataactagttattctccactttcctcaggcacgttttcttccatgttttttacagtattctaaaatttcaggcatttgagaacaatctgtcctgtttttgccctgtttgcctttgaccctagtagagggtcactaaaattaactgtcagattgtaaagaatcctcgttaaagcaatgatcagaaccagcagtttaaagggcccagttaagggagaagtctgtccttcaacttgttgtgcccctctgtctccccagttcatgagggtttttccagagatgtaccttgagatttgcttgccacattcagctgtggattgagtctagatcattctttaatagtggtaatcattggagtcttttattcggttcttttaaattttttgaggagggtggagaactggcctttacttatattcctttgcttaatgaaaatccatcttgctagtaaggattggaggtgtcagaaaagacttgggcactgtttcttactttgacttcttttgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaatctatatgttgagtcttttttttttttcctttttatcttttcctaaagatgagtcctgcattagaattgtctagataaagccattgctatgaccagtgtctggggtaggggctggggctatgactaagagtgatagcaacccttcttgcgtctgtttcttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctcaggtcccagttactaagaagactaccaaaatggcatcatcttaatcttgaagcgtatttctgacattcctgaaccgttcaacccttatgagttttatagaacttatttgatggtaagttggggtagagagaaatacaaaacttatcttttataaagttccacaaggaagtctgggcatagatgctaacactcaccttctctgcccagctcagatttattccctgaatagagtgcccactccattgctatatctttcagtctgtcctataacagcccagcctgtcacttacttagggttttttttttttttaagtaactattcccacagttctagttttgacatcatctactttctcagggtatatgttttaagaatgcaggcacacctgttaattttactcctttggtaatgttgaaatccagggttgggagctttgccataagcaaatcactcccttcttcatcttctcactagctgttttgggcatttaatactcttgagccagcagctctaccctgagtccgctggctttttccactgtcatacattttgagccccatgatccatttggctctccttgaatatattctcttctgatacttgccagctttgggctctaggtgtttgagattattgttgtacttaagggtaaatctcaatgcccttagttttgaatagctcccagtatgtcccacacattaccattgatccttaattatagtaactgtgtgagtgatagataactgtcatctttgcagttagggcagaaggtatgtggctttcccagggtcattgggtaggcagtcactgattgggctggaaaagagacttgatgtgtagcttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaattttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaagatttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttagggtatgtgtgctttgcgagacttcttgcttgggcttgtttgggggttcatttgtaccttgaaggggagggtataaagttttaagacactcagctttgggtgaacgtcactgtagttattttgtttattgtaagtaggacttgtaggtgccagaggaaggaggttatacagaagcccaggcaggcagccttattccaatgaagacttttcccactggtccacctttgttataaaaccaactacttttagtttacagatgtaggtcttctcttctagagaaacagtcaccaccttcccttaagactaccattccaatcacccagtcagtgtatctagcttaacttaatttccagggaaaaggaggggtttaggggaagaggaagtcagttttcgctcttcgtgccatgtgaaaaaatgaagctgtggctccaagagtactttgctaactaggccagtgacatgtgttgatgcctttcaccatctatttgtttagctctgccaaaatccaaagaatgcctgaatggtcccactagcacctcattacttgggtttacagcctttaaatcataggcatggagaaatgacccaacatatgaggctttagataccttgttgaatgatggggctgagtgcaagaactgccgcctcagcctcacgtttttcttgaaacagttatttgtcttccatatgtttggtctgtaccttcttgctccagtttctacagatacaggactgtgtcagagcatttctcagaatcattcaacaaatactgagcacctactgtatgccaggcattaccctttcagggaagttgggttatgatgatggggagataaagaagctggtctttacttcgatagtttctcagattttttttttaaattaattgtttcctcctgttagattctttctaatcatagatgaccaagatttgaacagctctatacaacatgtaatttattgaatatttttgtacgtgaagcctgtgctgggtgtttcgtgttctcatttaatcttcccagcaaatgtttttcctttagtttttccttcctggctgggttggttctctgccatttctcttggagggtcgtacatacctaactttggtttctttttctctaaaggacagacccaccactgaacgccatttttactcttgtcagtataccctttgatctgatgggtagggttggcaaatttcaaacattggagactaacagtattcattgattcaacaaatattttattgagtgatactctggaaggtggtgttttaagtgttggcgatacatacggttctggagcttctattctgagggagcagaaaatgcagaaatgtcaagtagagaattctgtttagatggggatggtcagtgaaggattttcagaagtgacatgataaacatggatatgatatatttttgcattacaaaactagttaaaattttaactccggccagtcatggtggctcacgcctgtaatctcagcgctttgggaggccacggtgggtggatcacgaggtcaggagttcgtgaccatcctgaccaacatggtgaaaaaccctgtctctactaaaaatacaaaaaattagctgggtgtggtggcacgcacctgtaatcccggctactcaggaggctgaggcaggagaatcgcttgaacccaggaggcagaggttgcagtgagccaagattgcgccactgcactccagcctgggcaatgagcaaaactcctcaaa

SEQ ID NO: 65926 - DNA, 2237 bp, Homo sapiens
tttcaagctgtggtgagctgattgtgtcactgtactccagcctaggtgacagagcaagacgaattatttttaagaggtgatttgaaaagattgactataactcactgattttcaacatcaatgtattatgaagttgtttttatgcttccaatcaagtgtatctttgagtggaagccacatagttggctctgtgtaattgacaaggttatgctgccactccttaggaataataaagtactttttcttgctttttgttttttagacatccagctctgtcacccaagctgcagtgtggtggcatgattgtagctcactgtaactttgaactcctgagctcaagggatcctcccgccttggcctcccagagtttttgcagggactatatgtgagccactgcgtctggtcaaaatgtagtttttcaagagtaatgctttaataaactgatttttttcccccatagcatttcactgttcattctgtctagtaaatgtctagctggctttgtatttcgctaggtactccctgattacctgcaattaggttaccatgtggcgaatacaaagatgaatagggcattgtgcctgtcctcactgtgcctccacaagctgctgcttgtctgggccttgggtgtacaaataactggtatgtccttggaagtcagttcggggtgggaatggtcatactattttgtattgatgacatgtgcctcggcctgattctgcatgggtcaaaggacctgtgagggcagttttcagggtgatcttggaatttaacttgatgttaaccctgttaactttgcctttaaagttttccagccaggcgtggtggctcaacgcctgtaatcccagcactttgggaggccaaggcaggcagatcacctgaggtcgggagttcaagaccagcctgtcaaacatggggaaaccccatctctactaaaaacacaaaaaattagccgggcatggtggtgggcacctgtaatcccatctgcttgggaggctgaggcagaagaattgcttgaagctgggaggaggaggttgcagtgagctgagattgcgccattgaactccagcctgggcaacgagagtgaaagtctgtcttaataataataggccaggcgcggtggcccacgcctgtattcccagcgctttgggaggccgaggtgggcggatcacgaggtcaggagatcaagaccatcctggctaacaaggtgaaactccatctctactaaaaatataaaaagttagccgggcgtggtggtgggcacctgtagtcccagctacttgggaggctgaggcaggagaatggcatgaacccgggaggtggagcttgcagtgagctgagattgcgccactgcactccagccggggcaacagagctagactccgtctcaaaataagtaaaataataataataaatttaaaaatgagccggtcatgctactcaggaggctgagatgggaggattgcttgatgccaggggcggatgttgcagtgagcagagatggcatcactggactccatcctgggtgacagtgggatcctgtctcaaaagtttcccaggcatcctcaaaattggggttgttttgggtgaatgctaaattaaaccaggctccttaccctagagctacacatcagtactaaagtagactcggggggggatggagtagtgagagtgagatcattgatcattggcactagtattaagtgctgtttcaaattacccaggtcagtttgctctcagtacttgtgtgttcttacacatgatctcattctgaggtaaaggaaattcccaggatgatggtgatgggaagtcccaggactccctttctgcagtggatttggagaacagtagtccaggttgtagcaagagaaagtacttttttttttttttttgaggcggagtcttgctctgtcacccaggttggagtgcagtggcactatctcggctcactgcatgctccacctcccgggttcacgccattctcctgcctcaccatccagagtaactgggactacaggcgcccgccaccacacctggctaatttttttgtatttttagtagagacagggtttcaccgtgttagccaggatggtctcgatctcctgacctcttgatccgcctgcctcggcctcccaaagtgctgggattacaggcgtgagccaccatgccccgccaacaggaggatttttttagtccgtttgaggtgctgtaacaaaagaccgtaagactggatggct

SEQ ID NO: 65927 - DNA, 2237 bp, Homo sapiens; identical to SEQ ID NO: 65926

SEQ ID NO: 65928 - DNA, 2237 bp, Homo sapiens; identical to SEQ ID NO: 65926

SEQ ID NO: 65929 - DNA, 2237 bp, Homo sapiens; identical to SEQ ID NO: 65926

SEQ ID NO: 65930 - DNA, 1279 bp, Homo sapiens
ccaccacacctggctgaaatgaggaaatttttaaaagtggcaaatggattatgaacatcttattcagaaataaaggtaaaaaacagctaaaatggcaaaagcagttgggttctggggaaggtggggccaggggactttttgaagccttaatatttgctttgttaaaccatgttcttgcattattaagttgtgtcatgctaagaactctattttgtcaagccagattatgatggcttaacatgagtgaaccttccagcttctcatgagatgcaaatctgacaggaatagggactcgtgttactttatggcaggtaaatagcacccttcagatacaaaattgggttggtttcgggcgtggtggcgcatgtcgtagtctcagctactacagaggctgaggtgcaaagattgagcacaggagttccaaggccagcctggccaacctagtgagacctgacctgtctgaaacatacaaccccacccgcacccccaccaaaacagggatggtgcttcctgtcccttaaggagacaagacaccaaaggagaaagtacgtagctagtgatgagtgaattgagcattgtattactgctctcatttttgtcttaagttgtcacaactaacagggaggctgagtactctgtccactgggagctggtggttccattgagggttgtgtgtgcctgctggtttgagttcctctgtccaacatcagaattgtttgtattcagatatgcaacaagatgggacttctcagtttcacaacgtaaggaagattgacaccaaactgagtttggggcttcctttgtacagttgaccattgaacaacaagggtttgaactgtgcaggttcactaatacatggattttcttctgcctctgccgcccctgagacagccagaccaacccctcctcctacttttcctcagcctactcaacatgaatactatcaggatgaacacctttatgatgattcacttctacttaatgatttttttttttttttttgagagggagtcttgctttgtcacccaggctggagtgcagtgatgcgatctcggctcactgcaacctctgcttcttgggtccaagcaaatctcctgtctcagccttccgagtagctgggactataggcacatgccaccacgcccagcttacttttgtatttttagtagagacagggtttcaccatattggtgaggctgttctcgaactcttgacctcaggtgatccacctgccttggcctcccaaagtgttgggattacaggtgtgacccaccgcgcc

SEQ ID NO: 65931 - DNA, 1279 bp, Homo sapiens; identical to SEQ ID NO: 65930

SEQ ID NO: 65932 - DNA, 1279 bp, Homo sapiens; identical to SEQ ID NO: 65930

SEQ ID NO: 65933 - DNA, 1279 bp, Homo sapiens; identical to SEQ ID NO: 65930

SEQ ID NO: 65934 - DNA, 1142 bp, Homo sapiens
agtgatgatatagaactcttttgcagaaaattttttttcttgtgccaatgacatagaaatcaagatacttttatttatttatttatttttttgagacagagtctcactctgttgcccaggctggagtgcattggcgtgatcttggctcactgtaacctctgcctcctgggttcaagcgattcttgtgcctcagcctccctagtagctgggattacaggtgcacaccaccatgcccggctaattttttgtatttttagtagagatggggtttcaccatgttgcccaggctggtctcaaactcttgagctcgggcaatccacctgcctcagcctcccaaaatgctaggattacaggcgtgagtcacgcacctggtatatgttaaacttcctatgttaaattggttgaaacctagcacagaaccaccagagattttgctgaggccagcaaaacctgcaaattttttttcttggctctgcatagtgccttgcagatcataagaaaatcccagcatctttgccttattttcccttttgtaaaacagagacagtcttgcttccttggggaatactgacgctaacatgagccttatgtacatcaccactggttggaatgtgtgcatggatggacaggttaacttctgtagattgtcagaccattcccctaagaaataagggaaaatttttgcttcacctgtcaagattaagtataaaatatgtgaggtaaatgctttattattgtaggtaaaatttcacatgtagtcagaatttacacatcaacatttccatataaagtacaataaagcttaagtagagttgagtccatcattaaatgtgttctatggggatctaaacaaagataaataagatgtccataatctagaagacatactttactgcaaaatgtcactgctaatcattaatatgtgatttgcttttctgctcaaagtactatgtatgaatattttagccaaagcctaatcctagcagaatattagcaccttgggaagacagacctcttttaatagctcataagtgaatttaattttttatttttttgagatggagtctcgctctgtcacccaggctggagtgcagtggcgtgatctcggctcagtgcaacctctgcctccttggttcacgcca

SEQ ID NO: 65935 - DNA, 1892 bp, Homo sapiens
cttcagtgggcttaagtgacctgcccacctcaacctcccaaagtgctaagattacaggtgtaagccaccatgcctgggcttaaatccttccttctatatctaaatttctgacatctattagtttgaactttgtagcttaagaactgggagagaataaaaagacaaacataaaaagatatttaagtgttagaaacatttatttgtcaaaaaatttttttaaaaaagggaggagtggagtaaaacaagggtaaatttcagctaatgctgtaccacgatcacaggtcggacataaaaaacaaacaaaacaacaaaacccccaatggtcctagcaatttcagaagagtaacttaagtgttaagagtccagagctaacagaagagtaaaaggctgcttgccactacatggtcattttaaagggaaaggagatgctgcaggtaggcagggagaaggattcaactcctagggaaagcaagataagaggggttccactgcacaggaaaaaggggatgccagcataatccttacctagggctgctcagaggctgagaatataaggaacagagtgaaaggctacagagactagtttcaggaggaaagaaaagtcaacttagaagaattaagaaagaaaacatagttggtcacaaactccttttgtttactgaaacatgaagcaatggaaacatcccggcaaaggggaccgcgcggagcaagttctcatatatgaccgcagcccgagggttcagtccgcaattatcctacctgaaagagagcacaacacaagaggcttacacaatgcctggagagcagcctggctccgcgtacaagcgccctgggtcctgtcctgtattccggggggaaaaaaaagaacaaaacaaaaccaagtcagactggatctaactcatatcccatgtaattacctaggagtctatcaatagctatatataggaatccacttatggctatatatataggacaagatgcaatctagctgaagaatgtgttggtgataaatacatctttcttatccatcttttaggcaagataacccctgtgacagaaggctactgttgctgtaacaaagggcatacatacattttcaagaactgcaatttaattttggagtccaggaaaagcagaagatgctgagatgtcatatatggcgaattgcactattctaaatgtgttttgttttaatctttcacagtaaacaagctttcagaaatgatggtcacaaggggtaggatatcaaggagcagccagtcattcacccaattccaacacacctacatgtcacactgtcacagagtgagagccacagttccagtagttcccctaattgaccaaatctcccttgccaaatcaaaagaaatcattcctagaattctctaatccttctattgatgatgggaactccagacaccaatggctgggggaaaaaaaaagttaactcacaccaagttcctctacttattacagacaaagggccaaatcttggtcttgatctgtgccaatcgacttcaaaagttgtgacgttcttggatcagttctgctagggtgagacccgaatttggatccccaacagttctggagtatttcatcctggcagcctcattaacatcaggctcctgggactgcaaccaactcagggttattcagtccatttgaggttcacacctggaaggtaagtttctttaaaagtcatcgctaaaaagaggttagttgaacaaccactgcttgcagtcaaaattcattttaaaatgtcctagcaataccttttgaagaccacaatatatgaatttaatatttaactttgaaacataagagacaggttatctgatagatttataccagcttacttcggaagcatgtcccaccccatgctagatccagct

SEQ ID NO: 65936 - DNA, 1016 bp, Homo sapiens
atgtatgtatgccctttgttacagcaacagtagccttctgtcacaggggttatcttgcctaaaagatggataagaaagatgtatttatcaccaacacattcttcagctagattgcatcttgtcctatatatatagccataagtggattcctatatatagctattgatagactcctaggtaattacatgggatatgagttagatccagtctgacttggttttgttttgttcttttttttccccccggaatacaggacaggacccagggcgcttgtacgcggagccaggctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaatatctttttatgtttgtctttttattctctcccagttcttaagctacaaagttcaaactaatagatgtcagaaatttagatatagaaggaaggatttaag

SEQ ID NO: 65937 - DNA, 1363 bp, Homo sapiens
tgcttcacacataaacacagactagctgcatggtggtctcaagagatctcaagtcttgctgacatgcatatagggtacaacttattacaggttcataacatttgcttctcaattcacataaaagagcaaattgctgtggctttgctttttaatttttttttttttttttaagagagagaggagccactcttgcccaggctggagtgcagtggctaactgcagtctctcactcctgggctcaagggatcctccagcctcagcttcctgaatagttgggactacaggcacaagccactgtacacagctgctttgttatcttctacatatataccaaagggataagttaggaacaccagaaactcagtagtaactcactttaaccttgcttctggggctccaattcaagtgatgctcaatttcaaggtacaaggaaaaccatgagaatataaagtcataatgccatttccactcagatgaaaagatttatctatctttagatactcaaaattattcttggcattttagcacttttggtacacatttcctgatgtaggaaatagtaaaatttcagagcctatggcattggctttcaccacctatgcaattttctacacatctgaaaattaccagtttatctaactccttaaatgttcctctcttcaacaacaaaaaacacaaacaaaaattgctggaagaaacaggaagcatccaggtccaaatgacagcataacagactatgaagaaacagggcttaagtgcccatctagaacaagatggtctagattacaataaggaccccatgggacagaacatcaaaacattcaactttcaagtaaatgtcttggaagtaaacatttaaaatttataggacttcctctggcatgtaggtatgatattagaagagtttcctttgacaaaggacaatgacccaagaagtaggtttttttttttttttaaataaaggagagacagtctcactctgttgcccaggctggaatacagtggtgtgatcatagctcactgcagcctcttttaactcctgggctcaagcaatccttccaacctcagcattctgagtagctgggatcacaggtgctccccatcacaccctgctaatttaattttctttgtagagacagggtcttgctatgttgcctaggctggtcttgaactcctgggctcaagtgatcctcccgcctcagcctcccagtgttaggattacaggagtgagccactgcctctgccttcaggtagcaattttattagcaaactataagcctaaagtaatagttaaaattctcactgtgatattcattactaacccctgaacctgtacccttcagcttaccactacagtacttct

SEQ ID NO: 65938 - DNA, 1723 bp, Homo sapiens
actgtggggagcatggctgcagcacgacgcagtgggctcctgtcccttccatagtaggaggaagtggtggctgcagcagcagccatagcagctgaagtggcagcagcgccagagtttggcaataggtgtctgtcatagggatcaacagaagtagagttgaggtggctggtcacagttgtgctttggacttgaggcagatgggacatggtctgctctgcgtagttgtatgcagaagccgctgccgccgctgctactgcctcataagagcggacccggtatcgcttatagtagtcgagtgctccatatgcatcgttgtaatacatggattccccgtagcccatggtgtaaggtgttcgaactgctccatattgttcattatactgctcagtaaagtctgccacacgacccgtacgatctactgggcactctttggaccagtgcccttctttcccacaccgatagcagccactctggtctcccataccaggggcagtccgaagccggcttgtggacaactgcacatgcattcttttgccttgagggaacagatgtaagaagatttattttaactcacttgacattctttttcctctcctccccaaatgaaagtaaattagttgtcataagacacatagacgcacacacctgtgaccctatttcagcaacctcctttaaaaagtagttgaagtttttttgtttttttttttgagacggagtttccctcctgttgcccaggctggagtgcagtggcacaatctcagctcaccgcaacctccacctcccggattcaagcaattctcctgcctcagcctcccgagtagctgggattacaggcatgcgctgccatgcctggctaattttgtatttttagtagagacagggtttctccatgttggtcaggctggtctcaaactcccgaccttgggtgatccgcccgccttggcctcccaaagtgttgggattacaggcatgcgccattgcgccctgccagtagttgaagtttaatacagatgagagctagaaaatttgattcctcagagaccagtcaatactttctacttaggccaggaatagaccagactccctcctgtttctgtctccacaactttcctttttccccttatacacaacaattggaaaagtttccacttctcactaagattgttattacttgtaatgattcaaattctgccaatacttccaaaatcaaccaacaaaacctcagttaagccagatttggacggcatcttgcccatctctcactgactgactaaggattaaggcctgagtatttactactgcttaaaaaccacatcaatagtccgtccatcttgtttcctctagctatttttgcagatgtcaccagaaggctccaatgatgggtacacaaaccatacctggcttgtcatctgcttcatctctagtatctctgggagttataagacctttcagatttcagtttagcccaccacccacccccgacccccccaaggctactgtggaaagctacctgaccaaggtctctcaacaagaagaattagatcttgaaacagtactgctttcttagggacagtgtcttgacatgtaatgaaatgactgtcatttcatcctgccatgtaacttacaatttttatagggattaactactagttagaaaaatgcagcatttgcctagagacctctaggaacccacacaaatgggccacatccattttggcttcca

SEQ ID NO: 65939 - DNA, 1049 bp, Homo sapiens
aactgctaggagacaggccgcatccactatcaccaatagagtcagcagatacccaaaatggcactaaatctctaaaagcattttgccatcccattgttttcagagatttaaatgctcctaattgttagatgttaggggccacaatgctaactgtgctttgaacagaaacacagatttctgccacaatttatatctcaaatgcatagttccctataatttagactaaaagattataaatgacttggctttcaaatatacatggtgacattaagctatgtgacagacacaaagtatactccaattgtgaagtcagagtgaccatgacagtctaaaaaggagccaatccagagacctaaaagtaacatttttaacaaaaaaattcaattaaatttgcactttacttttatagattctgggtccattttttggagaaacaaaacccagcaattttaccttgatgttttttaactaaatccaatcttcattcctgcttttatttagagggtgggaaatcaagtttatctgtggtaaaatctacctctgtgtagttgtgaaaaggatgcaggtatcaatttttttgttgcgtttgtttgatttttgagacgtagttttgctctgtcgcccaggctggagtgcagtggcgaaatctcggctcactgcaacctccacctcgcgggttcaagcaattccctgcctcagcctcccgagtagctgagattacaggcacctgccaccattggtgtggttttaaagcaatttttgtatttttagcagagatggggtttcaccatcttggccaggctagtcttgaactcctgacttcgtgatccacccgcctcagccccctcaaagtgctgggattacaggcgtgaccactgcacccggcccaattttttaacctagaactaaaaaaatctataataggggtgacgagtttaaaaaaattttttcaaacagtttctccaagctgggtgtggtagctcatatctgtaatcccagcactttgggaggctgaggtgagccaatcacctgaggccagaagttcgaga

SEQ ID NO: 65940 - DNA, 1051 bp, Homo sapiens
cctgcctcagcctcccgagtagctgggactgcaggcgcacgctaccacacctggctaatttcttctatttttagtggagacgaggtttcaccatgttggccaggctggtctcgaactcctgacctcaggtgatccgcctgtctcggcctcccaaagggctgggattacaggcatgagccaccacatccagcctagcctttaaatttaaataccctaaagtttttatagtaattgaaaaagactatgcctctctattattataccttaaggaaccagggcaaagaaaaatgaaagattaattcttctactctactacacttggacaaagtaggccaaaagcttaaaatttcctgggacttccaaaagttactgaagtttgttgccaacattttccagaaaaccagccctataagtgttttattttgaaagctgtaacagaaaagagcattaaaatgctgagaagtgggaaacttggggtcttaatttctgagcgcctatcaagtgccatgatccagaaaagactggggatgtagctaatacagagtagtattctgacttaatgcttgtttacatatagggaaaaaaaaaaaagacacctgaactctcacacattcttcccaattaagctgcctgattgttatttgggaatagcttctttaggtcttccaatacaaactatgtgtctaaggaaataagttgagttcactgctggctgtaaaaaggaaacagatcctgaaagagtaaagtaaactcagattccgctacttccttttagaagtcatacaatgcaaaaagcctcaatggcagccattaacatatagaaataaaggttcaaaagatgttcaagtggcacttttttgttggttcatttttgagactaagtcttgctctgctgcccaggctagagtgcggtggcacggtcttgactcactgcaacctccgcctctgggttcaagtgattctcctgcctcagcctcctgagtagccgggattacaggtgtgtgccaccatacctagctaatttttgtatttttagtagagacagggtttc

SEQ ID NO: 65941 - DNA, 1057 bp, Homo sapiens
attaataccacaagaggttgtcagaagactctagaactgtgctaatatggtaaccacatgcggcttagtaaattgaaattaacagattagataaaatttaaaattcagtttttcaagtgtataccagacacgtttcaagcactcagtagtcatgaggcctgtggctaccgtattaatagagacacagaacatttccatcatcatagaacattcttttggatagcactgttctacaagtgttttgttaacagtatcgtcttggacctcatgttcatagccacttttgtggttcctaagtcaacaccttttttgccctgagtgtcattaaaggggttgttaagaagtacttttgggtcttctattaaaactaaaaaacaaaatgagaaaaataatgggagaagaggaaaagttgaccagagaagggtaagaaagtttgcatagtggagatgggtagaggagcaccatcaagtatctccagcttcagccagtgatgccttggcctttagctgctctttaaagcatagggcaaaggttgcagatacttcctaccattaactagtgtgtgaccttggacaagtgttttaacatttctctgcttcattttcctcactaagattgtccccacttatggagttaatgatccctactgtacctccctcacaggattgtagtggggctagaatgaagaaatcgatgtgaaagtgttttgatagtaaaagctctttatgatgacaggtgattgctctttgcaaccatgagtgtttctattctggttagaaaattattgaaagtgtgatagcgaagctttccttattggtttgcttttcttacatttgtttttctttttcttattttggaatgttgttgcattttcagcttttaaaagtatcttaattattttcatttgatgggggaaatcatcatgatggacagtggagactggggaaggagggttttctcctgacaggtaatgagcaaaatgtaaaagaatgtaaagttgggtacaaactgcagaggtattctagtaatgtcatacagaatgcccttaccttttaaa

SEQ ID NO: 65942 - DNA, 1049 bp, Homo sapiens
aataattttctaaccagaatagaaacactcatggttgcaaagagcaatcacctgtcatcataaagagcttttactatcaaaacactttcacatcgatttcttcattctagccccactacaatcctgtgagggaggtacagtagggatcattaactccataagtggggacaatcttagtgaggaaaatgaagcagagaaatgttaaaacacttgtccaaggtcacacactagttaatggtaggaagtatctgcaacctttgccctatgctttaaagagcagctaaaggccaaggcatcactggctgaagctggagatacttgatggtgctcctctacccatctccactatgcaaactttcttacccttctctggtcaacttttcctcttctcccattatttttctcattttgttttttagttttaatagaagacccaaaagtacttcttaacaacccctttaatgacactcagggcaaaaaaggtgttgacttaggaaccacaaaagtggctatgaacatgaggtccaagacgatactgttaacaaaacacttgtagaacagtgctatccaaaagaatgttctatgatgatggaaatgttctgtgtctctattaatacggtagccacaggcctcatgactactgagtgcttgaaacgtgtctggtatacacttgaaaaactgaattttaaattttatctaatctgttaatttcaatttactaagccgcatgtggttaccatattagcacagttctagagtcttctgacaacctcttgtggtattaatgacaacatatgtacctttattatcggtataaatagtatgatatgctctacgatgcttgtactgaaatttcttcagaagcgggaccatcattcccattgagtctgatatatttagaaatttccttttctgagggtgaaatgaacaggtggagcagaacactccatggcatgtttttttgactctgcttgaagagactgcacaactttgatcaacaaaaagatactcccgcagatccagacttgccacccagatttataatatag

SEQ ID NO: 65943 - DNA, 2244 bp, Homo sapiens
ctggcttccacgttgatgttcaccccatgaagcttgtaatggtgcaggttgcgtatggcatcctcagctgccgtcttgtcttctatgtgcacaaagccgtaattcttaatgatgtcacattccagcaccttcccatactgctcgaagagtgagcgaatctcctgctctgtagcctcccggggaaggtttccgatgaacagcttcaccatcctgacaagagcctgggagagaaacacaagacttcaaaagtcaggggtgtggtgggaaatttcggtgcactgcagcattttcgtctaatcctccaaagttcttgcaccttcaagaccctcgtacagacattcattattcttcctcaatagaagaagggcggtttgttctcgagaagtgcgagctatgcgtgacatgcaaacaggaggtcgagggtcagcatgcatagcccagtctatcatctccgtgaagtggagcgcaatgaaataccagaattagctgcttcatgtcttaaaatgagggaagagaaaagcccaagcaaaggcaaggggcatcaatcgcagtgcgcctggtaacaaggttttggagggaaatctgtgtacctctcctgcgcgcactagcgcctttcaagatactctaaaaagaaaaaagtcccctttcccccaaaccggggaccaaccacctcgcccccagcggcccaccctccagcttcttcgccccaacaaagactcgacccgacccctgccccgcctccttccggagacccggccccgcctcctcccgttgtcttcccagacctcccgctgcaaaatgagaaacccaaatccgggccgtgcagtctgccggaggcccggcccgacccgcccccgagctccccacatcacacacacacgaccccctcgcacctccgggtggcggcagcgacggcggctcccacgtcagagagaaccttacaaaatggcgacggccgctcgagcctggacgcgaccgggccctttctcgcgcgccagctcacgcacgcgcgagtgcgcgctgcttccctccccttcccctcgcgggagccgagtgaccaatcccgaggctgcatacaaatgaccacgcagcacgggggcggggcctgttggtggtggcgcggcgccgcggaggtcagcccacccccagccccagccagccagtcaccaccctggaaagggtcgccactgctgcgtcagaggggctctgaacgcaaccactgcctagaaaagcggaggccttggggagtcgctcaccacaatgggtcctgctcttgggccctttgaggggggcggggagctaatgacagaggaatctccccgagggccctaaaaaggggcttttgtagcgggctggccggcttctgtggcagcttggggcaacatttcaaaaatacaggtgcgccacattttaagcaaaactagtcattgttttgtagcgctttaaacattattttaaagtttgtcattgcagaggtgttatttattgctacggaaactgagaaccaaggggcagaaagataacctggcagaactgggacaggcctaagaggcattgctacccaggctacgcttagtcatgttttgtttgctcgtgagtatccgtggtctgattctctctcactcattgtgtgtccatcacagtcctggtctgtggtgagcacgccagaggaatacttggtggagaggcccagcgaggtccctagttctgggtgggacagggtctcctcgtacacaccaagctggaagtctaggcaactgagtttcccgactgtctagcattcaaaattcagctgtggtccaagggcacctcctggcggtaaaaacaagcttaggcgtgccaggtgcggcggctcacgcctataatcccagcactttgggaggccaaggcgggcggatcacgagttcaggagttcgacaccagcttggccaacatggtgaaaccccgtgtctactaaaaatacaaaaaatagcccggcgtggtggcgggcgcctgtaatcccaactactcgggaggctgaggcaggagaatcgttggaacccgggaggcggaggttgcagtgagccgagatggcgtcactgcactccagcctgggtgacagagcaagactcggtctcaaaaaaaaaaaaaaaagaagtttaggctgattccccactgtcaccttccagcaaagagtagccttttatggagattgatggattgggtttatctcctagtagagcccgccagggaggttgtcagcca

SEQ ID NO: 65944 - DNA, 1124 bp, Homo sapiens
ctgagctgtttaatcacctccttggccagactcaaggcggtggctgtccccgaacaacacacctggaagccattgagagcagctggagatggagtggcagctggagttacagggtgggggtggggagggagggctcctgcgcctctgactgtcatctggcacttctgcccccagggcctgcttcagctctgagaggttcctggctggtctgaggggtgaggaaccagaaggcagaaggcgagtgccctcgcatggcaggagaatgaccctgaggcaggggcagccactccccacatggcctatgttgagggtgcggcactgtccacaccgtggtgagggacagaggcacgaggctggggaaaggggagaagtcggcgggggtgggagagggggttacctgggtcccaccaccagtctggaattaaacagcagaagagaagggctgcccttgggaacatggactcgtccccagtgacagttcctggtgatgggttgaccttggcaacagaccctagcagcaggcagttgtcctgacaagagggcggtccctgtcgactgtccctggcagtttcctgaacggagggagggagttggcctgggaccttgcccccaactacttgttcttcttaaagaagctgaagcgtttttctcgctctcgttctctgccgtctttgctgcggagcacaacaggcccctcagccccgacgggtgacactgggggcatggtcatggcccgggtcatgccccgggtggtgctgggcaccaccggctcttcaggctctccagaggcagaagacgctgtggcaatggctgcattcaccacccgtagccacgagctcatctctgcctgtggatggaaagaccctcaatcagcttcaaggacactgtgctgagttggccgcagtggacagcagggaagtgtaagaggaggaggcagaaagtgagctgactgtttcatgctattaggagaatgtggccggcttagacagggagtgcggcctggtgcggccgtcgcacacatccagtcttaccacaaaggacaagaccaggaaaaagagggaggacagggaaagaaggggagtctgcagctggaagcttctggaatggcacggacagagaggaac

SEQ ID NO: 65945 - DNA, 1036 bp, Homo sapiens
ccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccaccccc

SEQ ID NO: 65946 - DNA, 1159 bp, Homo sapiens
cacaggtcaggggagcaggttggagtgggcatccggggtcctgtgtccctcaccgcagtaagcttctccagcgcacagaatcgctcctcccaggccactgctgacttctggaaggcctcgtgccgcttgatgaggctctcaacttcgtcgaccgtgcaacccagctcagcgctgcgcaccagtggctcctggctgcagagccaggcctctgccatccctgcatctcttccaaacacaagcacctccaaaactggcaggatcgggggttgcaggaagatggtgggtcagagtggccactggcagggcacagtggccatggcaacctcaagaacagggacacagagaaagccactgccccagagctgtgccaggcagcacgaagattgggcatcgtgagtttcacacccagggttcctagtctcacctactctggaacccacagggtgcaggatgccccccactccccacagggcctggggcccccttggcagctcacccagctgaagccagtccatcttctcctgccacttctcagctgtctcctggcgccgtgcctgcagctgagacagcttctctgagatctgggggcggggggcagagatatgagttagcaccaggatgtgagatctttccacggcccctggggagtcatccagggggacaggtgatttctttctttctttcttttttttgagacggagtttcgctcttatcaccaaggctggaatgcagtggcgcaatctcagctcactgcaacctccacctcccaggttcaagcaattctcctgcctcagcctccgagtagctgggattacaggtgcccgccaccacgcccggctaatttttgtgtttttagtggaaacggggtttcaccatgtttcatcacagcccagccacacaacccatggaggccaggctggtctcgaactcgtgacctcaggtgatctgcccgcctgggcctcccaaagtgctgggattacaggcgtgagccaccatgcctggcccaggaccagtgatttctgatgtcaagaggcagacggttctggggagagatttccagaatgcgagaaacccgtgaatggcactgaggggagagaatgaaaggtttcttgcaaagagagaatgagaggaagcagaaagccaccaagaagtcagcgtt

SEQ ID NO: 65947 - DNA, 1217 bp, Homo sapiens
ccgtctcaaaaagaaagaaaacatctctggcaggggacatctagccactgcattcacacttttgatgacaagcccccttgagagcccatgatgtcttcaggggttcccagtggccaggagactcttcatgctgcgctaaatcagcctgttagtgcttcccaggcttgagctctaggctcacactcagtaagcatggatccttccttcaaccactagaacccatcagcccctgcctgaatccccttttcaggctaagtagcacgttctagcaatctccaaggtctatcacatcctagacaggcctctgaaagttcaactggccaatggctcttttccagatcctcccccagttaagcccaggtgtctagatgagacccaacagggcagagtgtggccagcccctgccttcatctttcccagcacccccactccctggctcctccccctgcttctttggctgtgagacaggcaggaggtgagagtggcagccaggactgaggcaggctgcggctccttggagtcccccgctctgcctgactctgacccggggctccgcaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccggtgagaatcccagggctcagggcctccacgggttgtgtggctgggctgtgatggggctgtgggcagcaggtgatgctgtttctgcctccccccagggatgtgtcctccgcggatctagtcatcaagaaccagcaaggcatcaaggcagagatagaggcccgggcagaccgcttctcctcctgcatcgacatggggaaggagctgctggccaggagccactatgcggccgaggaggtgggtgaggcctgggtggccgggccattctcactgtgcagtgctgaacgctgacttcttggtggctttctgcttcctctcattctctctttgcaagaaacctttcattctctcccctcagtgccattcacgggtttctcgcattctggaaatctctccccagaaccgtctgcctcttga

SEQ ID NO: 65948 - DNA, 1045 bp, Homo sapiens
gttgaggtcgcggccagtcccgtccggaagctgctgctgcttgtgctgcacccgcgccagggcttggcgtgccccgtgcaggaagcgctgcagctcgtacgccgcggccagcacctgaccccgtgtgtccagcagctcaagcaggtcagcccaggcctcgttgagactgtccttccactcggccacggtggcccgtgcagcatggcccccagcaatgagcccattggccagcgcattggcgctatctacgcgctcctgaccgatggtgcttgtgtcccgggagaactctcggaatttgtctcggagcatctggtagaggaagcagatggacagaccatgccgtgatgttaggggatgtggtccctgcctgatggagcgagtcctccactccaaactcagaacccacctctccccgctgcatgggggccgggacaggtttcttccctgtggttaaggagtaggtgcagctgcttcccactgaccctgtatttgacagactccctccacccccagcaaaggcgtttcaaggtgcttgggacccttaggcttcagacaaggataccctaactatggtccatatttctgtacgactgagggtccaagcccccaaactgtcgggggggtggatcatactccgttttgttgaattctgttgaaaagtgtgagtgataatttcctgtttgcccttgtctcagctcagcttcatgtcccctttctgtacaattcttcaaattgtgtgtgtgtgtatgtatttagagatgatagggtcttgctctggagtgcactagcgcaatcactgcagtgtcgacctcccaggctcaagagatcctcccacctcagcctcctaagtagttgggcctacaggcatgcacggctgtgcctggctaataaaaaaaaattttttttgtagagatggggggtctcactatgttgcccaggctggtcttgaactcctggactcaagcaatcctcccatctcagcctcccaaggtgctaggattacaggtgtgagcctatgcccggcctcttcaaatcatatacctca

SEQ ID NO: 65949 - DNA, 1191 bp, Homo sapiens
cccaggtgtccccactcccactaatcagtccctgctgcttgccttgccctctgggcctccactgaccccctcttcctcttccagttgtgggtgacagagcggctgcccatggccagctccatggagcatggcaaggacctgcccagcgtccagcttctcatgaagaaaaaccaggtgaggcagaggctgaaggcaaaagagaagttcccaggagcctgcccagacttggacgtgttttttcttaagaccaggcccccctcgatgctgagtgtaaccctggacttcagtggctgtctttcctcaccttgggagggtgggtcctctcagtaggagatagtgggggctgggcggctgacgggtgttaccatcgcacccccaggctaggagagggagcagaggacccaggaaggagagaggcacaggggtgaagggtggtctccgggagcacgtggggctggggcaggactttcagcattttctcttctgtggccatgggcagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggtgagggccaggacagagcccagtgtatgtgaccagttctgccctcccctgacctgatgctggatgccactgtcccttcccccaggatgagctgagtgcccaggcagaggtgaagaagcaccaggtgctggagcaagccctggccgactacgcgcagaccatccaccagctggcggccagcagccaggacatgattgaccacgagcacccagagaggtgggtgcagcggcagcccggcccagcctgggggtggagccggctgcaggaacaggaaggtgcagggaatgtggagccttcagtgctgtgtgcacggagccttctagaaagctggaacacagggtgggcgagctgttgggagactcagagggacagggctccacagaacagaccggaggtcagagctacacccctaagtcccacagtgcctccct

SEQ ID NO: 65950 - DNA, 1015 bp, Homo sapiens
tcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaaggtaccagtgaggcgtgctgggtggggtaagagtgatcaagagtcgagggggccccacagtgggtgcgtccgcccgtctgctcggccgatctctgtggagtgtgaaccagcacagggccctgtccccagttgcagggaacaaagtaaacagggccctgtccacatggggttcgtgtccacatggaggaggctgatgacaaaacccacggacctttccgtaaacaaaagagcaggggccataaaaccactgatgaaactggaacagggtggtgtgaggggctggtcagacaaggcctctgagaaaataccatttaagccgagaccagaatagtgccaggagccagcacagagagctctcaggagagaatgttccgggcagaaggaacagccggcacaggccctcggcctggatcagcatggtgtgttcaggatcagaaggaaggccggtgggctgtgagcatgaggagtgggggccatggactgagatttgggagggcacggccagcccactagggccttacaggcctggtcagggagtttggattttattcaaagtaacatggatcctttaaagtgatttgaaggggccaggcgcagtggctcatgcctgtaatcccagctctttgggaggccaaggcaggcagatcacttgaggtcaggagttcaagaccagcctggccaacatggtgaaaccccgtgtctataaaaatacagaaattaaccaggtgcggtggtagcgcatgcctgtagtcccagctactcaggaggctgagacagcagaatcgcttgaacccaggaggcggaggttgcagtgagccaagattgcaccactgcactccagcctaggtgatagagcaa

SEQ ID NO: 65951 - DNA, 1009 bp, Homo sapiens
acctggagatggtgctgagagctggcctctgtccccactgagctgcagggatcacagggcccatcgatctgagcatcctaggttcaggaggcttagttcataccttccgtcccactgcccctcaatccattgacttcttaaacattattctagcctaaaagtccatgatccatccccacatagcaatgctgtttcttttcttgcttttcttccccaaacaactgattttggtctccacggggaactctgggtaaaagcttccttgtgcttctggggtttgtgctctgcttggagggcccttcttgtttccaggagaaggggaaaaaaagatgagctttttggtgcccttttcatttgaatgggtaagttgtcattttgctctaaaaggagatggagagatgtcagccttggaggactgggcaggcccagggtttggggtaagtgatgcaagttatggatgaacttctgggaggcctgacccaaatggtcctctcttgcagacgtgaatgtggaccagccagatgagaagtcaatcattacctatgtggctacttactaccattacttctccaagatgaaggccctggccgtggaaggcaagagaattggcaaggtactgtccatgggcagtaggcataaaggccagaggaggcccggctgaggggtcttactgccctagtgcaagggcagggtggagctgcaggactgggccagggaccctgtggctgggactgtcacgtccctgtcttctgcctcccaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtaggtgtccctggggccccacccttccctgagctgtgctcccacgagaggaagcctaaat

SEQ ID NO: 65952 - DNA, 1507 bp, Homo sapiens
cctccactcagacacacccattcttcagcatcctaccctaatctgctgcctcaaatcccttgcacccagtgttttgtggtccctggcctaggttgaaaggacctcaggctatgcctgtccaccccattaccacagtctaaagagcagtttcctgccatttatctgagcatctctgataacaccaggagttcctgtccagggactgagggccctgcttgcttccttcctagatccaagacatcagtgtggagacagaagacaacaaggagaagaagtcagccaaggatgccctgcttctgtggtgccagatgaagactgcagggtgaggacaccctgggcgtgtggcactggagggtcagtgacccccaggctgtgctgggctccaggaaccatgagctggtgactgccctggagtcatagaacagagctcagccctactcaccattttctgaatctctgtttatagttatcccaacgtcaatgtacacaacttcaccaccagctggagagatggactagctttcaacgccatcgtgcataaacaccggtgagaagatggggttagcaaacgcagcagagctgctgggtcggctaatgacctggggtgcacatgtggagacagagatgagatgagctgcacagcagtcagacggaaggaatagcactcggagcagaaccagaacatgggggtgcagggctgcgcagagcacttgtgatgggaagcaggggaggtggtgtggggaggggctgtgagcagcagtgtgggtttgggatgcctacttctggacaaaattgggtcggtgacttagggataaagattggtgtgggtttcctcttcctcttcgagatctcacatgtttctgatcccttctgtcttgcctccccacccaggccagacctgctggattttgagtctctgaagaagtgtaatgcacactataatctgcagaatgcattcaatctggctgaaaaggaactgggacttaccaagctgctggatcccgaaggtggggccagagctatgtgaaaaagaggtggtagggtagagacaggaggtggaccagtggttgccaggggctgcggagggggaagacatggagtaaccaccaactgatacaggggcttctttggtgggggaagagaatgttctggaattagaaagtggtgatggttacacaaccttgtaaatatactgaaaaacacgtggttgctcacacccagcactttgggaggccaaggcaggaggatcacttgagcctaggagtttggtaccagcctgggcaacatagtgagaccccatgactacccctcccccccaaaaaaaatatatatctttacactgaaaaccactgaattatatacattgaaaggttgaattttatggtgtgacaatcatttctcaggttttttttttttttaacaaaagactgtaggtaggaagaaaggcagcccagtgacagaaagagccctggactgtgggttgtgtcccaggcagagcacagaggag

SEQ ID NO: 65953 - DNA, 1053 bp, Homo sapiens
gatgttttttacaaatacaggtttccaagcccctccctagacacaataagttagaatcttggtccagaactcaggatttttcaaaagctccccaagtgattcttttgagccagctcagcaccagtctgaggacccccttgtggcagccatagcttcccaggaccccttctcattttctcctgggcctctctgtccttctggttgggtcttcaggccggctgtgaaacactcctaccagtgtgtctatacatcagagaagacagaaggtgtgggttatggagaatgtcatgtttggggaaaatgttcctggcactctggttttggattcatgtagcctctagaactgtcatgatgtctatgtgtgtacaacatgtgccacccaccatgtttgcacacatgacaaatgccatccaggactgtcaccatgcctgtgtacataggacacatgcctcccaggactctcaccatgcctgtgtacataggacacatgccacccaggactgtcaccatgtctggctgcacataacttgggccacccagcactgtcaccatgtctgtgcacacatctgtgtgacctcgtgctctcattgggtgtttatctccaccactgaactgggctctcctgaagaggcagctctgcatgggatttgcctagcactgtgtctccagccagtaggtgtcaaataaacactgaatgaatgaagatgaggaagggcaagtgtaggctgcacatgacaaacgctgaagcccagaggaagggcgcctggtatatgtgcccagcagcggggcgtctgggggcagggatggcctggtggaggatggccctggtgggccagagggcagggaaggggctggcactggaggtggtgataagcaagtggaaaggatggtaacagccctcgtttcacagatgagggagtgaaggaaaatgcctcgcacagtgcctggcttttcctctttgaggatttcctcgtttccagatttctctttgtctgtttctgagctggggctcaaagcccacacatcctggagaaggacctcccagagtcaccc

SEQ ID NO: 65954 - DNA, 1061 bp, Homo sapiens
ttcatcaggagcaggatgtggtgagaggaagaattaggatacaaggcagcctgtagcccagggtataggatttctagcttaacatgtcagctgaaagagaggaaaactgccctggaggatcggcacggtgagcctagtctgcctccagcagcgcctggagtacattccagcaggaccccaagcctgcagccggcgggggttggcattcttctagcactaacagtgtaagctacttgggcctggccttgaggtcaattgctaagaataaggtatgatgagactgtaatctggattagctactgcaccaccctattgccagacttcaggaatctgtggaagagaggacgattgaggattctccagcttcctcatgacagggggtcatgaagctggggggctgctggccgactgaggaaatgtgagcatggagaccctggtcataggtgaggaatgatctactcagtggcaagaaaccagcgctggatatgtgtaggagaaaagcaaatagaaatcagtgggaatctagagatggcagcaggggacacaagctgagaacacagcatattgtccaaaaggccagggagctacagagccagaatgcttggaaaccaagacctagagacacaaaggtagcagagcctcagagccacatgctgaacaatgccagagagcaccattcacatggaaggctgtggagttgcaacatggtggccctgtgggggtctgtgatctaaggacaccagtgccagcttggttcctgatccatatcacagcatttctggaaactcagaacacacagcatgcatgcttcaaattcaatttggagagaggagcatttaagtggctgaggttttatttgggggaagaggaggttctagctccatactttctcctggtaatggtaggaatccgcagagacattctaacagttggacttccctggagggtctggctcccagttgggcccctttgtaactttaacaaaacccccaattctgcatttctcctgagccctacttcctaccaccagggctgtggtcttggcagtctctggttctgga

SEQ ID NO: 65955 - DNA, 1009 bp, Homo sapiens
ctcccacaactttaccctggccaaactcaggttaggcatcaatactgctgaggacgggggtgtggacccaacataaacccaatgtcttgagatgacctgaatggaaggcattagctgaggcaagggcatcctggaagtaaactctggagacaccaaaatttaagcaagactagctctggttggggaagcaggggacagtgctctctgatccacaccaaatactgctgggggttcccagggaactccttggacgttggcaatcaacccttagaggccacctagctctatgtttccattttactgatgagaaaacacacccagagagatgacatttcacgtgtccagatcacaccctgagcccgctgactccctgccccaatgtcctggactgcctgtgcctacttttcccttcagcctttaagactcacccaggacaaccttcagcccatctgccaggtcacaagggcaatccatagagagctgcatcagtgggcccaggaaaagaatctgagggcaagaaaacactttcaccataacccaccgcttttgcccagacctttgcccatgctccctgagactccaagcttgaaatcctctccagccacgatttccagaccatgcataccggaggaccctggggccatctcaaaagtcctgtctcccatcaaccaaaaaccaaaaacaagagtccacggcactgcccatcaggctgataacaaagaccagaagaaaaaatacagcaggagcactcaccatggtcagcaacaggggcagcagcgccgctgggaaaatgccctccagcctgaagcccatcagggtgagcagggatgtgcctggctgagccacaggaaagggggcatcagttttgcttcctcccctaaagacccctgagctctcaccgccgttgccctttgccccgcctccttcgcacctggatgcctgtgagttccctccagagcagcacgcacaggggtgagagactggacaccaccaggacgctggtgaagcg

SEQ ID NO: 65956 - DNA, 1892 bp, Homo sapiens
gtatgtagtgtgggggcaggaagggcgtgcaggtgtggtcactcgtggcctccccgtctccagcgttccagttctcctacacagctgtcttcggtgcctacactgctttcctcttcatccgcacaggttggtcctcagtccctcatgggtccctgggggcccacaggagcgggtgggagaatgggaatactgtttgttctaggaacaaaagttcttctactccagtccttgagacaggctgagccagagccctcagcctggtgaggtctgagaggtggaaaggagcagaggccgtggtgtgtgggtggatggctggggtagtgggatcttgatctcctgtttcaggggatgagggtcactagccctggaagggccagaggaggtggtagggctgctccctgagctgctgtctcttttccccaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggccttgggcctttgggaatcggtctatttgggatcttgtgtgaagactctaggcagctcttgggagtgtgcccaccacctgtcccagctaccttgaacactgacatctgggcggtgcatccaggcgggtagttccctggagtacaggatgggctgggagctctggttgctgggagcctgtggcttcctccttcctgaaccatgccccaaagtcctagtgtggttggctctgagactgcaggtaccaggtgtgagcccagctcatcctggggcctgtgccttggctgacgggtcagggagtgggaaccatggccctggccctgacctcagcgatggagcctccgacgtatctcctctgaggggaagatgactggcctgaagcctctgccaggacctccacagtctgccagtcttgtttttcacaagaggaaataggtccctgagtcaccataagtagaggcttttctggttctctccacctctgacctctgccccagaggaacccagaacacaggctgcagccctgagggcagcagggactttgccaagcaacacagtgactccagggtccttctcggcacctgcaagtgttctgcctgctctccatcatttttggaagggctctcgtttccctgcctgtgctcttttaaaattagattcctgaaagagtattagccctggattacttgaggtcaggagtccgagaccagcctgaccaacatggtgaaacccgtctctactaaaaatacaaaaaattagccgggcataggcggggcgtggtggcaggaggctaaggcag

SEQ ID NO: 65957 - DNA, 1015 bp, Homo sapiens
agccggcccgggcccgggtggatccccgcgcgcccctccccgtccgccctccacgtgcgtgtccgcggcgcgcgcgcccgccggcgcgcacccgctcgcctgtcgccgccgccaccgctaaccgcgccgggaaaaggtgccgggaaccgagcgagccggggccgcgggcccgagcgccatgggcccgagggtgggcggcgggcggccggtcatccccgggcctcgtccccgcgggagagcggccaggagtcggcgggggccggccgggctcgcagggaggccggcccgcgccccctgagcgacggacaccaggtgagggggccgccgggcgcagcgcgggggccggccagggaggggccacggactccacgggaggttcggggggcgccttctctggcgggggagggtatggcggggagtggggaggcggctggcgattcctggggacgcctgggaaaggaagttccgggaccctccctgctctcggtcctcctccgcttcctgcctcatgcctcaccttgtccccagcgcctggactcccccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacc

SEQ ID NO: 65958 - DNA, 1060 bp, Homo sapiens
accgtagccatctactctgagcaggacacgggccagatgcaccggcagaaagcagatgaagcctatctcatcggccgcggcctggcccccgtgcaggcctacctgcacatcccagacatcatcaaggtggccaaggtgagcccagtggcctggctgggcctggacagcagggaccagggagtcttagttgccgcgggggtctcttgaggctggcgtgctcagcgcctctgtgcgtgggtgggtaaacggatgcagctcagcaggttaggcaggggaagaggctggccgaggccttggaagggactgcaaggtaccgtcctctccctgacccccacctgcaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgaatataacgggcaagcaaggggtggccccgcagctcctggagagggtccagcagggaggggtggcagggattcccgcctgttacagagactcccccacacctttctcccaacaggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggtgagtgaagatgcccagggctgggagcagggcagggcagcctgccgtgggggcaggggcggaccactcaagggatctggaaagtgggtggggttcatggcaggggagaggtagcgctgtggggtctgaggtctggctggcccctgcccgccctcgcaggagctggaggagaattacacccgggcctactcagaggctctggccgcctttgggaatggggcgctgtttgtggagaagttcatcgagaagccacggcacatcgaggtgcagatcttgggtgagtggtcctg

SEQ ID NO: 65959 - DNA, 1050 bp, Homo sapiens
cagcctggatagttaaaaattacatatttaaaatgtaatatatgtgtgagcgttcacagcagcgttattcaaatacaaaaaaaaattagctgggcatgatggtgcatgcctgtaatcccagctactcaggagactgagggtgggagaatcgcttgaacctgcgaggcagaggttgcagtgagccgagatcatgccattgcactccagcctgggcgacgagagcaaaactccgtctcaaaacacaaaaaaagagccaaaaggtggaaacaacccagatgttcatcaaccaatgaatggctaaacaaaatgtggcctacccatccagtggaatgttgttcagccataaaaaggagtgaagttctgacacatgctacgacatggatgaaccatgaaaacattgtgctaagcaaaagaagccagacacaaaaggtcacatactatatgacatttctaggaaatatccagaataggccatagagatggaaagcagattactggttgccaggggctgggggtgggtgggaatggggaatgacagctagtggtaccaggtttctttttggagtgatgaaaaggttctggaattggatagttggttaccaacattataaatatgctaaaaaccactgaactgtatagtactggtaaccagaatatgtgcatcattaggcctatatattaaacaattctagttggtcatgtccctagaccccggttgtgttgacttgccatgatttgtttaactgtttgcctactgttgaatacttggcttatttccaggattttgtgatcattgataatggtaagccttactttcaaagtctgataagctttttaaaaaattctgcttcctatgtgatgccaagcacttaagaagtactctataaatatttattgaattatctttgcttgctattcctgtttcattagtgtagataattactttctgttccagattatttcaaaagaaaatattccttaaactgttagcctttcagtaagagctgtacattttatatttgtaagtggtatatttcagatagaaatagt

SEQ ID NO: 65960 - DNA, 1009 bp, Homo sapiens
taaatgaagctgaatattacacttttcttaaactttcctataccgttttatgttttgtttgtttatttttgtttattttgagacggtctgattctgtcactcaggctggagtacagtggcacagtctcagctcactgcaacctctacctcctaggctcaggtgatcttcccttttcagactcctgagtagctgggactacaggttcaagccaccacacccggctaatttttgtactttttgtggagacggggtttcaccacattgcccaggctcatctcgaactcctgagctcaagcaatcagcccgccttggcctcccaaagtgctgggattacaggcgtgatacattttagtttttacaatagctttattggagtattactgagatataataagttgcacatatttaaagtatacagtttagtaagttttaacatatgtgtacccttgtgaaaccatcactgcagtccagagagtgaacacattcatcacctttggaattcctccctctgcctcctcactcttcaggaaaccatggaactgctttctgttactataggttagtttccattttctggaatttcacataaattgactcatacagtatatattcttttttctctgccttcttttactcagcataattatgttgagatatgtccatgttgttgcttgtattgatagttcatttccttcttttttttttttttaagacagagtcttgctctgtcacccaagctggaatatagcggcgtgatcatagctcactgcagccttgatcttctgggctcaagtgatctcccatctcactgagtagctggaactacaggtgtgtgccactacgcctggcatatctatctatctatctatctatctatctatctatctatctatctatctatctttagtagagatgagatctcggtatgttgcttaggctttttttttttttttgagacggaatctcactctgtcgcccaggctggagtgcagtggcatgatctcggct

SEQ ID NO: 65961 - DNA, 1001 bp, Homo sapiens
aatcccaactacctcaggaggctgaggcaggagaatcgcttgaatccgggaagcagaggttgcagtgagccgggattgcgccattgcactccagcccgggtaacaagactgaaaaagttctctgggttctaaaatcggtgttcttgccactcctgttttctctgggaagttcctggagcaatgagggtaatgctgttttttcttttgctttagatagtgtctgccttctggagagctgaccaaacactaagggtaagtcctgtgcctgaatccaggctggcgggatgcatgggggtcttcaccaggagcagctgtggatgccagcagtttggcatgtcaggtcttaagctcaatcaataaaaaaaggctgcgctctgatttgtggataatatccgtttaagcagtcttgtctgtttccagttgctcctgatttttacaggaaagtgacatctggctccctgctggccccatttggcagctggccagcctcagcagaaggccctggttctggaagggtatggtcagcttgggaagctgggcaggaagaatccctggggctgggccgtctctgagaagaccccttgagtcagcatggagagcaggcagctgtggtgtgaggtggttctgccagctggttgtaaagtcacttgacacgggtttccagagggtgacgctcaacctttgccagtcacggtaacaacggggaaaaagggacctgcccttcttcccctgcacattttacaggcatgtgccaccacacctggctaagtttttttttttcttttttttttttgagacggagtcttgctctgttgccaggctggagtgcagtggcgcaagctcggcttactgcaacctctgcctcctgggttcaagcaattctcctgcctcagcctcccgagtagctgggactacaggtgtgtgctgccatgcccagctaatttttgtatttttagtagagacggggttttaccatgttggccaggatggtctcaatctct

SEQ ID NO: 65962 - DNA, 1121 bp, Homo sapiens
gtccctctgtgtcacctccaaagctgcttagagtgacccctccctcccttggacctgctcctgctcaagaccccaccatggctccccactgccagcaggataaggagcttctccctgagcttggacacacagcctccacagcccaaccccacctggcctctcaagcctcagcccagctgtgtctccccagacactgtgacacctttgctcaggcagtttgagacccctctccctcctccatgtgtacagtccccctgctgcaaagccagctctcatgcttctacctcctccaggaagccctccctggtctctgcccctcttaccggctcctgccacagcccgtctcattggttgcctcagaagctcttcggagtcagtccctgtggtggacaggcctcccaggagctgctgggaattctccatcagctcatccttatccatgcttgatgtcccacgcttctgatcttccaggggtggggaggggaaggcagcagcctgggacccagcgggggtttctcttatgccctcagccttacattcaaggagctggggaagggggcgttgttgctgagtgatccagagcactggctctgtagcaaagacaggccgagcttgagtcccagctctgtgactttctggctgtgtggccttgggctagttacctaacctctctgagctcttttccacatctgcaaaaaaggggatagcagcagcacttactttgaagtgttgcaggctgaacaccagcactcgctgaatgtggaaggcccttctacccttcagaactcccccttggctctcttcttcccaccctgctcactccctccaccatcccccactttattctggccaaatggatacactggccaagttttcgcccccttgtgcccttttgtatatggggttccctgctaggaatgcttctcctgccgtgtctacctgatctcctccttctggccctgaagcctcagctgggtgtcaccaccaggaagccttccttgatactccccatcatcctactctctcctgccagagctggctcagtggcccctcctctgagcttcccaaggagtctgatgcattggtccttccttttttttttgagacctttttttgagtct

SEQ ID NO: 65963 - DNA, 1040 bp, Homo sapiens
tggttccgcgtgcatcccctgtcctctgctctttttttttttttttccatggggagtcttgcccaggatggagtgcagtgatgtgatctcggctcactgcaacctccgccttccgggttcaggcgattctcctgtcttagcctcctgagtagctgggattagaggcacctgccaccacgcccagctaatttttgtatttttagtggagacggggtttcaccatgttggccaggctagtctcaagctcctgacctcaggtgatccacccgcctcggcctcccatagtgctgggattataggcgtgaaccaccgcgcccgtccctggcccacattcatctgaaatactggatcctaagagcctttgccctcagcctgaactcctccacccaaagccttgacctcgcatttactgagcacctacctgtgccggacacttggcacatgtcatttcatgccatcctatgaagtatgttcaattcttatcctcctttgacaagtgaggaaactgaggcccaaagaggttggataatttgcccaaggtcccgcagctagtaagcagagaagctgggatttggacccaggcccttgggctccggagtccatacacacagaatgtccaaaagtcagaggtacagggctctttagaggccatcttatccaacacccccattcttcagatggggaaactgaggcctgagaagggaaggaacttacacagcaagtgagcagcagactcagctttacgccaggtggaaaccagagggcctctgctcccaagtttctttttgtctagcctgcccagacagctccagcctggctgccatctaactggagccccaggccacggggacgtgccctcctgccctggcctcctctccctgccaaaccattattgatctttcaggttgggacggaagggctgataatagggtgggaggggtggagagagaggaggtctggtggccccatcctggtgcttattaagccttttgatttgtcccttttgggggtctgcaggcacagacagatagaagagagga

SEQ ID NO: 65964 - DNA, 2392 bp, Homo sapiens
gggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccggtgagtttccccctcccccccctcatttggaagtttggttgactgtgttatccaaagactgaatgcaaagtttctatctctttttccgatgggtgaaccattgaaacgccttttcctgggggagcccagcgagattcgccctttttcctctccggccctggctgctccatgcccaggcggtcgtcgcccagggggtgcaagcacggtttccctcccgacttcgggccagggcttcctccgggagggctctgcctctaactgctctgcaaactgtgtcatcgggtcctctggtctcgtagcagttttgaaaggatgctgttaacgtggctgtaatgtagtgacaaaaacggggggaacctgtgttctcaatggaagccattatccacgagaatatttagaaaaaagaaaaccctttcttggtattacggattgaccgtcgcgccggccggtcttttatttaatttttggacaagatgtattttccttgtatccttagatgcaatcgtttattttattactttatccaaaaagatcagatggaattttggtccttgatttgcacctctgaaatttgtttcagagttgtgcacatcttgtgttggggtggagggtagatttgggaatgataagatccggggagtctagaaaggaaggcgacgattgtgcacggccttacaggaggggtatgggaaattgttttggggtcatttaaatcctaattttttgtcctctttttacatagtcagtttgcccttctttcctttagtttctgattaccggtgagagagaactaatttggttaggatctggattagttcagtggtgcttcacctggtcagctctctggagataaaagtcctgggctttttttttttcttgctgatgctgccatgaaggagatccttgctagttgtaatcctgtggggagaaactggtggtgtggcccttccacaaggaactgaaaccaacatctcgtttcgtctaggcctccgacagttgtaatgtgattaatgttgaacatgacatggaaccacttgcccaagagcagaaaggtcccaaactcatgaagaggaacctgatttttcagagagcctttaacacttaccttaaatactcctttccgtgaacagaaagcacaagtttgagaatgagttctcatttctgcttatatcattattctttagtgttgcaatctggttcctaaggaggaagaggaaggcagccctggagtggtttctttacagtaatttcaacagaagagtgagagatggaacccgaagaagaaaggattcgttacagccagagattggttagtattttctccccccaccacaccctccagttttaaagtaggataactattttgtttccagttgtgaatatactgtgaatctgtgattaaaacttttcgggtgacttttctgtgcaccagaggagggggaaaggtgtattaatatcgaatttggcttttggccaaacatgttttatattttatatatttatcttgtttggaaatggagttatatgtagcctttagcttttatagaaaccattgtataccaaaggattttgtggattacaatgtgacaaagattcctgattttacagtactgacattgtaatacatctgattacgttagattagaatataaattttgggggcaaagctgtttgaggaaggatagttcaatacgttttttaagattttgttgtcccaggatttgtgactttgagcggggagaactatggattattttcttttattttataaattaacattttggtagctttgaagggttgttgggattgattgaagacaagtaggtagaatactggatgctgataaagttctgtgttttgggaggaatgtacgagatagatcttgttgaaagaaattttagacatgatttgaaaggattggcttatatctgtatatgaacacttggatcctttaagccatgctttcctcgtaaggtttccctattggagttttaagaattcaatttttgtttttcttagccaaagagagctttattagtagtctcacagtattaataaaaatctgaatttgtgtttgaagagtgggctatgaggaaagcgacagaattgtatgtagtatgtgaaatttgctgacctgaaaggcctagaagattactaaaggaatt

SEQ ID NO: 65965 - DNA, 1096 bp, Homo sapiens
agagaagagtaattgaaactgctttctgcatatcattgattctcaagtgtatttaaattatttttgtagtaatctatagtatttttggtttttgtttgtttactattagtacacattggaaagtggattccaggccaattagggaaggagattgattttgaaatgatgttagttctctggaaaccacttgtttaaataagggaatatcaagaggaaagggctggccatagttactaatcctttgagaggagggatctaagagttggaggatatgtcagacatgatctctcttctctggggaattagaggtgagttggagaaaactgtgggagagagggtcagcagacaaggtgaaagatcacttgagtctagtagtgtgagaccagcctgggcaacagagcaagaccccatctctacaaaaataaaattaaaatgccaaggtaaatggtgttaattctaaacattttggaggtgggggtggggtggagaatggagcatagcattcacctcttctttcatcctagtcttcagtctaaacctagtgttgaaggccaaaggacaatactcccatacacagtgtgagtgggagggagtatgtagtaaaccccccttgcatgcagtagagatgtgatattctcctttgcttggaggatatcatggtggatagtagaagcaggggttcagtttagtttgtaagttataccttggtaactgtatgtttgaccaattatgctgaaaatacagaactgtttcagcatacgttgctttaggagatacacatacatatattgaatcactctcttggtggctgattttttcagctttggttctgctgctgcttccaacagcctagagttgtgttgtacgctatggtagccactagccacaggttgctagggagcatgtgaaatgtggctactatgaattaagatgttggtgtaaactatacacaccacatattttatttattattttattttatttttaaatttaattttattattttattttgagacagagtttcactcttgttgcccaggctggagtgcaatggtgccatctctgctcgctgcaccttccgcctcccgaataagtg

SEQ ID NO: 65966 - DNA, 1068 bp, Homo sapiens
aggtaaacttgcagtataagcaacattttgaaagtgactgcttattagatagaattctcataccatacagtctcctcatttaaagtgtacaagtcagctgggtatagtgactgaagcctgtaatcccagcagtttggaaggctgaggcgtgcagatcgcttgagcacaggagttcgagaccagcctggccaacatgggaaacccctgtctctactaaaaataaaaaaatcagctgggtgtggtggtgtgcactggtggtgtcagctatgggaggctgtaggtgggaggatcacctgagcctaggaggttgaggttgcagtgagccttagtggagccactgcattccagcctgcgcgacagagcacaaccccatctcagaaaataaaaaataaaataaagtgtacaatccagtggtttttagtatattcacagggtcatacaaataccactatctaattccagaacattttcattgctcttgaaaaaacccatactattaacagtcacttctcccattcttcattttctctagcccctggcaactatgaatctagtttctgtctctatggatttgcctattctagacattttatttaaatgaagtcatacaatatgtggtcttttatgactggctttttttttatttggcataatgttttcagagtttatctatgtcatggcacatagcgttatttcattcctttttgtggttaaatgatatctcattgtataggtataccacattttgttaatgcattcatcaattgattgacatttgggtggtttctatcttttggctgttgtgaataacactagtgtaaacatttgtgtataagcttttgttttgaaaagaagaacgtatgttttcagttctttgggttatatacctaggagcagaattgttaagtcgtacgataactttgtttaactttttgagaaactttcaaactgtttaccagtgtctgcaccattttacattcccaccagcaatgtatgaggcttccagttggtctgcattcacatcagcacttgttattgtttatctctttgatgatagccgttctggtg

SEQ ID NO: 65967 - DNA, 1516 bp, Homo sapiens
gctggtctcgaactcctgacctgaggtgatctgcccaccttggcctcccaaagtgctgggattacaggtatgagccaccacacctggcccttttttttttttttttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctctccatattttctaagagatgcttcttactaagcatatattttattgactaacagcataactatatacacagaataacaaacaccatttatactgtattacttaggatcctttttatggtccttttatcgtttttaattataccacttatctttctaatattttcctatggtgacagattttaatgtagagtatattcagcggggtggcttgagagatcctctgattttcaagaattctgatggactcggaataaagtaagtgttttcagcctggctggatgtagttgcaaaatggcctcgttacacccagggcaataaacagtggtggtattgataacccaaaacaatagtaattgaaaataatttcccactttgttttaaaagtatatgcttttcttttgatacacaagtgtttcatattagaggtaaatgagaaaatatagatgaaccaaaaaaaaaaaaacaacaaatttaaatctcctgaaatctaccacccttaggtagatcattaacattttattatgtattcttttttcctgtgcatatgtgtaaatatataatcacctatatttttaaaataatttcaaacctgattgtgaatattactgtgtctggggagtactcagtactttaagaaaaaaaactcacatttactagagcaattgtgttttccatatatacttactggtgtttgtttcatagaatgccggatccagacttcactgtgaatgatgtcaaaatgtgtgtgggtaagtgtcgagcttttggcctctgtctttaaggcaaagatttaagacttaggactgaattaaatctctgactgagatttaaggcctaggaacattgaagtatatatttgattagaaactacattttcattaggaactgagaattttatcaaagagagttacagaagttgccttatttaatacacattaaacctagaaagttggaacctctttttcctaccttcatacttccttctctccttgaagagtgtgccttctagggcaacctttccaagaaaccgaaaacttacatctcttagccaagaaagaagtttcattaatatccgtgattcccttccttcccctaaaaggagtagagaaatttccaggaaatgctcgccagtgctgcatttggaaacttgcctaagacttgaaactttataggctgagaagtagatacattaaaattgagtcttttaattattttattatattcaaaatttgggaaaaagaaagc

SEQ ID NO: 65968 - DNA, 1700 bp, Homo sapiens
gcactccagcctgggtgacacagcgagactgtctcaaaataaaattaaagaaataaataggctgggcatggtggctcacgcctgtaatcctagcactttaggaggccaagacaggcggattgcctgagctcaggagttggaggccatcctgggcaacatggtgaaaccccgtctctactaaaatacaaaaaattaggtggggtagtggcgtgtgcctgtagtcccagctactgtggaggttgaggcaggagaactgcttgaacccaggaggtgggaggttgcagtgagccgagagcgtgccactgcactccagcctgagcgacagagcgagactccgtctctaaaaaataaataaacaaacttaggtctctttgactccaaagctattgttttctctccactactattttatgctgactcttgtggccttatgcgttttgttgtagttgttatagttaacaagaatctgatatagattttcgtgtccatcctggtgtctttatcattctataaatatttgtggaataaatgaaaaggggactttgttcttcatgaactaggataattatcttcatgggctaggatattagcaacaggtttgcgaaatagccctgtttaacaaaagaatataaattcaaaatcagtctgttacccactaaattatggatacttcattcaaattatgagatagattaggtcaacctgcatcaaatcagtatagatcagtaagtaagagcttgactctagagtgagcctgccccggttcttttcctgctttgttctgtaagttacctaacatctgctttctcatgtatgaagtggagattagtatttagcatttagaattgttaggattaaatgagacattagataaaagagtcaacaactgactgtatagtaaacatgccttagggaataattattattaacattatccattgtctttcccattctttgtgatttgattatgattgttgagtgagaactttttccttgtgtattattgaaaataagaaaggacagtattttttcttctactttttaaaaaatattcttactatatttaaggatattagtggctcgatagagatgatcgatgcatcttttatggcagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggttagtgtaatcattttcttcatattgtcattgtcaccaaaagggttgttttcggctggacgttggtaactgatgcttgttatcccagcactttgggaggccaagggaggcagatcgcttgagctgaggagtttgagagcagccggggcaacatggtgaaaccacatctctacaaaaagtacaaaaaaaaaaattagctgggtgtgatggcacatgtctgtagttccagctactcaagaggctgaggtgggaggatcacctgagcccaggaggttgaggctgcagtgaccggtgattgcaccactgcattccagcctgggtgacagaacaagaccctgtctcaaaaatttaaaataaaatgcgttgtttttatactgggaaattttataactttttgcacatatcaa

SEQ ID NO: 65969 - DNA, 1056 bp, Homo sapiens
cttttttctttcttatttatttatttatttatttatttatttttgacacagggtctcactctgtcacccaggctggagtgcagtagcatgatctcagctcattgcagcctcaacctcgtaggctcaagtgatccttctgcctcagcctcctgagtagctgggaccacagacgcacaccaccacacctggctagtttttttatttttatttttttgtagaaacgaggttttactatgctgcccaggctcgtctcaaactcctgggctcaagcagtcctccagcctcaggcccccaaagccttgggaccacgggcatgagccactatgcccagactcttcttttttttaaactgtcattattactcagctttcaactgatttccagagggctttagaatttggagttgtcctgaactcctaataaaaacccttccagaaagtgttgctatacttaaaaggctaatggagaggcgtagtgtattatatttaattttgagggaccaaatacctattggttgttgtctctctcctctgtctcccttagtcagaaataaattaattttacttccgtgtaagagagtcattcttttagttgttaaaagttttagccacataagaaaccagaatcagggtctggctactatgcattagaaaactgattggggctaactatgaaaagtacatctcctctcctgccttgccatggggagagtgatctccttattccccagtgatgccctgtggcctggtgaaggtttttgaaaagggactcctatccagttctccgtgattcaggaacactacccgatatagagtttgtaaacgggtaggtgaagtcatccctacaatatgggaggagatgggaacattctcaggagctgcatattcaaaacagtatcatttggcttatccttttgaaatatggcctctctaaaagaaagctgtatggccagatatggtggttcatgcctataatcccaagtactttttgggagtttgaagcgaaggatcacttaatcccaggagtttaagaccagcctggacaacatagtgagac

SEQ ID NO: 65970 - DNA, 1060 bp, Homo sapiens
ttttgaacagtggacaaatgggttggaataaagatagaccatttttttaaatgtggtaattttgtcatttatagcctcaaggcccctatcatgccacctatttctcttgctgatcacatggcagagtgaaatgttcttactgcattttttcttcatattggtagatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaaggtaagggtttgatgtgttacatgacagctactgatccagctatggcagtcagcttccagattcagagggagaaaatataggaattttgggtgatctctggttcagtcagagagaagttaatatgcatgtgtgtttgttattgctgctcagtgttttcattactagaatgaggttatgtccctgttttgaaaatactaacatttatgtgttcattgaagacttataaatttagtcttaaacataggtttcaggctgaccccaaaaataaagtgacccaaagaaaatatttatataagaaatgttacattaaacttaagttaccttgagataaaactcaggacaaaagtgactgataggagtctcatcctaagcagattgagagaaatgaaattgttctatgctgggttaacgttgagtagctttagcctctttagattcaaatttatctagcatcaagacttaaatacattgggaaaagcatcattttaaaataattcatcc

SEQ ID NO: 65971 - DNA, 1049 bp, Homo sapiens
gcgtgacaccgcgcccggctgcttttttgttttgttttgttttgttttgttttgtttttgagacagagtcttgctctgtcacctaggctggggtgcagtggcgccatctcggctcactgcagcctccacctcctgggttcaagtgattctcctgtctcagcctctgagtaactgggtctacaggcacgcaccaccactccagctaatttttgtatttttagtagagacggggtttcaccatgttggccaggctggtcttgaactcctgaccttgcgatccacctgccttggcctcccaaagtgctgggattacaggcgtgagccactgcgcccggccaagatatccttaacatttctaaaattggaaagttgtattcttgatatatgttgaataaaaaggtaggacatgtaacagtatgtatagtaccatcccattaatgtaagaaaaagtgtatgcgtatttgtgcattgcagaggaatctaaaagggtacatcccagcctgctaatagcagggcacaataggatagtagtagtcaactggaagaatttgtggtttttttgttttttgagatgaagtcttgctctgtcacccaggccgaagtgcagtggcgtgatctaggctcactgcagcctccgcctgtcgggttcaagtgattctcctgcctcagcctcctgagtagctgggattataggtgtgtgccaccacgcctggctaatttttgtattttcagtagagatggagttttaccatgttggccaggctggtcttgactcctgacctcaagtgatctgcctgtctaggcctcccagagtgctaggattataggcatgagccaccacgcccagccacaatttgagtttttaatcagattgttgtttttgttggtatttattttggtgataaagtagttcttaatatatatgcatatataaaagaagctttttatataacaatatatctggcggcccagctcacttaataaagcaaattcaatattgttgaatacttttcgactttcctgttttctctaaacattttgataagcct

SEQ ID NO: 65972 - DNA, 1075 bp, Homo sapiens
tcttacaggcagaggagactgctggaattgggagaatgtgtgttccctggcttcctgcaccttgtttagaggcaggagggcaaagtgtgttgtgcctcagttgtttgacttggtcacggtggaactgctgcaggattgctgcgcagacatttctagtactgtactgtgggggtggagtccttgtcagaatcagaagcaggcatctgttttagatgtagttgatgttagccgtattttattgaatatctcaatattggctgacatgggccatttctgaaggttttttggaacacataggcagattctggattgtgggctgggagcaagtcagcgagggcaggtgaagcaggcagtgtgccggagagagaagataactcaagaggaactcagctcctgtgcctagttcatccagagaggcggaactttgggcgaccccctctacttgctgagaggggagagagaagtgtgtgtgcagtcagccagagagctctggcagtaacagtggtaacagtgagaggtgaccctgaggggaagggtgtggactgaaacaaggacaaatgtgggccaaggtgcctagtgtagcccgcagaatgagttaaagccttccctttggctggcgccttcagaagtctgccaccgggagccctcagggggctggccctaggttctcctattgcagtggtggtgggagggagacagggcgggggctgtggctgagctctcctccctggcagggcctcttccaatcgcgaggaagaaagcagttgctgaacacaccccctcccggctctgcagcagaacggctgggccctctgcctggctcgctcactctcgctcggctccccctcctgccatcttccgttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggc

SEQ ID NO: 65973 - DNA, 1673 bp, Homo sapiens
ggagttcgagaccagcctggccaacatggtgaaactccgtctctactaaaaatacaaaaattagctgggtatggtggcaggtgcctgtaatcccagctactcaggaggctgaggcaggagaatagcttgaacacgggaggcgaggcggaggttgcagtgagccgagatagcgccactgcactccagcctgagcaacagagtgagactccatctaaaaaataaaaattaaaaaaaatatatttgtttcaaaataacagtcaaccagtgtgattcacttaagtggcattttctcactgtagcattgttcgtaagtcatttaaattttattggtaatgccatgagaacttttgcccctaagattgttcctttcccccatttagaggaataaaggcaaatagcagactctgtgggtgtgtgtatgtgtgtgtgtgtgtgtgtgtgtgtgagagagagagagaaagaaagagatttgagattgagatttctgtaatcagccttagaagaaaagagccctgggttgaatctgcacattaggctgtaccattcatctcattaattctgtattagcaaatcatttttatgccacttggttcacatctgagaaatgaaggcaattacctgataatattcactaactggtgtagaaaagtgaagaagcaataataaagttttactgtcatatgtagaactgtatgagaagtaacacttgtcaccacagtaagttagttgtttcagtgtgttagtataattagtacacaagtaagggattgggaacaaaggtgagtttgaagtcctttctgctcccccaccaccaccatccgcccccagtagagatgggtcttgctgtgtttcccaggctggtctcaaactcctggctcaagtgatcctcccacctctcacaggcatgagccactgtgcccagcctcaaagttttgataatattgcagcagcctaagtttgagttttctccttcacctttgatttatttgttttccagtgagtctctatatgaagggcaaatacagacagttgccaccctgcctcccttgctactcaagggtactgaggcagagtctggatgctgttcagggtggttggctctttgttcaccctgccctgatttttccttcttttccctcctacccttagattttgctggaggagcttgccaacagcgatcccaagttagccctcactggagttcctatagtacagtggccaaaaagggataaggtaagaaactattttccttgatctttaggctgcttaagccttttgttagttgatcattaccattctggggaaaacaagaacaactagaggcagatggcttttggtgcattaatacaaactgacagaaaatcattattcagttctgttttgactcgtaggtcagggtaattggctatctttggaggtgacctctcttaacagaactatcaaactgggaggcctccctccagattcagatgccaaattgtgcatttgtgcatccgcttctatccttgtgaccagttactcagctatcttcacagatatgattgaaagccagttaaaataattacatagatatctaaaaggagcagagtttttctttgacgtagtgagatcattctctcaaaaatccccttaccttggactttgcagtgtggaatggaaaagagaagaaaggg

SEQ ID NO: 65974 - DNA, 1042 bp, Homo sapiens
gagcttgcagtgagccgagatcatgccactgtattccagcctgggtgacaaagcgagactctgtctcaaaaaaaaaaaaaaaaagcagccattgataatacatacacaagatgagttgtgtgtcaataaaatttattctagaaacaagcagtgggcagatctggccatagtgggccaagccccaggctaggtatgctaccatgtaatcttctaccctatccagtcttaaagcaacctgatatatttgacctcactgctttctctttccagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcagtgagtgatctgctgggtaaagaattttggggaggggtggcagtgccaaaggaactgaaatacatatagtgtagagttaaagagacttcagagttggaaagaaaaggtttatactctctttttggctttattttgtaccttttttccccaggtttagatagaaggtatctagtactaaaaatccgatttaatctttaggctttacctaattttcaaacaagagattagcatttgaagggcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttg

SEQ ID NO: 65975 - DNA, 3721 bp, Homo sapiens
tgggattcctcaccataatcctgagtgaatctctctgtagcaacccagtttctcagagaggttcttgttatctgctttattattcacgtgggggttggagtggaagacgcagcctggtggagtcaaacttagactgtggtagagctagaagccaatggtgtttaccattgtcagactcaggatcttagttcaaatggtatatgtgggctttttccaccatgaaacagaaatacgtctcttgggtgaaagaggtaagtcagagacgcaattaaaaatggtcaggccaggtgcagtggctcacacctataattccagcactttgggaggccaaggcaggtggatcacttgagcccaggagttggagaccagcctgggccgactctgagggaatgaccccctctccaacgtgacctttcttctctctggtcccctgagagcaagggaggtccaccctgtcggttcagagggtttggaagaaaggaagcactgatgttgcttttctgggcctgttttgcagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgagcagggattcagggggtcaggaattaggggtatgggagtaggtggcaggttttccatatgagaacagcatgcaccttggcatctgaaagcctgtggggtcttatgaggagtgaattgaccctttttcccaaactttgggtcctgtttaaagatgtagcctgttgtacccgcagatgtcattagggaactggccatttgcctcctggccctgctctatactttcccatgtctcattgttatggggagggagactgatttgcgggatagatttgtagtctgtgataaaacttgagagtcttgcgggctgaaaatttcctcctcaagtcagctgaactcatcacatgttggttgagagcctatgatgttctagtcactcttctggtgctgataacacagataacctcacttaagcccctgactcaattacctctccattcagtgagagaagtgggcatgcttttcaagatgaatttgaaggtgcttaacatttttcttcagttttaatgctcatccccccaaacctggatcagaattccctcttccagcaagcagagtccagttttgaagcttccttaatgagagctaccatttcttcttaagttggacagacacttgggggaaaaaattgctagtgatgatgaacaaggagcttcccattgggcattgttggtttttccttaaactctggtatatatttactctaggatatatcctttttatctgggtcacacacatcctattacagtagtgtggtgtcctgaccaatggcattcactcaggaactttttagaaatgtcaactgtcaggaccctcataggcctcttaaatcagaacctcttgggtgggcccagcagtctgctttaacaagcgctcctccaggggactctgatgcatgctcgagtttagagcagcaaaatctgctgtattgtcagcagcttgcttctgccatagaagcttcatgtgccactggtaaaattgtttcagtctctaaatagaccctattctttgcaaacatgagtttatttcccaaatctgaattaatgtatagtgtatctaaattctccttaatatttctctgtctagggctaataggactgcttggctctacctcttggttttcagggcaaggcacatcagattcccgttatgtgctgtctctcttcccctgccaaccaggctggggggcaggggctataaaatattaaattgaagccagcatgttgtggtttgtggcctgtagatttgtagactgcagtggaaagccaggcctatccctttcagttctggtctggcctggctagaaaatgtcaggatagcactgaggcagaacttgagggtgagagaggactctgtaagcctgataaagagcctcttttgacctgatacagtaatgggctgaaggcagggtgaattgtggatgtgctgagtagcaccctgcatttcaggcagctgcgagtgattgacaagggagggaacggagcaggccttcttagctttagacagtaagaagtctagaaacttcaagaggctcccttatatacacttcagcaggaaccatgccattttaatacagatgaaggggctatagactgttgcttgctatgggtccctaacaactgttgtgttctcaaacactccagaataaatcagggtaaagtggtcaagttatatactatcaacatgtaggtttgcaaagcgtctagttgttgtagagttcaaggcaattttttgcctattctgtgaggcaaaaaatgataaggtgtgatccctgtacacttgtagaagaacgagcctccaggtactctgcttttcccagaagccataagcagcctgtgatgggagctccactgatcaagttaatgaaggcgagttctcttcccttctatcacaggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggtaagtgagcagccctgccgctgtctttccaggggcccagaagaagcgggcaagaaaagttgcattattggcagtgcttcttagcatcactggagggcagtgtagggcagcagtcccatgccattgttgcttagcaagaggtttacccagggccatcttaagtgtcagtctcccaggcagcactctggactggcaggccaatcactgcaatggacagcaaagagaacggaatcagtgttgctgccagccctgcagttctcctcagcataaccactaaagaggaaatttgagtcagatgttactttggtcagctccttataagcccttgttctcttcagcattttgagctcttagaaagacaggaagtcactccttcttgtattgctctggtgggaactaagcaatcaatttaccactaaagctagaagatgt

SEQ ID NO: 65976 - DNA, 1038 bp, Homo sapiens
tcactttgctcagatcgttacggctctgagtatgctgggaaacagtgtattattacatgtctcattccatccattgcaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtatgctctggacctgacttctctgtgcttgtcttggggtagctttgtcttccaaacagacctcgtcttcagaagctaaggtagtctcagatatgacgctgtggaagaatagaagagcacaaaatgaaaacagaatgatggactgtgtacaagaatagggtaactataagcagataactacctacaaacaatggagtaagtccattttgtgagttggtggagtttggggcccagagagtgtaagcctgaaaaagtctgagaaggctttatggtggaggtggagtcaaaagctatttgcatgatggtctagaaaagtgtggtggtattggaaggggaggagcattctgcacatagccttttgctgtgtgcatgaggcataatctagcagcttgagaagaaagaaaacttgtctggtttcctagaaactgcctacacccagtgctcacaccctgaaggcatggctgggtgtgggcagttctacttaaccccttcaagggggcctggccagcaagtagctgttgctgcctggagccttgaagctggattagagaattgagagttttgatctaggctcttctcttgcctgtacaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaat

SEQ ID NO: 65977 - DNA, 1043 bp, Homo sapiens
ttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaat

SEQ ID NO: 65978 - DNA, 1043 bp, Homo sapiens
acttctggttctacatttcatcagctaccctggcctgtgccagggagcagacgtgcccgccacgattctttgtgtcgtgtggcaactccttgtgcatgcctgagagttggcctcctcctggtgccccagcgggctggggatggggcctgtccacactgccgtggtcttatcttgtgactctgggtaagtctcttccctcactgggcctcggtcttctcatctgtgaaatgtggatggcgtgaaataagagctgtgactctgcggtgtccctcagcctttgaagcagccgtctaagctctggctgacgctgcaggggtgccccatgcccatggccctcaccgcccccctgtgccatgccctgctcactgggtgtttggattgactgaacgtcaggcctgggagaggaaaattggtctgcattttgaaaaggccgttagggcctttttttttctaagacatttgcaatcagatttctcaaaacaggaaccagactgactgtcagctgggggctgtccagggagcagtgacggttagtacagaaatgagttcagaaatgacaaacccacgagggaggaaacgggggagtcagcctctagggctcaaaacggctctccttggtggctgcagcctcgagaccctcctgcaggatggagttctgcaactgtgaggcggggccttttctggaactgtctgcgttcgggtaatctccccccagaatgcattgcttctgatggggcgccgccttggctctgcaggtgtcagaaccctgagaaacgagatggtcttcttttcctgtcccctttcccatccatggtagtgatggcggtgatagcaataatgataggaattattactgacttacctattttgatatctgtcatctcagttcttccagcaaccaacctgtgaagctggcaaggccatgccttgcatgtagtagttgctcaagaaataccaggactgtgtggcacccccatgcagtcctgagcagaaacaaggttggataggattctaggaggacagcaggaggccgagccaggcag

SEQ ID NO: 65979 - DNA, 1052 bp, Homo sapiens
attgggtcaccatcagcagcatggccttccgcaaatcgcccacatctgtgaaacggactggaggtgcgagcgccgaatgtcagtgcgctaaggcctgggaagggctactggccacccctacatgggggtccaggcctggggcattagggagcaggccaccctttgcataacgccttgccttgcacacccagtggggcagagcacgccgccccccgccccccgccgccccagtggtgatcctgaccatgtttcatgtttgcctgacacttttccacttgcagagtgctttttactctgttttgtccttttgacaactgtgagaggcaggcccagcagttaggattctcccctttagcagttgaagttattgaggctcagggaggggaggagtcgtgtcctcgtcacagaagaaagctggaatggggcctcgggtttctggaccacacaggccagtgctgtttctttgctgtgctttatcccctccacccacccctgcacaccactgttctcgcctctgtccacattttgcggtgtgggctgactggcaccccttgtctggggccatcggctgtcacagttcacaaggctcagccctcttcccgttggctgggatggagaactgagctgccgtggcaaagctactgcaccgaggggcagccccactccagggtcccgtcagatgcaggagcctgtcttccccatacccacaaggtcaaggtcagagtcagggagaggggctgtggcttgtcccagtgacaggttgccactgggaattgttcataccttgaggtggcccaccttggcagcccctccatggctggtgcctggggatgtgtcttggccaagaactggggctggcatcacagctctgagttccaaaggctagggaatgggagtggttaggcacagtgccacactgagttggcacaggggcctccccttctgtcaccctatagaatccaaggaaacagtccctttccccgaccttcttgtagaaggaggtagcgtaaggcagcattgtgtatctggaagatgggaggtctggcttctcc

SEQ ID NO: 65980 - DNA, 1028 bp, Homo sapiens
tcaccctggtgcccatcgccgtccagctaccacctggggaaacagatttcaggaagagggtagaaacacaggggccccaacccagaatccaggaatcttcacgttggcagcagccttagcagctgcctggcccaccccttgcctggggccgagaccacctttgccacctccatagccagttctgcccagggagcccaacccacaccatccacaatgatgggaaggcctctgagagaggcgtggctctgtgaccttacactgttgccttcagggtacctgctcttccgagacttctgcctgaaccacctggaggaggccaggcccttggtggaattctatgaggaggtgagacccagaggcccaagccctgctctgcctggagaaaggggaggaggttggggcggctttgtggaacccacaagctgcctggtgtgggcatccccattccctgctgggctctagatgacctgcaggaatcctgtcctccagatcaagaagtacgagaagctggagacggaggaggagcgtgtggcccgcagccgggagatcttcgactcatacatcatgaaggagctgctggcctgctcgcatgtgagtgtcctcagctggccctgtgtgctggcccagagtcacctgcagattgggaggggaagagaggaccctgctgagaattcatggccacctctgtcttccccagcccttctcgaagagtgccactgagcatgtccaaggccacctggggaagaagcaggtgcctccggatctcttccaggtgtgtgcctcccggtccctccccaggcaaggtcaccttggacagcccctggtcaacaagcctggtcagccaggggtggggcctgggcaaccacggtctctcggggctcagtcaccaacttccagcttcctcccttagccatacatcgaagagatttgtcaaaacctccgaggggacgtgttccagaaattcattgagaggtgagagcagggaagtgtgggagaggaagggggagggaggggccgctctcagaagg

SEQ ID NO: 65981 - DNA, 2417 bp, Homo sapiens
gccgtgctgttacccccgcaggctcctctggccccagccctccctgtctctgatttgtgtcacacgctggtcctgggtctagtctttccctcaagcgccccctgaggcagccctgggcccctgctctgagggtgggtgttgactgccgacctctgccccgtaggtacgccatgaagtgcctggacaaaaagcgcatcaagatgaagcagggggagaccctggccctgaacgagcgcatcatgctctcgctcgtcagcactggggtgagctgggtgggccgggctgccgctgaggctctggaaccccgggcgcccctgctaactgcccgccccctcccctcctctcccctcctaggactgcccattcattgtctgcatgtcatacgcgttccacacgccagacaagctcagcttcatcctggacctcatgaacggtgagtgctggccgggccctagggtgggccgggcccaggcacgggaggctggggcaagacactgagtgctgcctgtgggactgcctccctcaggtggggacctgcactaccacctctcccagcacggggtcttctcagaggctgacatgcgcttctatgcggccgagatcatcctgggcctggagcacatgcacaaccgcttcgtggtctaccgggacctgaaggtgagcgcccctgctgtccccaggctggacctccgtggctgtcctctccttcctctcgacatcccggccaccaggcccagaggagtggggctcctgggacatggccgccccgtatcttcccatctccgcccctgcccttcccaccgagccactctctgggtccaggttgtagctggggacaggagagaggacccccacctttgccctttctttgggtacccatcgtcctctccagtgaagcagtgacccagctggcatcttgcctggctgggccccatcctgagctgccccaggcagctcactgggcttccttcacagccagccaacatccttctggacgagcatggccacgtgcggatctcggacctgggcctggcctgtgacttctccaagaagaagccccatgccagcgtgtgagtgccccccaccctctccctccccaccccttgccactcccgcttatggcccccttgctcccacaggggcacccacgggtacatggctccggaggtcctgcagaagggcgtggcctacgacagcagtgccgactggttctctctggggtgcatgctcttcaagttgctgcgggggtgagtggcccatcccaggtgggcaggtgggttggggctaagagaagttcctccccaatccaggtgggatgccaaaggaggggagcccatagctgccttggtggtagggttggcaccgtccctgactttggccacagctcatccatgctgcctgcctccctttccccattcctgtcctttgacattggtttttggcctttcttgcccaggcacagccccttccggcagcacaagaccaaagacaagcatgagatcgaccgcatgacgctgacgatggtgggtgcaggtctcagtgcagggccgcagggggctggggggagctcctgtgggtgccaggccatgactcttgcttcccaccagccagcagagatctgggccactgacccctactctggcctctgagacagacctcctgccccataggctctcgccctccccgtgctgttggagcatgactgctgggcgagctaggatgctgtgccccatctgtccctctgcgggggcctggacccctctctcccctgagctgggatggggtcaagggctcttcctaagcccctgctaatgtcccactcctctctaaaggccgtggagctgcccgactccttctcccctgaactacgctccctgctggaggggttgctgcagagggatgtcaaccggagattgggctgcctgggccgagggtgagtaccctggcgccttgggcatgctgctggctgtgcccccatgaggacaagggctgtgtcccgtcacctggaaccccctccaaggtcccagcctccttggaggagctcataagttggggcatggccagccctgtccaatgttctcagagtggaggggctgccctgggagttggagctgctggaaccagctagtaactggcttccagaggggcccttgtcacagatgatgatgatagcagctttttatgtttatcaaacatttattaagcactgggcatagggttgcaaaatttaccagtgttaaaacccacaaccctacgatgtaggaacttctgttctcccatttgagagatgaggaaacagctcaggcttaaggaacttgcccaagttcacagagccagaaagtggctcaatcaggagttaagcccgggactcagggtggggctgagcccagatgactggcctctccccacagggctca

SEQ ID NO: 65982 - DNA, 1047 bp, Homo sapiens
ctaccggttttctgtgccaagccccttgctaagggctgaggaccatggataaggcagacatgactcctgccctccaggagtggagtccagagagaagccagccgagggagtgggtccctaactatgacaggcccagagaggggtctgcaagagcccttgtcccgaggcaagtccccagccagctctcagacctcacctctgtactttgctggacatctcgatggggcggccaatgttccgtgactccaggctgaagttggggtcgaagtactcctcaggggagatggctgtggggttggtggggctggctgcctgctgcacgggggcctgcgtgggtcccagggcggactcagccatcaaggtgacagagggtgccctcccgcccaggctcggccccccgccagccctgtctcggcccagccccggctcaccccggtgtgggaggaatgctgctgcgccatccccaggaaggactggaatggagtcttccccgctacggagaaggggtgggagctggtaaggggtcacaatgctcgcatcgcccctgcccacctccacccctggagcctactgtctgggggaagaggggtcagacgggaatggggaggcctcccagctcatcctgggaaactctggcccctaatcccaggccagggtgaccccaccacacggtgtgaccgggcagcaggcaggcgcacctgggtttacctttgctcctcgacttgtcctgatcagagaggtgctccgtgcgtgtgcgtgtcaccagctccacgttggtggcactgtacacctggggagcaggggacacggggagctgggggctcagagcctgctccccacactcagcctcaccagtgcagaacccaggtcctcctgtcccagagacagatgagatcttgctccccaaaatggaggaggtggcagggtctgaaccccaggaagtcaccaacgaggagatgcagccccagggtcaagaggaacacactcctcttttgatctcggtaccctgggtaggggcccatgatgtgggtgagccctgtgtactcc

SEQ ID NO: 65983 - DNA, 1073 bp, Homo sapiens
aagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattttcaatgtgacgatgaagccatctgtgttgcagtcagacccttctctgctggctggggaaggtggccgccccttcctcccagcagtctcctcacaattccaaggtggctcgtgacagacctatttgggggagtgccgtgtttgggcgtggcgtgggaggaagattgggtaagagaagagaggaagtcagtgctatctccccatctcctggggcagggcctggtaaatatgacctgctcacacccacccgctcagacaggtcgggcaagggaagaagtcgtcagcgggcagcaggcatgtggctccactgtgagagctggaaggggttactcatgaggaagtgcctacctggacaggaccaagcctgttccaaaagcgaagcctccttggga

SEQ ID NO: 65984 - DNA, 1065 bp, Homo sapiens
cctaagcaccctggcacatctgcatggctgaactctcaccctcactgggaaaggtcagcctgggggtgtccaggccagggactgaggggcagctggctaaagtggctaaagacatgtgctcacgggtgcgcctgcctgtgcagctgtctgggtggccagtcacttccttgggctaagagagagagagtgtgtgtgtgtgtgtgtgttcatgaggagagccttggttcctagggcccagggatctggatggaattaggggctggccgggggtggggggctgttgcaggaaacgtgagctgtactcgttagctcctcacgtgctcagccggatttataaacacacagagaagacgggatgtaaacaatcagtgggcagcagccagaggcagagctggggcgggggccgggctgggggccaggactggtggggagggggagagggggacctaggacacagccccagtggccggggtccacctgcacaacatgagcctgagggaggatggatgagggctccaggaagcccaccacgcactctcctcaggaggcaggcgagctgtgttgggttcccaagctcacgactaaaccgcaggtgttcaccccacgctgctttccctcctgctgcctgagacacgggcatggctttgcccagagtggaagctgtcatagcaggggcagagccctgtccttctaccccccctttcttttctcctaacctcttctccctctggattcctgagaacccttccctctttctggttctgtgggccgtcggatccttctgttctcccctgccccccacccgcagcctgcaacgacacagttacctcagaactgaaatattcctggaaacaccggcctcgtctggttaatttcatgagccgtttttttctgcccagatgacttagttcttgtctatccaaaggcttctccccctgctgtccctgtgtagggagctgatctcccctagggatgtcccacagggctcagaatgggagagggtaagttctgagctgggttcctgactgtacctcttggccatgacaaaggcagagcctagaactc

SEQ ID NO: 65985 - DNA, 1036 bp, Homo sapiens
ccatctcaaaaaaaaaaaccagactgtgtgccaggtggggatgcatcagctggaaggtattccccttcccctgggcttccgggtccacgtgtgtaaaatgtaagggagtcctggagaaactcactgacccctactctccccacagtaccaaggctctggtagttcttggaagggcccagggcatccctgtattcctgcagggcctgcccgtgccttgcccctcaggtcctgtggtagtgcagaagatatatttatctctgccacccttgctctccagacccactttcaaatgagttgaattgatacataataattgtacacatttggatacatgcatacactttgtttctccctctccttcccttctgctcccctcgtcaccagcccttgccccttccgtggagccttgggggaggaggttactcttcccttccccttcccgggggatccatggaaatagtgcccctgtccctgggcatccggctcagtatgctggagtcatccttgacctcatgctcgccctcacccctacacagtctttcagttaagtcctgaccactctgcttcccaaacaggtggcaacttaacaggtggcaactttgccctcctcttccatctccaaggcctaggccaccatcctctcacctggatgactgtaacagctctcagtggtctcctgcctccaccctgccccctccaggccactctccatacagcagcaaagtgaccctcctaaaatgtccattgtgtcatgcctctcccgtgtttgcacactccagtggttgccataaaatccaaactctgccctgaacctgcaggagccgccgccacccatttctccacctgtggcctccccttgatcacctgcacagccatgccaaccctgtgggctccctgaaccctccacttccttttccacctggggattttagcacatccttagctgtccccaccacttggcatcgtcttaccccttctaacgtggcggtgcttctcttcctccaggctcagtgccgtcttttctgcccccaccagc

SEQ ID NO: 65986 - DNA, 1133 bp, Homo sapiens
ccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatgtgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggtgagtgggcagccggccagccaaggggtgcctcagcagggaggtcggcgaggcccactgagaccctatcgcccatccaggggtgcggaagactcacaacctgtccttccaggactgtgagtccctgcaggccgtcttcgacccagcctcgtgcccccacatgctccgcgccccagcacggtgagcacacccctgccctcagctcagccccgggtctctctcttccttctttggggccccaaggggttgattttagaaggtacctctttcattttccctacagagtttctgtgaacctcaaagacatcccatggcccgctatgtgctcaggtccttacctggctctttaaaggcagacggtggcatggaggaggggcaggcgcctccttgctccattctccttactgttaggagcctg

SEQ ID NO: 65987 - DNA, 1081 bp, Homo sapiens
accaccctaaatgcagaccaaggaattggcccccgtctctcactacccaaaagagctctgagcagtgctggctcaaaagaacctggggaaacagatgtcaggacccaaagggatcttcagtcaccctgagaaatgagcaggaccttgggccacttgaatgcaagcagtgaccagcatggagcagggggagagcccactcctctctgagctggtcctcgccagggacgtttgcttcaactggagtccccatttccctggccccagacagcccccagtgctcggactgcccagaacagctccaccccatagctgattattcagcctccctccagcctcctgccctggccttggggactcctcgatcctgggcagtcaggaaaagaggctgccgttgaatggggaacacctctggaaggatgcccaggccggagaaggggtctgagcctctgagccacaggttatgggcagaccttcaaggttactcaagccagacaagagatttggtggcaggccagaaatgtgctccctagaggaggagttggaatgggtttgagcagccagaaagtcaagtcagacctttgggatggagaatgcaggctcctaacagtaaggagaatggagcaaggaggcgcctgcccctcctccatgccaccgtctgcctttaaagagccaggtaaggacctgagcacatagcgggccatgggatgtctttgaggttcacagaaactctgtagggaaaatgaaagaggtaccttctaaaatcaaccccttggggccccaaagaaggaagagagagacccggggctgagctgagggcaggggtgtgctcaccgtgctggggcgcggagcatgtgggggcacgaggctgggtcgaagacggcctgcagggactcacagtcctggaaggacaggttgtgagtcttccgcacccctggatgggcgatagggtctcagtgggcctcgccgacctccctgctgaggcaccccttggctggccggctgcccactcaccgaacttgcaatgcagctggaccaccaggcggctgctccggccattcagggagatgcagcatttttccac

SEQ ID NO: 65988 - DNA, 1734 bp, Homo sapiens
ggactctttgctggacggccactttgtcttggccacactctcagacaccgactcgcactcccaggacctgggctccccagagcgtcaccagccagtgcctcagctccaggctcacaggtgagggcacctccccccaactcctcctctctccatgtctgtgcactccagcctgagactgcaactcctagcttctgcacctccccgcaatgtgttctctcccgccccttctctttctatcaggccccagcccctaaccctatagtgctcacagctgccagccctgcagactcagccttctcggttagctgtactcagagacccctcccacccagggaagcatccccaaggccctgccagcttccttctctggctgaggccgcccctctgagcctcctcccaggccaaggagggaaagggctgctgggaggcaggagctgcctgggctgggggaagcaggtggctggaagggcaggtgggctggggaggatggcccagtgcactttcagcacaggaagttggggctggcccccagcccagcctgtccctgggctcctgtgctttccagctcctgtcccctgggaaggtgggggcttgggctccatgtggcccagttcataagacttgctgctcctccctcctagctgagctaaggtagcccccgggatgcctccctcaggcccctacctgaattctgatcaaagagattcctggcccaccccctccaggaagtcaccacttaacccctgcatcctctcctctccagccaaatcaggaagtcataaaaccaagagatctccagtggtcgggggccccagagctcccttcgagccctccaaggtggggccctgcctctgctcccccagtcccctccctgatactccgattctgcctacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaaggtagggactggaggtggaggcaggggtgggaggtagggaagggagcagcctccagaactcacttgttctctttccagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttc

SEQ ID NO: 65989 - DNA, 3172 bp, Homo sapiens
tccgtgaatgcgaggtccaggctgtttttatctcttgagcctcagtttcctttcctgcacttggagcagttaaccctcagtgcctagcagccggttattaacatgttcacaacaccttccacccagggaaggggtgggaaagtctgttgggcttttgaaagagaaaaacaacttccacagtccttccggccccacatcctctgaacagggctgggcgcctcctctggggcgtaaccagcttggtcacgcccccgacagaccccgcccccagcccgccgccgaggccccgccccccgggccgccgcgcctcacgtccagcgggggcgctagagggcgggggactgggcggggcgggcccgggaggcctggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaaggttggtcggggcgggggaggcccgcgtccgccgcgccctggccccctgcccggcccggaagtggcgcgcgggcgggcccccggggccagcttagactgggcggggacgggcagcgaggttccgtggccgcagctgcccccccgcggacgcgcctgagaggtccggggccagctccgacgcgcggagcagctccccccctctcccgggctgggggcgcacgggttgcctgggctcttggggcgagggagaaacccgggaagcccggtccaggaaggggtcctgcgctgtgaggtttttggtggcagccccctgcgcacgacagtcgcctcccgaggcgctgagggtagctgggggcttcccctgggaggcttgaggccgcggtcccgggaggctcagcagcaacagctgcctgtgggcaaggaggggccgaggaggcctaggcgcccccggaggtatccatggggccacccgtgtcgcccaccctcctcctgtcagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgagcccccggcccaggtccccttgccttcctaaaagtggcactggaccccacagagttcctggagccctcctcccttgagcgcagtcctggccctgggttcaggtctagaccttgcatctagcttacccggttccctgggtcacaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgtgagtggtctgagcgtctggggctgcccgggtcctgaaccgcactctttgccattcagtgggaccttcacattggcctgatatctgacagacacttgatagactgtgcgctccacgaaggcggggcccaggtccgttctcgtgcctgccctgcccctcctggcatggggtctggggaatggttgctgactgaagggctgcccggattctagtgctttcccccagggccctgcctggtgacactccccctacatttgctactaagcacttaggatgtttgcagatgggctctgctgtccagaagctgagataaaccagacctggacttggcccggctcatgggtgggggcatgcgaggagtgccaaccctgaggctggtccagattggaacttagtttccagtggactcgggtgctttagaattacttctggcaggaggccgaggcgggaagatcccttggacccagaagctccaagttacagtgagctatgatcttgccactgcactccagcctgggtgacagagcaagaccctgtttctttacttttttgagacggagtttcactcttgttgcccaggctagagtgcaatggtgtgatctcggctcaccacaacctccgtctcctgggttcaagcgattctcctgcctcagcctcccaagtagctgggattacaggcatgcgccaccacgcctggctgatttttttgtattttagtagagacgaggtttctccatgttggtcaggctggtctcgaacttctgacctcaggtgatccgcccgcctcggcctcccaaagtgctgggattacaggtcttagccactgcgcctggccagatcctgtcttctttaattaaaataaaaagtaactagaattgctcctggaaggctgacaggtggcaggggtggggggtggtttgcatcggtgcctgactctctcctcccagccacggctgaatagcccagggaccctggctgagggtggggtaggcaggcacctcacagccacctccccctgggcaggcaagagacgctacaacatcaaactgtggaaaaccttcactgactgcttcaactgcctgcccatcgcggccatagtggacgaaaagatcttctgctgccacggaggtgagggaggggatggctggggaggaggagcactggccgcatccctcagcacccggcagctctccttaggtctcatctgggaagtcactccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaaagctgaggggaaggggatgacttctgcctgtctaggcgcccaggagaccagtggcgggaccaggagggtggtgggaaaggtggggttcattggccaaggcttcctggagggaggatgtccttgtttgaggaagtgaccttcccccggccccccaggcctgtccccggacctgcagtctatggagcagattcggcggatcatgcggcccacagat

SEQ ID NO: 65990 - DNA, 1015 bp, Homo sapiens
tgaggctgccaggtccctgctctactcccgccttcaccctgtcttgtttctgcagcttctacctggctgagatcacgctggccctgggccatctccactcccagggcatcatctaccgggacctcaagcccgagaacatcatgctcagcagccagggtgcgcatgtgtgtgcgggcagctgcaggcggggtctgcaatctgtggggagggctgaggacctctgtgggtggggtggggccctggtcacgcctctccaacacccttcctcaggccacatcaaactgaccgactttggactctgcaaggagtctatccatgagggcgccgtcactcacaccttctgcggcaccattgagtacatgtaagtggcacctggctggcccaggggtcgggaggacagcccgaaggggcacggcctgactgacagttccacctggaccccagggcccctgagattctggtgcgcagtggccacaaccgggctgtggactggtggagcctgggggccctgatgtacgacatgctcactggatcggcaagtccagcccccggggaggaggaggggcaggggcagaggtgggagtagcccccctcctggggcaagggcagggcctggtgggaggcccacaaggctcctctcaccttcctcctcctccagccgcccttcaccgcagagaaccggaagaaaaccatggataagatcatcaggggcaagctggcactgcccccctacctcaccccagatgcccgggaccttgtcaaaaaggtgcagctcccttctctcttctccggggccctgccagccattctgcacgtgttcctgagtctctctgggctgtggggaagccagggccaccccggcctgtgcagtttgcctctgggaatgaaaggagcccctcccttgaagtcagggattgagcccaggtctcagccctgtcacagaccagctgctgccctggcccagtccttaggctgagtcctaaccagtgacacgcttgtgatgagctggccacac

SEQ ID NO: 65991 - DNA, 1024 bp, Homo sapiens
ggcagggccccagggcagagggagtgaccggggggcaagcagggtgagctgttagtgggtttggtgcattctctacctacagagacatccctttttccggcacatgaattgggacgaccttctggcctggcgtgtggacccccctttcaggccctgtctggtgagcagcagggctggtggccagtggccggtggcgggtggcaagtggagaacctgcatcttggtgccctctgacccctccccactctggtcggcccacagcagtcagaggaggacgtgagccagtttgatacccgcttcacacggcagacgccggtggacagtcctgatgacacagccctcagcgagagtgccaaccaggccttcctggtgagtgcgggggcctgaggcctgtgggaccagggcacggatcgtgactaaggatggcaggcactgagtgtcgcatggccctgcctccgccccccagggcttcacatacgtggcgccgtctgtcctggacagcatcaaggagggcttctccttccagcccaagctgcgctcacccaggcgcctcaacagtagcccccgggcccccgtcaggtactgagggacgtgggggtgtgtggctgggttagggacgctggcaggcaggatgccagctccagccttgggtgccttggccacgtctgtcggccagtgttggcttcggttgctgtgtctatcatggggacctcagttcctacaccccttgtggccaggctgcctggatgggagtttgtggagcccgcggcctgtgtgcctgggcaggtgggaaaggctgccttccctgactgagtgctgggagcctctggcagggcctaggaggctcttattctgccttggtttcccctgcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtcc

SEQ ID NO: 65992 - DNA, 1073 bp, Homo sapiens
gcctgcggaggtcctggggtgaggactggaagtggaggatgccaggagagctggcggtgggtggggggggcggtgagggttccacccgtggctcctccttgcatccccaggttctacaaactgcatgagcgcaagtgtgagcccatcgtcatgactgtgccaagaaaggtgaggccgcccgtccctcggctcacttggccctttctccagcaagcgggccatgcagttgtgaccagggcgaggcctgtgaatggaacatgacctagtatggtttgtgggcagtgagctggacagatgccagcttgcccttgtaccagccagctgttgggctgtgccagtcagggggcaagtggggatgagacagagggtgagcaggggccctgctctggatgagccacaggagaaggacaccaggcagtcagggagggagtggcagccacacagatcttcctgaaggaggcaggacccataacacagctggggtggcgccatccactgggggcaggccaggcgaagggcacagtggtgggaatggagagaggaacaaggagtctggctgcagtggggaatcccatgaagaggggaccgggccacatgtggcttggcctcagatgccaagagcctcggacacgcttccatgattctctggccagcatttgccgactgctctttcaacatgccaggcacattttggggagtggagctgagctgatagggcctgctccaggagctcacagtccatgggccccagaatcccataaagccacatagtggcccctgtgccttgcaggggaaggtgatgacaggggccttgctcagaagggtgggaaagcttccgagggagctgttgatggtgtccagaaaggaagttaaaggccagatttgagctttccaggccgtgggagaatgggttaacagagtgcaagcctggaggccaggggagggatgaggggaccctgatggggcctcctaactgatcctgacctccccggccccctgcccagtcggacctcttccaggatgatctgtaccccgacacagccgggcccgaggcagccctggaggctgaggag

SEQ ID NO: 65993 - DNA, 1964 bp, Homo sapiens
ggagcatttacctctcagatcactgcctgcggggtgacaggcggccaggctctgcacctgtgaccccattctgtaactgggtaaaccgagacccaggagggttacggtggcctggcccccggttgcatcctcccggctcaccttcagcagcctggggagggctggagttgttgggatgggccggactgacccaggcctctctgtcccgcagacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaaggtgggtcctgtcagggttgggggaagaggaggcacctcggccacccctactgggcctttctgcacaccttgaatccctcatcttgccgtttctcacactgctgggcaggtgttataacccagatttatcgccccaagtgttagcacagatggaaagtagcctgttgccatagaggcagggttagaggcagcaaacatttcctgctcacctggcaagtggggcacagtcacatctgggccacctgtgagccgggacgtgcatgtcattcccactccatggaggggaagaccaaggcttcgggagggatggagcccactgactgccccctcgtgcccacagacgggccgcattgacaaggcctacccgacggtgtgtgggcacacgggacctgtcctggacatcgactggtgtcctcacaacgacgaagtcatagccagcggctcggaggactgcacggtcatggtgaggcacaggactggctgggccagggtcgtgggtgtggccgaagggggccagcaataggaccagcagaggactgagctcggtggccctgtccctaccacaggtgtggcagatcccagagaacgggctgacctccccgctgacagagccggtggtggtactggaggggcacaccaagcgagtgggcatcatcgcctggcaccccacggcccgaaacgtgctgctcagtgcaggtctgcaccgccccccgttttgtgctccccccccccacggacccctccatacatcccagcagcccctccagggcccacatgacaaatgggaaagctgaggccctcagagttggagagacccgtctgtcccagggtggtgggcagagtgggcctcagcctggtgagctaatggcctcctgccacccacccggcccgagctgacaaccctcacctgccaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagtacgtggctctggagggcaaggatggctgtggataggcccaggaccttgagcagggcgctgcactgaccagcctgtccccccgacaggagcgggagaaggctcatgagggggcccggcccatgcgggccatcttcctggcagatggcaaggtgttcaccacaggcttcagccgaatgagcgagcggcagctggcgctctgggacccagtgagtggccagcctgagggggcaaacttgagacttgggccccaccctgggccaggcaggcagggttcaccctggggaggcctgtggttcctagcttctctgcctggaacttgaggctctcagggcctaggactctgtcagactttcctctcctgccccctgctcgcccgactgccccaccactcccccatggcctcccactgcctctgtgtctttgcccatgttgttcatgccaacggaagggccc

SEQ ID NO: 65994 - DNA, 1017 bp, Homo sapiens
ggcgcagggagggatggtgacttgcctggagatgcacagcaccgtctctcccatactcggtcattcacaccatcattgattcaccaggcacccactccgtgtccagcaggactctggggaccccaaatggacactaccatggaagctgacctgggtgccactggccacaggccccgcacagagcttgatgatgaggactcctacccccaaggtggctgggacacggtcttcctggtggccctgctgctccttgggctgccagccaatgggttgatggcgtggctggccggctcccaggcccggcatggagctggcacgcgtctggcgctgctcctgctcagcctggccctctctgacttcttgttcctggcagcagcggccttccagatcctagagatccggcatgggggacactggccgctggggacagctgcctgccgcttctactacttcctatggggcgtgtcctactcctccggcctcttcctgctggccgccctcagcctcgaccgctgcctgctggcgctgtgcccacactggtaccctgggcaccgcccagtccgcctgcccctctgggtctgcgccggtgtctgggtgctggccacactcttcagcgtgccctggctggtcttccccgaggctgccgtctggtggtacgacctggtcatctgcctggacttctgggacagcgaggagctgtcgctgaggatgctggaggtcctggggggcttcctgcctttcctcctgctgctcgtctgccacgtgctcacccaggccacagcctgtcgcacctgccaccgccaacagcagcccgcagcctgccggggcttcgcccgtgtggccaggaccattctgtcagcctatgtggtcctgaggctgccctaccagctggcccagctgctctacctggccttcctgtgggacgtctactctggctacctgctctgggaggccctggtctactccgactacctgatcctactcaacagctgcctcagccccttcctctgcctcatg

SEQ ID NO: 65995 - DNA, 1093 bp, Homo sapiens
caaagcaggccccagtgagggccggggggacagctggagtgctgggcaggcaggcacgccctgctcctgctccttccacccatcggcctctgcctcccaggtaagccaggcctcactggtcagggccccagtctcggggtgcctggggctctgatccaatagggaatggagacagcagagggggtcagcctgaggaggaaccctgagggtacggagggcaccaaactaaaggccaagtggctggagccgtgggccgtgggcaggggccagcccttcagggcatccgttccctccccagactataccaccacctgggctctcatcgccctcaaagggaaactccctccccgctgccagcggggaagggcgaggtggggctgcaggcctcttggatcccaggtctgggtgccctccaactcccctcaccctcaccatcccaccaccatcccactgcagagcccctccccctctctttagcagctccaggagacaaacaggggtcacctcctgcctgagctgtgggaagcgggagagggccgcggtggggtggaagatgctggagaggcaccaggggctcctaggatggccctcctgaccccaggctgtggggtcctgaggctcagagacctcatcctgagcccatgagtgacactcgctggaggggagggggttcccactgccccagactccctaccttcgggtcccctgggcccatgggaaccagagccctcccttcttggaatcctaaacactcgaaccccagaggagcaggcataaaggggccttgtgatgagcggaccaaacggtcttcaaactgtgttccctggaaccctggggggtaggggtactcttccctcccttaatttgagcacccccttttagtccatataggagttccactagaatactttttttttttttttttttgagacagagttttgctcttgttactcaggctggagtgcgatggcacgatcttggctcaccacaacctctgcctcccgggttcaagcgattctcctgagtagctgggattacaggcatgcgccaccacggccagccaattttgtatttttagtagagatggggtttc

SEQ ID NO: 65996 - DNA, 1097 bp, Homo sapiens
aggcgtgagccaccgcgcctggccagccagttccactcttaccgctgcctgtacctagatgctcccctgcccaccatctctgcccatgcacaccttccacaccctcccacaccaaggtggtttgcctcctgctccaggaagtccccctggacggatcctctagctggtagtgatctgaaccatctctgacccatccctgggccccagtcccaccgcctgcagggctctaggccttcccaaggctgagacctgagtgagaggccagcaaggatgccacccagccctgcccccctctgcccacctcaccacactccgcacctctcggaaggcgatgcgcagctctcgcacccccagcatgtgcgccgtctcctccctcagctttgggcctatcagttctacaaactcctcaaagtccacacggccgcccactgcagacccaggaagagtgtcacaatggtgagggcataaggtctgaagcccaaggagggacatcccacaggccaggcacccccacccccaggctctgcacctaggaagaaacacccgtgtccacgcctgcagcagataggaggctggaacccccgtccttggctgctggggtaccagggctgcttctgctcttagtggagaacccaagtgtgcaaggaagagaccaggctttggagccagatagtgcccggttcaaatcttggccctgctgctgatgtgcgtggcattggctgacttactgccctcccttcctcatcctaggagcagggtgaggagcctactccatggggttcaggttcatggccatgaagtactggagcccagtgggcagcaataaatgccacctccgaacacacccatgtggtccgtgcctcagttctaagatgccatcagtcactcaaagcactcatggtcacccaacagctttggggacagaaaagcatgacaccaaatgtccagctcaattgtaaatcacatccccattttgggaattttaaggaaaaaatgcaggagtcctggaatgaagtgaatatgagatttgtctgaggacaaaccagcgaaggggaaccacacagttcctgccatcagacactgagtcgcaaggcata

SEQ ID NO: 65997 - DNA, 1089 bp, Homo sapiens
ctgtcactcatggttgtaggagtccaggcggccaagcctccatccagatctgaaacccccacagcgtcagctccctcttacaaccccagctttgatttctttgtctttgatacatggagccatccctttctttctttcaagctcactttttttacacttgggttttttggttttttgtttgtttttttgtcttttatttttcctttttgtggagaatggggtctcagtatattgcccaggcaggtcttgcactcctgggctcaagctatcctcccgcttctgccccctgacagctgggcttacaggtgtgagccactgcacccggctcaagttcattaaaaaaaaaaaaaattataaacataagtagtggaaggggtccagccatcctctccattcatcatgccactggggggtccccactgaatgctgccagtgccagggaactccctacctcccagaggtctggagagacccaaatcttgctcacactgaggaacggtgggcagctgagagcaggtcttctccaggcagcttgagtaggaggaggtaaggatgagggtgggcaggtaacataacaagccaacattgaggccaggtgttttcagggatagaagtagtctgggggctgctgggtctccatctccatcctggaggctcctgggggaggcctgcagcctgggtctggctggtgtctggggccgcaggggcaacagatattccctcctggagcctcagtggcgggagagcatcatcacaaactctgcgggagagaagggcagggcttgggtcagtccacgtcagggatcccaggaggtgctgggctcagcctaggccctggaagcacgggagggttttccgggaaggagactcaccgtcaaagtctacggtgccatccccattgaggtccacttctcggagcatctcgtccagctcaggacccgccagcggctccccgagcagagccggtaccgcctcccgcagctccgccaccgtaattcgtccatccctgtccctgtcaaactaaggtccccgcaaagctcagcccctcccacccaaagctgcctcagcctcagccagctccactctttt

SEQ ID NO: 65998 - DNA, 1051 bp, Homo sapiens
tgaccgggctctggtccctcccgcaggtgtctccagcgccatcttcttcgtgccgggcttcctgttgttggtgcctggaggtgcgagcgggcaccggggcggaaggggcgggggctgtggggcggcactgggggcggtgttgcggggaggggcggggcttctgcgctgacaggccccgccccgcagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaccagaggcaattgctctcctcctgtcctgccactgctagcccagcccaccagcctgaccacagcccccctcccaaggactgaccctgacgctgaagggcttcgagcaccaccgaacgcgtggcagccctgatgctgaggcttgcccaagggcacggggcatgttaggggcagagctgggcgtaggactcctgccttgccagccaggagccggccggaacagcctgccccacccccagcccttggatgactcaaccagcccgtctctgtctggtggccctggccgagggcacgcagagatgacgcaggcctgggacctggaggctggtatcctagttccagcctggctctggggccctgggctgccacagccagccctgaatgtgggccatgtcaaggcaatggcccagccccctccacccactgccctccttcccagtcccagaggttgggagaacctgggggcagagggcataggaagccgcgcctgacagacaccctcagtggtcaaagacttagaaatgcaga

SEQ ID NO: 65999 - DNA, 1010 bp, Homo sapiens
ctatccttcatgagggaaggaaggacatctggaggccacctgagccaagcctagaggatgtccagtattactaccagagaggtgttttgaatcgaattgaaattgagtccatttccagggaagagcatgggaatttgtatttcaacagggcaaccttgaggattaaccaaacctctaatttcatctagccgtcattagatttgaatttcttttgccgaaagtggaaagggagtggggaggcaggggtcctcctctggagggcagtgggtggggctgtggagggttgctgagaccccaccccacccccaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctcagctctgagcctttctgggtctggttcttcagctaagcctgggtgggccaggcagagacaggggaagaggagactatggatggggagggtgtgattaaatgaggtttgacttgcctctgtaggccatcagcctttggtgggacctgggccctctccgccccagccgtggcgctgagagccctgggc

SEQ ID NO: 66000 - DNA, 1946 bp, Homo sapiens
ccgggcgcggtggctcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggtgagacagtgcccttagtgtgttgggtcccggagcaaggtgtccccttcattgccttccctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggtgtgtgtgtgggggcggggcagatgtggctgtgggagagaccttgggggtggctggggtttccctgggcctttgggctctttccttagaaacttagcatgaatgaggtgggcacatgttcccaggccttaaatggatgggacttactctgtggacttccacaggggagacttatgtagcagaatcaacacatgattttgactcaggcagacttagttcaaatcctagctctgcctcctaatcatagaggtttgggcaatttcccagcctttgtgaaccttagcttcctttttgtaaataggtacagtgatatcatgcaaggattaaagagataatgttcatacagcttttggcctgtatgctggttggcacataaagcaaatgataaatgtcacctgctttacctccttttgatggtagagcttgaggaatgctctttgtcaccaagagtagaatctggctctcaggggcagacacaaggagagatgtttggatgagctgaatgaagacctttcttgtggtcatagccacccaaagacagaataggcagtgagctccctgtcattggtggtgagcaagcagagcccctgggacatgttgggagggcagtaaaggattggctgtcagaggagacatctttgaggcctccctgggtggagtggggtggcatggagttgaagacccagtcctgatggccctgtagcctgtctgacctgtgggcccctgcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacctggtctgtcagtggttgaactgggggagtggtggccagtcctgcatgcatcccaaatgggacttggctcccaaagcctccttccagggctcctaatgctgctggtgtaaattttttttttttgcttcaaaaatatagtattttttataaaacaagtagcaagaag

SEQ ID NO: 66001 - DNA, 2780 bp, Homo sapiens
tgtgtttagcaagagagcggaataattatgaatataaacaattcctatttggagaaaatacattatgttcattgcttggaactatgaataatacttatatctgtaggaaatatagaaaaataaaataggttaaggcaataaggatataggcaattacatttttattttaattttataaggacttttatttttcctttacagactagggtagttaggagacctgatagtagctacttcgtttttattttcctggcagcaaagcagcttacttatgtgttccttcttgcttatctgttccagatcatagtcaagttttccaattcgttttactaagctagcaaaattttttataccaggagcattaggagcttcaccgtgggaggccttcaagggcttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtcccctccgcaccagtgctgctctgtggctccaccttcacagtgcctgttctgaggctaagggcatggggtgaacaaggcaatgggcatctctggagtttggggtccagcagggataagaatgataaggggatattagagcaggggctctgccatgggtgcaggaccctgggacacacctccctgccaggaaacttgccccaccccctagcagccaccagttctcttcccatttccctgaaggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggtaaggcctggggccagccaggtggtgggggggtgcgcagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtaagggttcacacaccagccctggtccctgccctcctggttgctgtctccctccctgggcctcccagaaaaccctcttgccagcactcaggtctcagttcctgcagcctgagataaagcaaggtggaagaggagggaggaaggctgctctgaggagaataccccggagtctgggcagcacagggggcccagggaggctggaggaggccagaacgctgggtgggctgggaagagcttctggaactgggggaggggctgctgctagggggctgaggcccaggcttctgtctggccgtgggtgcctgctaattgcccctcgtcacccagacggacatcgtgaaagccatcgcccgcctcattgagttctataagcacgagagctgtggccagtgtaccccatgccgtgagggtgagcatcgggcaggttgggggcttgcttgctgtggcttcatttaacctcctccccaccacgtggcctgcagccctcaagcgccgccccacatcctggctggggagatcatcaggccctctcttgtggctgtggctgcaggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcaggtattcaccacccttctgcgtagcacggagggtgggtggcatcaagggcccagggtgttgggggatttttggactctgtttcacatggtccccccaccgaccccagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccagctgccgctgctgtgactgtgctctttaccctttacccagcacacgatcctcaagggtgggaggggagaacagggtccagtctggcccatggccagagaaaggacagggtctcatctggcttgaaggagatgtttatttcggctccatgatttgggg

SEQ ID NO: 66002 - DNA, 1042 bp, Homo sapiens
cctgagtagaggtggcccagggcgatggggtgggccagctccactcagtttggtggattagggtcagggaagcttcatggggtaggcagggattgaacccaggcttgaatgccaagtgggagattgtcctaagcagagggaacaggtctagtgcatttgaggggacctgagtcagtcagcatggctggaggacacaggcaggtggacccgaacatgactaccaaaggcctatgcatggcaaaggggtcttcctctcacactcccctccccagccttcaaacccagcgaaggccatgcttccctgaccacctgccctcttccccagcaaaaggccaccgtggtgccagtgcttgctggtgtaggcccactggatccccagagcctcaggcccaactcggaggaggtgagctgggggatatgagggggttgggctgttccagtcctctgtctaccctctctgcctcctgcctgcaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggccagctccactccaggactgaataaaggtctttgacagctctagagctcttgcttctgctgtactggggccttgaccttgggcagaccactccaggtcgctggctggggctcctccttccagtcacgccatgccccacagcaatggacacttcctgggtgccaagtacttggagtcaattcatctcaccctcacaacagcccataaggcagggccaacactgtctctggctggtgagactgctttcagggaggagagacaccttgcctaagggccccacgctgggattggaaccaga

SEQ ID NO: 66003 - DNA, 1103 bp, Homo sapiens
gagacagagtttcgctcttgtcgcccaggctgtagtgcaatggcatgatctcggctcactgcaacctctgcctcatgcctcagcctcccaagtagctgggattacaggcacccaccaccatgcctggataaattttgtatttttagtacagacggggttttgccatgttgcccaggctggtcttacactcctgacatcaggtgatccactcgcctcagcctcccaaagtgctgggattataggtgtgagccaccgcgcccaccctaattttttttttttttttggtagagacagggtctccctatgttgcccaggctggtcttgaacacctaggctcaagcaatctgccccccttggcctcccaaagtgttggggttacaggtgtgagccactgcacccagctgacaaagaagctcttgaacaaattcatttaatgagattctctagcactaaaatagtcctacctcattgtaatgttttgtagagtatcttataaaacaatgaaaaaaaaccagtattttaatacatatttttctgtatatttccttctagcctttgtacatatgatcacatatttgtaaaaagttgtatgtatatatatacaactttacccgctttgtgtgatgatatgacaaaaacatttatctgaaaaaagtatttttttcatcaaatggcagagctcctgtttctggtaacccggggtatggcaagtaggggctctgggagatggagcagctcagcctcctgtgaaaaattctgtttctctaaaaaagaacaaattctcatgctgggcgcggtggctcacgcctgtaatctcagcactttgggaggccgaggcgggcggatcacgaggtcaagagatcgagaccatcctggctaacacggtgaaaccccgtctctactaaaaatgcaaaaaattagccgggcgtggtggcgggcgcctgtggtcccagctactcaggaagctgaggcaggagaatggcgtgaacccgggaggtggagcttgcagtgagccgagatcgcgccactgcaccccagcttgggtgacagagccagactctgtctcaaaaaaaaaaaaacgaattcccaaaactagtcccact

SEQ ID NO: 66004 - DNA, 2093 bp, Homo sapiens
gtggcgtggctttgtgctgagaggcggggccttgagctgggataaggcaagacctgggtctgtgggagtgtctcaggggcggggccctggtttgggaggcggggccgagctggggcaaggcccaggcacgtggtgcatctgaagggcggggctgaagcctggaggccaggcctgggcctggctggccgccccttcaagtaatgggttcgcaggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttggtaagtacagcctgcaaaggattgcccgacaaaagacaagatagccaggtaaatttgaattcaagtaaacaaagaataatttttaattacatatgtaagtgtgtacatgtatatcccaaatatccccctcctgctttctcttccctctcttacccccgtcccccctttaccttgggcaagttattttaacttctctgaatcgaaatgggatagcacccacagagtgtttagttccttgtggggtacagcccacggtgtctagggacattccaagcattttcacacctgccctcagaaccttcccctgagccttggagcgaggtcaggcagtccagggagggcagggtgtggcctaaggaacacctcttgtggggagtaagagccagcccttctccccacctggctcttactccccgtatcgcggggggcccctctccccaccctggctcttaggacccccatcgcaggggggtaaggcacccccccgcgatgcggggagtaagagccaacccctcttttccccccgactcttaggacccccatcgcaggggggtgaggcaccccccacgatgcggggagtaagagccagaccctcttcccccctggctcttaggacccccatcgcaggggggtgaggcacccccgcgatgcggggagggctgagactgtggtctgggctgttccagacttcaacactcaccccttgtccccccgcagggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcagtgagtatagctgtgggcactgggggggggggggcggggcagggggctttatggctatctgtgggtggttggcgagacatagacatcccagggacagatatggggtcccatggtcacatagggtcctgtggacatggcagaggcaggtggggcttcctgtggacactccgggggtggaagggaagtcttatggacacactggggacagatgggtagggtgtggacaccctggagacaggtatgggggttccatgccatggacattctgttaataccccagagcgggcacagggccccatcaacactggagggtcagtgtgaagtctcgtggctacatggggcaggtgtggggctctgtggacaccccttagggacagtgtgaaaaacacatcagggattctcccttttcataccaggggacagggcttaccctggcatagttttcatgacacttggagcagatgttttggtctctgcttcacggagcatgtggtaggagcaagtggcctgttgtacacccatggcatagatacagacatgggcctttgtatagagaggagcaggcctgcagccccaacccagtctgctcagtaccagagtccaggccccaggtctgggctgctggggaacagggccctgtttgcagaaggcagcgggtgggcccatgttcagctccaggatgctccctgaccacagatgggcacacg

SEQ ID NO: 66005 - DNA, 1050 bp, Homo sapiens
ggtgctgccccaatacgtggaccaggtgagcagggctgccgggcaggtagagcgggaacaggcaaggctcaagggctgggcagcccctggcatggaagggcctgtcagtcagacccgagtccccacctcaatcctgcctcttctgagttgtgtaaacttgaccaagtcaccgcccctgtcagcctcagtttccctctgaggagcagcgagggcagcctgttgcccaggggttccgtgtctgcctccacctggccctggcatcagcccctccagcgccagctggactccaagctgggcctgccaatgccagccaaccttggggagctcccttctccccactttgcctccacccaaccctcctagagccctggctgggtcaggccaggcggggtggaggcagggcagggtccaggcagggcgggctgctcccttgtgttctcggagctggggtcccagaaggagcctcacccatcccgccttgcagagctgctttgctgtggtgctgggcgggccccaggagacggggcagctgctagagcacaggttcgactacatcttcttcacaggtgaggccgggacgagggtcgggacaggctggggtcggggaggacagctgctcaggggtcctgtccctaactctgggagtccacagggagactgaattctcctctctctctctctctggaccaggctgggagcagtcctggacccccaggaccccttaggaagggatggagtcccatgtccagggccagcccactgtgccaaccacagcgtcaggaaccatagcctctgcccccactgtccccagaccctcatacgtgaccctgctgccccccaggctcttagacaccaccctactggtgcccacagccctctctgcaggcagatgagggactgggcctcagtgtcctgcccagggtcaccctgctggccaggatggggacaggctggaatgtgcacacaagcccttggagaaatccacgccagaggtcactttttttttctttttttttgagacagagtcttgctctgtcacccaggcagtgg

SEQ ID NO: 66006 - DNA, 1485 bp, Homo sapiens
gtggtggtcaagggcatggattccagagtcagactgccgggggttaaactctggccctgctgcaaacaatccatgtcaccttggactgtgcctcagtctcctctgtcgtggggtgacaagggtacctccctcctaaggttgtggtggggattgaggggatgttgagacccctggacccagtaggtgctatgtgcagtgaactctcctcagcgtctaggttgggaggcagacgaggccccaggccagggcgttcagagcacagcctgggtggagtggggttggctggggggcttcctgcagtgagtgagctccaaggatatgcagttaataagacgaagagagtgggtgggggcaagagggacccaggcttggggagccttagaggtgggtgccatgcggtgtgttagggacctgggcagagctcaggctgtgggagcagcaggtggggaagccggggtggggccacggccaccaagaagggtcagctcgggggcctgggagctgggggaggctttcttgagggagcagcagggtcagatgtgcccacagacagccccgactctcctccagggcagggaggcgggttgaggaggctggggctggggctggggaggcagctaggtggggtcgggggcagccgcccaaactcgagccgagccaggacagcagcacaggcactgttgtgcccctggctgccctccaggaagggcatggacccacctgaggcagcttgcctggccctgccatcgttcactgtggtgctgagtgtggacaggtggcgggactgcctgtcacctgctcggggcctactgttctctgaggaggaagtgggctcagaaaggggagatgtcacctgggccacagggccttcagcgtgttgctaggaccatctctgaggcttcctgactcagaggccaggactctgcagtggcatcggggctgctctggggggtggaggattggcactcatccgggcctctcagggtggggaggtgttgtactgagagctggaggggggatggggttagaggagcagctgccctggagtaaaggacaccggcggcattgctgctgaggggcagacaccaggtcatgctgttggggagaagagcaaatagcatcgcagtgggcagtgtgatcatagttgtgtggtatttttaaaaattcactaaattgtgtgtctgtgcagagatggtctagaaggttccaccacagacttttttttgagatggggtcttactgtgttgcccagattggactcagaccctctggggtggggagcaggatgcgggttctggggtgaggcctccttgcctgtccctctacattgaggtggggctggggtgctttggcagaaatgtatgcaggtaacactattgcaatttgaccaaatggtaacagaagggcagggtagcaggcacctacccactcctccaaaaggcaggctggccagggtcatgtgcatgaagccgtcgttcccacaga

SEQ ID NO: 66007 - DNA, 1147 bp, Homo sapiens
gccctgctggaaactcttcaaggcctgaacagtcctcggtaccacattcctttccccagcttcaaggccctcctggaactgtcccccagcctgccgcgtgaccttgggcagatgatgtgacctgacctccgtcttctcacctatgaagtgggttgggggcggttggtcttgggaattaggggagcccgtacatgccaagggcaccccagagcccggcacttagccggcgctcataagagctcatcccacgacctgtgaaccccctaacaggcccactcctttggatcactgactgcagttccagggacccaacccagcaccttccccaccttcccagtgatctccgaccctaactaggccggtggcgcagagcgggcggcgcatgcgccctgagagccggctccccgctgcacctgaaggacacggaggccgcggatcctgagtgagccgaggggaagcccaggcgcagagctggcggcgccaacggggacaccacactcgcccccgacgccacgctgcccaagcccgactttcacggccaaaacgtgaacacccaccttgaagcgccgccgctacttgccttgccaagcaggccagtcaatcgggaggcggaggctacactgtaggacgctgccattgggccagcgggttcccccttttctgtattgatgcttcatggtgtggtctgattggccagcaaggctgctgaaagaggcgggattcagaaatatctttcttttgattggctaggagagaccggcgcttgaagtttgtagggggccgccatgttggtttggggaggccaataagtgaagacctccgagccgctggaggcgggacatccggggcgtggtttagaaagagtgctttcgccgtgggtgcagagggtgggcccgccgggttgggtggggggcgtgtgatgacggtaatggcgacgagatgctcaactcacgcggcctcttttaatcctcacagcagctctgcgtggagaaactacagtaacgtgttaccacgttaaggcgggaagctgaggcatgggagtatttagtaacgttcccgggccgtagagctgcggtgtgcggccgcctgatccacctgatctgtatgactcccgtactcaaccagcctatgtttcctaccagcgaat

SEQ ID NO: 66008 - DNA, 1025 bp, Homo sapiens
taaaatgattatggtgatggagactgactctgattcacaggggcagggtccatcattgccgaggttagcatgtgtgatctcagagctccctgggtgtgatggggagggggttgccaggtgtgagccatgggtacctgtgcctattgccagtccctggtgaaggcaaaggctcaagccccccacctaccccccttgattcctctttcaagccctgttgggcagggaagtgcgtctgggctccaatggccacccaagcacagggagaggtaggcacggacgggctcaggccagaggcggcctccagggtccttgctgaggctggggagaggtgtggtgagtgtacagcccctttgtagcccagcagttgcacctggaagtgagggccaggctgctctccctgaggctccagggagacagtgtgtgaggcctcttgccatggcctccctgcccgcctctctgcagagtatgtgaacatgcaggatcccgagatggacatgaagtcagtgactgaccgggcagcccgcaccctgctgtggactgagctcttccgaggtgcgtcctgggcatgaggggacagggaaggtgccgggtgggcacggatgcatgggggaggagggtgcccctgcccaccacacccgtgctgcccacaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaag

SEQ ID NO: 66009 - DNA, 1036 bp, Homo sapiens
ggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaa

SEQ ID NO: 66010 - DNA, 1956 bp, Homo sapiens
atcatcaccttccccttcctgtttgctgtgatgttcggggatgtgggccacgggctgctcatgttcctgttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgca

SEQ ID NO: 66011 - DNA, 1058 bp, Homo sapiens
gaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgctgggatgccagctgagagcagcggagcactgctaagctaaggggctgagtgggtgcagatggagccctccgtgggctccttcaggtaccaggagccctgcctgagattcaggacacatccaagggtgacagcttgaggttgggtttttatttttttatttgtatagtacaatctctgtggtagcagaaatatatgcacaaaaaacaattcaaataagagttcagagtaaaaaaaagtcagctaagactgtatcccgcaggacatttcatatatatggatttcacagctacactcgatccacgccccacaccacatacaggctgctgtctcccacaagaatgatgatgtcaggggcatcaggaaaggtaagggccgggaaaccgggcccttggagaaccctgcccaggggaggcccagcctactcacaggatccgacactccaggcagagcagagggcaggagaggcccaaagagctaggtcaagcagctggctcccctgggaggggagccgggagacagggaggtcctcacactgcccccgtggccacgcatggctgtctgcacactccatcaggaggaagggcaggggagaagtcacatgcagtacagtgaaactcatcagtgtcacacacgcccagcaggaggggagagctctgctccacacgctggcggccttggctgctccagagcaatccgctgctccagcttcagccatgggacca

SEQ ID NO: 66012 - DNA, 1034 bp, Homo sapiens
caaatccattctctcggctctgctgttcaaggacttgagccttctattgtaaaacataaaccatgttatccaaaccttttgcaggtaatatcttgttgctggaaggccgagagaattctgaaaaacagaaactgatgctcattgatttcgaatacagcagttacaattacaggtactgtgttacagtccagtgtttccatctcaatattgatttatcattacgatatgcttaattaacagttattagagaaaataagtcaaaatgccgctctgagttgcaagctgcttcacctggaatcagtggcttctcgtccagtggccggtgatggttgtggtgaagcagcacagccttctttgttcctagcagacagcgctagttggggacagccatgccattcagtccagactttggcattttcttttggcttcagaggtcattttcttctcataaatcctggtctaggagacacaatgttctggagtagtggttcaggtgcacctgtatagctttagtcagctgtgatgctgatcaaccacctgttgtctctctctgtcattaaagcagctacagtcctgctccctcagcaagtccagatggcaacaggagtggcgtgctcggaactcagcctttctttcttctgcagtcagggagcctccaggcatacggtttgcctcattgtgtgcactgtcttatgtcttatttcaggggattcgacattggaaatcacttctgtgagtggatgtatgattatagctatgaaaaatacccttttttcagagcaaacatccggaagtatcccaccaagaaacaacaggtaggagatgagtttttgtatacttgataggaaaattacatgtcaatttcatgcagttagaattacatcttcttttttattttttgaggcagggtctcactctgtttcccaggctggagtgcagtagtgcgatcatggctcactgtacccttgaccttctgtgctcaggtgatcctctcgcctcagccccccaagtagctgggaccacagacgcatgcc

SEQ ID NO: 66013 - DNA, 1476 bp, Homo sapiens
gtgttgcccaggctggtctcaaactcctgggctcaagcagtcctcccgccttggcctcccaaagtgctgggattacaggcatgagccaccacgcctggcttaggtttactcttcactgcttgggatcaggtgatttagtttcatgattcctgtagccatctttcaaagggcatgtgagaatagccgggccactagggatagtaggtagtctgtttctctttctctactggggaaggaatttggaatactgagatttgttcatatctgagcatgttagcttcagattttccttgttgccaaattaatggcagttttgaaagctgagtgagctaccttaataagtcctgtgtgtcctgctgctggaagtggaggccctgttcttattgcagcatggtaatttgttgacagtgctgtggtgacagtgctttctggagggagttgaatagaaggttgagtccaatgcttacagtgagctcttagctctcagtagcagacatctgccacttgctgagctgcaccctgggctaggtgctgtcccagagacctcatctgcattctctcctccagctctcctggcaactctgtgagagaattcatgtcctgattcccatttgatagaaatgggaacacacagatgtatgaggtaacttggatggccatgtagctttgaaatgagaattaaagccacaatttcaactgaggtttccctgagttgggagcattcactcttacccctgtgctgtacttctttgcattttcacagaaacctctctttagatttctgcagggtggcaggttgcatgaggaagctctggaggtctcagttgattgtgagctcccatgggcctcctgtaaaagggcagccaaacaagcatggcctcgggctgatttaggggaagtgcaggatgcagaggccaggaggaagtcctctagacactgtttctttgcccaactttgccctggacacctgctctgtgccaggccaggtgctgacaccaccactgggagcagctggagacggcccccctgtctctgtgacgcatctcctggttaggacctattctggaccccacatctcacctgcaacacatcagagtagaatgtcccagctgatggaggagctggaagtggggccatgtgataaactgctgaagacatggacttcagcattgggtagtgaatagacattcagtgtggttttagaggccagaataatagatgatagtgtagtagttcaataaaatttaaggaaggagttctcatagttaaaaagggttcaaaatgaaatagatctttggaggtggccggctcctcactgtagaaatgccatagcaattgctgggtcactgtctgtagggacacagtgtccattcttaagggaatttggggcattgggtgagacttaaatgcactacaaaaacacttctcgttcctaagactgtgtgatctcactctttttagtttacttggtaaatg

SEQ ID NO: 66014 - DNA, 1221 bp, Homo sapiens
gatcaaagcatggattttgaaggcaaaatgatgatagatcccacgttaattattaggacgaagatagaacagacagcatcatagagatttcagcaagacaacaaacattcaataacaggaaaaggtcgggtgtgccaactgaaaatagcaatctaggatgctccatgctagggtgctctttggactagaaagccgtagaccctggacctaaatcagtaattttcaagcttgttggacccatgagcccaatttagtaggcagaaggtcctttggatcctttgctttaactagacacactcaaccaaaagcaaatcaacccttaccagaatggatggtgttgtggcctttggtgagataccaagggtgagactcctatataggttgcgaaataaatagaagcaataaaagcactgatggatatttttctatttttggatctagtgacctaaattaaactcatattttaaatcttatcaatatagcatagtgcttgcaagcatgaatcctgcaaatgacacgatgtgtgactttggaacctctgtttcttcatatttaaaatggggatgatgataacagtagtgcccacgtgaaagaatactcatgaggatcagatgaaacactcctgtgagagtgcttctgatgcctggcgcttagcaaacactcagtaaacacctgatttgttgccatctgttttagggggctgaggccatggttctggagagcgttatgtttgccattctcgcagagaggtcacttgggccaaaactctatggcatctttccccaaggccgactggagcagttcatcccggtaagatttgttcataaacgcttagttgacatatgccacagacagaagatggcttctttgtctcattgctgcaagaacctgcaatgctgtgttttcactgttaacctcacctatgtcattaaactgtatcagaaatcatgaaaagcaacatttattttgtacttacatccgaacctctttcttttctgtaaaggtgtattcatccaaatttgaaatatatatgaaacttaccattttattgtcccctgaggctgtgtaccctgagactttgcccttttcaccgtgttcctctcaacttctagggccctgctttatagaacttgctgctagaacaccttggccctgctcagtctctgactgtagccctgtgggggccatgcctgttctttcccatcacccttccttggtttg

SEQ ID NO: 66015 - DNA, 1063 bp, Homo sapiens
tccgagtccagcacccccttgtcctgccatgcccagcccctgtttacttttgtgttttacacagcatgagggtggtggtggggaccacagtcttcagagcaccaggaccgtgctgccccctggggagcaggggagcataatgtctaagcagagacttggaggaggctttgcagacccttgcttaaatgccccggatactttctgtgatgttgggcttggagtaagatggggactgcatctctggacaacactaccataggactaaaaagttcttggaaaccttttgacaactaaatagagatactagatctttgttttcattctctaaggttttaagaaataaaacctgtctgatatcaaatcccaccctaaaattcattagcttgatagatagatgttatcagtttattgtcatatacacaaaaccacaaattaggaaagattgagcctcacaagatcacaggccataattgtgaggattatacgaatgatggttgtagacgataattgtggggggattaccggcaaatccatttacccccacaaaatgtaaaagtgaccaaaatactttttgctttaatgtggtctgatatcctttggaagtagcttttcttttttgttttcttcttactatagtactgtatcatttcctaataagtttgtcctcttggtttctcagtttttggtaacgtgaatgtgttttagaggtttctctgggatcatgttcctccacagcacattgcttcacagggggtgaattagaatcatctgaaagctttttcaaaacagccctgctggtgcctctcttttaatacttggagtaagacctaggaatctctttgcaaaagctcttttttttaaaaagagacttcggtggtggtggggcatctcactatgttgcccaggctggtctctaactcctggcctcaagtgatcctcccacctcagcctcccaaagtgttgggattacaggcatgagccaccgcctggcctgtaaaagctctttaagagattcaggtggacctctgggtaagcgtgactccttcactccaacagatggaaa

SEQ ID NO: 66016 - DNA, 4740 bp, Homo sapiens
aggaaagaaagaaggtgggaggaagccagtggcaatatatttttcattattgtgtgccttttaagtgtagaattcagtggttttcagtgtatttatggagttgggtgtcttaggcataattgagacattctgatttcttaggtcttgaaatttcaatgtttattttttaaaagtttttattatggggaatttcagatataccctaaagtagaagagtataatgaaccccagtgtccattcctcatcttcccctcacagccagtcttcttccatcttttccctcatttactccaccagggttattttgaagcaaattccagatgttatattattctgtaaatatttcagtctgtatctatataagatgattttttaaaaatgaccacagtaatgttcacattaaaaaaatttaataattacttaatattaaataaccagtgttcaaatttctaataaatgtaaaaagcttagttttgttttataacttatagaggataatttttattaacttgttagagaaaagttggatgtcatactaaatatttatacaatgtattttaatatctacttcaaatgaatttatgtcactgaagtaaaatcccacggattcctatatatatatacacacatatatatacgtatatatatgtgtatatatatatacacatatatacgtatatgtgtgtatatatatacacatatacgtatatatgtgtatatatatatacacatatatatacgtatatgtgtatatatatacacatgtatatacacatatacgtatatatatgtgtatatatacgtatatatgtatttttttttttttttgagtcagagttttgctcttgtcacccaggctggagtgcagtggcgtgatcttggctcactacaacctcttcttcccggattcaagcgattctcctgcctcagcctcctgagtagctgggattacaggcatgcgccactatgcccggctaatttttttgtatttttagtagagttggagtttcaccatgttggccaggctgatctcaagctcctgacctgagatgatccacctgcctcagcctcccaaagtgctgggattacaggcatgggccacccccgccggccccaaaatatatttaacttcctgtcttcctggacgaaaaagttattctcttacctttccatgaatatacacttggtttgagatttcctcgtcttacacttcttatttacaggacttagggagcctgaacattctgtactgaggaaacagaacagagggctggatattgcagaagtccatcttgccttcataatggtgctcttatggtataagtgatgaattcatctgggggtggagtgagggagtgggcaggggagattatcatggatttactaccacttatagtgccaatatgtttaaaaaaaggaaagactttggggcctcagccaatttttaactttggatgaagtaacttgcttttgcgagcgccattagataagggaaagggacttctgaaggctaaataacccattaactgtatctccctaagaagatacagttagagtaacaacagcataggaataaccatagtcatttagaattgtgtacaggtcaaatcccgttacaacaatttcagaagagtatctaacttatttgtcttaaagcttatactgcaaagtattaatatgtaatatatcagattatagaacttttttgttcttaagtttctttggagaaaaaaacacaaggacttttgaaggggcatttctaattaaccccacagccagcttccttgttaccaagaccctggatgggaatttgctatcactggttggctgcgtggcaccaggcagctcgttgggctcacttgcctcgtgctataccactccggagtgttcatttattcatgcagcctaaaaagtgtagtgggcatcgagatttgcttggtgctctgggagaagactaacatcaataaaagacgcagtccctattcattaggaatttacagactgcttggaagaggcgacccgcaaagcagagtctaaggaacgatgcggccacgagagtgtttggaattagggtgaagggaagctttccagcgcctaccacatcgcacatcaaaccatctgcaaagatctgaaagcatttttgtagtattttgatttttatagctttcattgtaacgggatttaacctgtaacatcttttcatcagagaactgcagattacacaaatgaaaatatcataaatccccatttgtactttctgtactttgtaccaaatgtacttaactgtatgctaaatatagtattgaatatgtatcagtgcaaacgttaagagccttttgcaaatagatttatgaacatggatacttattttgtttacttttatattacatgtactgtttatacaaaacatgcattaaaacgtctgtaatgttatttcagtgtgtgatggatgagtggttgctttaaatcactaggtttttgattggtgctagagtagctggtgttgcttaacgtggcattttttttcctgtccacactttccacccttggtacaggtatttttgataaagctgtggaatggaaaggtatgtttttcatggggtgttcaagaatctgttaccttaaatttttttaaagaggtttcctttctgggattccttttgtgtctggcttaagcagacttagtttaatttaacaagtaacatttttagaggcagtatttgagtataaaagtttgacgtgacacaagtttctgactttacttttccccattcccttattaaagatagtacgaaggattttaaagcatttggggtggggggttgctcttaaaatatatgatctgtaccatgagaaagaatgtagcccaagggttgtttatggtagttaatgatctagtgtgttgttattgctagaatcctggttatcataaatttgcaatttcattgaggaaagtgatataagtatttcttaatatattaatatatgaaataattttagagactttattaaatacacacagtcctctttatggtagaggaacagttcagcttgagctggtgaccggctgaactagaggggttactctgggaaagtggcgagtcggcagggcatgtctgcacagattttgtgccaggtttcctgcctgcacagcgctttcttctctgtccaagttctgtgctgaccacagctgtccacaggcatgtttacactccctgttcttgcaggttgacttgagagaaccacgtagctaaattggtgagagactcagcctgaccgcttgtctttagaaggcctgattggaagagtgcactctattgactttcctctaacaatgaaattgtgaaaggtacatggggcggctgtgagacgtgcagctatcgggtctcaccggcacatcccttttctcgtaaagcaatgaagcactttctaaggtgttggtactagtgctggaggctgctggtgcattagatgctgcccgtcacatcggtgggctgagaaaccttccttaaagacctgtgatgttttgtaaaccctgactgttctggtggttgcaaagttagtgtctgtttagtgttccccatctcaccagaagtgtttcctttttctcattcatagaggtcctgtaataaagagggatccgaacaagctcagaaagaaaatgaatttcaagtaagtaattcagtctttctgcatctgtgtgagatgtgaactagtgttagccacccttcgctactccagggcttggcagtgcctcttatctacccttggaaaatcctgatctatctttctacgaggaggggctcttggtatatctatcagaagccaccttacggagactgagtgagcggtgggtattcctcattcctcctgagagtgtagactgtggaagtttggtgtctttatggcaatcgaaacagcattcggatgttggcagatggcagccaggggagcattcgtgtgtggtacctgatgaggaggccctggctgccgctgctgtgatgcctctctcaccccctttctggtcgttcccacacttcccatcaggaagcgggtcactgcccagtggttttggtggccacccattttccatgggctaacagcaatgttttttcctatggatgatacccaagttggaaaagcttcttcctagacttagagaatgtgaccccactctctgaaacacacatgtgcagatggcttgaggccaagagcactgaccgatggagcctcagaggcaggggtctggggtgttggtctgcatgccccagcgtaagcaccttttgagcatctctgccattatgtgcaggctcacagagaagggtgcatgtgcacacatgcccaacatacgtgggtctaagatgtagatacacacatcgccacatcacttttaccaattgtatattgattattaaaatggtcaagaaataggctgaatgcggtggctcacacctgtaatcccagcattttgggaggctgaggcaggtggatcatgaggtcaggagtttgagaccagcctggccaacaaggtgaaaccccgtctctactgaaaatagaaaaattagccaggcatagtggtgggcacctgtaattccagctacttgggaggctgaggcaggagaattacttgaacctgggaggcggaggttgcagtagaccgagattgtgccactgcactccagcctgggcgacaggagtcgtccccaccaaatgcaaaaaaaaaagaaaaaaatcaagaaa

SEQ ID NO: 66017 - DNA, 4792 bp, Homo sapiens
tcccagcaactttggaggctgaggtgagaagatctcttaagcccaggaggtggagattgcagtgagccaagatcatgccactgcactgcagcctgggggacagagagagaccccgtctcaaaaaaaaaaaaaaaaaacccaaaaaaaactggatgggaaattagtagttttctatacggataataagcatacctctaacaatctgacagttgacatagacaacaaactgatttttgttagaaaaaaactatttctttgcttcttaggtgggaatctatattttcaatataattattcagttggtcgagtccttagttcaaacacacttttttggttgtagtttaaacttaggaaaccatgaagcctagagtctcagagttaagtatatttggtttcctagctctgcagagtttagcagtcatacttgttgccagttaagagtttcagatattaatggccattggagactgttggtcattgggagtactgtgacaacatgaggaggggaaccaaaatcaagaactccaaaagatggctatggtacaaaagaagcaaagtagagaacaggcttagaagcttctaagatgcgagccaggcaacagctgctgtgtgctttagaagctgagctgccacacactgtgccgaggattttaaattcctttccaaatattttcaaatcagctttaaagtttctattatttatttttgctgtgatctagctgtgatgaaattgctaatgtatagccagctctttagaatgaatctggcctataatggaaggagatatttatggtctacaatgagggttttgttcctatcacaacaaaaaaagccagaatttatgataaattgtcaggattgataaaaaattgtcaagatttgcattaattgagagatgtggctgagcaaatacagagcccccaataataaatcacatcatggttaaagagagaattaaatatagtatgactcaagtcttctgctttccttctttttgctctaccttatgggaaagcatacacatatcctatacatgtatgtgtacttatacaatataactggtatctcccaagccaactttataaatgcagctataatgtcctttaagatgggttagaattcactccttctttgaaaaatgttaattgaagtctactgcacaaataataggtctatgtattttttcagagtattttgcatttttccttaattatatgacagatttagtttagtatgtcccttctttccatttctcttccttgtttttagcttttgaacattttacctctgtgagaatcagaggtggtaacattttacacgttctttgatcagcaaatgatttacaggtgacttggtttaaaataactagatgattctcaactttctcatttttcttcatcttggcattataagatgtctgatttcctttatttccatagtgacactgaaatgactgctctttggtacagttctctaagggttaagtgccagaaagccaaggtaaaactttctgattgggttcagctccacagcttctgtcccacaaacatctgtctcttctagcccctatttctatctaagatgagacggaaacaaacttcctgactgtatcctggagtttttgtttagtatttgtgttagttttagggtgcttatgaaaattcctgtgtttggcaaggtcaagaatgggtccttttgaaaatatgaacaagataagacacacacaactatacaatattatttgtaggaaattattaaacataaaaatattggtctgatcttaatgcatgtgagtataatttagcgtctgttttacatagactgtctttaattttaatggaaatgagattattttcattagctacatagattatgaaaaccaaactcaactgtaaaactaccctgaactaaaggaggataatttaatagaagttttgagaagtaatagttcagcctttgcattgtggaaagagatagaattgctagaagagagcgtaaatgtataaaattagctataaatgtaacttgatttttttcctttctgatactgggaaggaacatgagctctgcaacgtccagtagcagccttttcagagaagcaagtttggctgattacaaataaccagtttgcttatttatcatgaattgtggaagacacaaatgtcagtacgtattgttcattcaatgtaacctgtgccagttggcggaagtctcagaggattgctttgtcccttcctctgtcagaacagtgactctgtgttaagccacttccttctgtgcatgagtggagagatttggcctcaccgttatgagcggtctcacaggcatgaacgtttataatacacatcaaagatctctcttgaatgttgtctggaaaattgtttttgtttgttttttgagtaatagaaggctaatattagtgcttgtttgagtactaaccataataaaggcatcaaggcacaacgcagatatgtattagcaacttaaaagagtcaaatttgagacactgtcctttttaaatctagaaaacaaatgtcttcctccctattttctcttagccccagtttaattaaaaattaagccacaataaaatatggaataactcataaatagttaatattaaactaccagctactgagaaatcagctgctaaaacctatttctttatgttactaaggtcacaccatgcaaagaccagcattgctggtactccttgaaggagtcatgtccctggtaactgaattctatgaattgccactgttttcctcattgtgttaggatcattaggaatttaagttgttctgttcactctgctttaaaaaaattcccttatacttttgagtatggtttaattctgtgttcctaaggcagtcaaaacttccttctcagaagtaaaacatttttctagtgttgtgcgttcccatttggtctaacctaatatttctttagctgatactctcccaagatagttgccaaattactaccaatagtccttccatacctgctttggtgccttcttttgataaccaaataaaccacagactactatgtctaatttttacatattcagagtgtctttgtcttgctggtattaaatgtttgggatttatagcatgaagccaatgcggatttctggtccatggaacgatggtttgaccgcagcccacccctctttgggaaggaatgtctttatgttgggtggagtgaagggcgttgggggtaatgtaccactttagctgtatgtgcatgtgttctctgctgcaggcttgtccatgcgatcgtgcctggagcactctggtttccaggtgacagacacgattcacggtatagtatgagacctctgaagttggagcattctctacagctttaatttctttcttttagttcttggattcaagaattgcttttaaaaaagaaagttgtaatgcttgttaagtagcaccagctacagtttgtgctgtgcttaaagaggtacagtgattaagatttcagaatgttgtgtaataaatatatcacttattttttttgtccaaagcaaatcagattcctttcttctgtttcctcagtagaaaatgacaaacatttaggaattttagaaatttatgggcctcaacttgataacttaattgaagtaatcaagttcttccttcatatcacttccagcattaaggagacaccatatatattttgatattttggtcagaattagaaacaaaccttcttctttgtccttaccagtcagtatactttcatatgtcttagctgggtacctgagaccttagggagctctgcagtgctgacttgatgtagtgaaggcacacttcccgtaaaagtgttgcttgcaagtcaacctttgggatacttagagggagggtattttatttagtcttggaagtctgaggagtgttgggtcagcaggttgccctagatcagacatagattttgagaaggtcctgaaataggcctttttaaaacctgggcttccactcacctgtctttctgctggcttgtgttgcctaaagtgttttagaagttctagtttcctacggatattcatcaagtcatccaattttgaaattattaatgtccaaaaagatcaaggtgttttaggctggtccttgggataattgaagacactctagagactaccataaaatgttagaaatcacttatctgtttaaattcttgtaattcatatgtgcttattaaataatcacataagctatactttaaatcattgcattgagatctcacattttaatgtgttctgtaaaatgttttcagaaagtgctaaaagtggccgggcatagtggctcacacctgtaatcccagcactttgggaggctgaggcgagttggatcactgaggtcaggagttcgagaaagaatgctgtaagaaaccataaaagcaagaaatacgggatgatttcattttttttcatagaaatcaggaagaagtaaggttagggtccatgataactctgagaagaaaacatattgccaagaaaatatactgcaaaatgttaattgaaagagtcacataactctttcaattctatagaattgaacacattctatagagtcatggttctcatgctttttcctgccccacctctcctgagatggaacatagcttcatcatcaacagggacttggcaggccagggattataacagatgccacccctgtattaaaaattatttctctcctagagggttgagtgtggtgagataaccagggtgggtattaagggtctccgaagccacaggctacacagtaaagaagttcatgcc

SEQ ID NO: 66018 - DNA, 1053 bp, Homo sapiens
attcttgtgcctcagcctcccgagtagctgggactacagatgcaccaccacatccggctaatttttgtatttttggtagagatagggtttcaccatattgaccaggctggtctcgaactcctgacctcaggtgttccaccctccttggcctcccaaagtgctgggattacaggcgttagccactgcaccctgcccggcctaactttttagactggttctttttgttattactgttttaaaatcactccttctccagaaccacagcaactaacattgagctagttacactggagcctgcattttctgaatgagctttgtgttttcagtttccaggcctttctttgcccctaccctctgcttggcagcctttcccttggtgtgtttcctttaaaattcctctttcaaggcttaactcagagagaaccagacatactgaatttctttcccctctgtgtctcatccttagcactttgtacatgcaggccttgttatcacaacccttaacacgtttgtgtgtgtgtttattcattccattctcttgttagattgaattcctagagggcatttcacgttcatctttgtatctccagcactaggatagtgcctggcacaccggaactggataagtgtagaaattgtcatttttagcttaagttggcctctttgctgtgtgatgaacggagatccttgtctgagtctcttcaactatgagtggtatagggaaaaataaaaattgtcctaacatgagagttgttgttaatgagctgaccacttagaaaatttgttcatttccagacatcacaacttaatactaacttctgtccctgcctatcaaatcaatagtatgttattagcattttctttctttctttctttttttttttttaagacagtcttgctctgttgcccaggcgggagcacaatggcgcgatctcggctcactgcaacctctgcctcccaggttcaagcgattctcctgcctcggcctcccgagtagctgggattacagtcacatgccatgtccagctaaattttttttttttggtatcttta

SEQ ID NO: 66019 - DNA, 1089 bp, Homo sapiens
ggggccgcggcggttgggcgcgcggggcggcggcggcggctgcggcgactgcggcgactgtggagcggggatgtgctgctggccgctgcactcgctcctctgccgccgccgcacgaggagcgccggccgcgtcacagcccgccctcgcgctcgccactgattggccgccgtccgccggcccggcgcatcataaccgccgccgccctcgccacaccgcctccccattggctgcggcgccgcccccaacccagagcgctgcggcctccgtgagcggggcctgggcgaagggggcggggcgtcgagggggcgccccggcggtcgcagggaagggggagaggggagcgaggcgcggggggcgccgggagagcgcctccgcggtgggacggagccggactgggccgagcgagggaggctcctgagcctcggaggaccccggggttggctttgggagctgaaagtttccttggacccctcggaagccccgtgacatcagaggccgggcctggcaggggcaggcaggaaacgtgtctggaggctactgccctctccgcgtgaccttgggcgagcagcctcctcctggggctcagtgggtgtgattttgtaacatttcccagcgctgccacaggcgcgtctcgccctgtccaacgcggagcccgaagaattactaagaaaccgaggtctgaaggagggaagaggtgacgggctcgaggccacacggtgggccaggctgggcccggctgcacgccggctaccggggcccagccctctgcacgcctcccgcagcctcagtttccctgtccgtggtactgaggatgctcgggcctagaagttcagggctggaggcccagggaccgtcgagggaggggcatcatccccgccatggggccgccgcaactgcccagagcacaggccaaaggtgcgtgccacggggctactggcgttgtggacgctgcccctgcctccccatcccccgcaggaaacagccttgtgaccgtgactaacgcacctttgccggggtagaggggcaagggcccctgctaccgtttgccacacactgccccatgtccctcactgctcccgtccttccta

SEQ ID NO: 66020 - DNA, 1038 bp, Homo sapiens
cagtggcacgatctcggctcactgcaacctccgcctcccgggttcacgccattctgctgcctcagcctcccgagtagctaggactacagacgcccgccacgacgcctggctaattttttttttttttttttttttttttttgtatttttagtagagacggggtttcatcgtgttagccaggatggtctcgatctcctgacctcgtgatccgcccgcctcggcctcccaaagtgctgggattacaggagtgagccaccgcgcccggccgcaaaaatcttttagagtgtgtacttggctgaacttgctccacgcaaaatggtcttatttaaggataaaaatgaaaggggacttttgtaaggctgctgtggcgacaggcctggaagttgacctgcagggaggtaggagagaccaaggcccctgggacggaggccggccactggatgtttgaaaggctgagaagccaagggcttcaatctggggaggccgtttggataaaggagccaaggactttctctaaaaataccggctcacagggaggtggggccatgccaatggcctgcccaggtgacaagccctttgtcccactgtcccctggcaccagtctggtaatctcaaaggaatgccagaaatctggccaggaggaagggacactaaagtaaggagtggccctctataatttgaaataactctttctggcatctgctggcttttgttaggaaaagcctcagacatttttatgggatcacagttccctgtgggaggaagaggttgcctcaaggccaggcatggtggcttatggctgtaatcccagcactttgggaggccaaggcaggaggatcacttgagccaggagtttgagaccagcctggccaacataacaagactctgtctcgccgggcgaggtggctcatgcctgtaaccccagcactttgggaggccgaggtgggcggatcacaaggtcaggagttcgagaccattccggctaacacggtgaaaccccatctctactaaaaatacaaaaaaaattagccgggcgta

SEQ ID NO: 66021 - DNA, 1040 bp, Homo sapiens
tgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgact

SEQ ID NO: 66022 - DNA, 1032 bp, Homo sapiens
aaactactaaatcaggagaagaaagcgttcgtttgggccagtgtcacgacagattaagaagcttagagtggaatctaggtccctgctgtgaaaagctccttaaccgtgcaactacttacctcaaaaatgaatagatgccccataaattagaaaagaacttcaaagagaagcagtgtagggaatgcaggtgcgctggcagaatctgcagcaggagccgtggtgttggcgtttgtgtaatctaaacgtgctgtagctaatagcctgggtttgggcattcttttcttgaactctgctgttaccaaggcttttcacctttttctctttaaccttacagcttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgca

SEQ ID NO: 66023 - DNA, 1059 bp, Homo sapiens
atggagacctcgaaaggggacgtcgtcaggagacttgatggtgagttccatttaggggcttagagacagtcagtatttggtgacctggttctgtaagttaggagcgggtctggccagagttcgggaactgtcagcctgtaagtggtaatagccgtgcgagaatgggtgcttgtcacctggggcctaggactacacagacctgaagaagaacagtctaaggggccgatgaaggagggtgccagggatggagaagggaaccaggagagtgcgctctctttgacagccaagagaagaaaggttttctcaagaaaaagtggttatcagtgtcacattcagagaaatgaagaaagggaagggctgaggagtgtgtgctgggtttgacgacaagaagttgtcagatcaccaaaggctgtctcattggaggagcaggctggatccagatggcggggattgctgttgagaatatgacatagatgtgagtgttgtgtaagggtgcttgcaggtacgtcatgagagtggaatggaaagaggagaaatcaaaggttggaaaccactaagtttggtcataaattagtccttgaggaggcatagaatgagcaaaggatcatcgtagccacatctgagagagccaagcaaagggaagccaagcagtgcagtcctttcttcactagtgtctttatattggcagcacgtccattcagtccaccttgtaggcaagcataaagaaaccctttagccgaagagttccctattttttcttattttctaaatttcttattaaaaaaaaatttgctatcacatagttctgtatagttccagtggataataaatcactcgttctcaaattgaatcacattcaaagttcactactcctactattctaaaaagaggcgccaccttggtagcagcccacatgtgtaagtatgttcttgtttcaaactgtgaatccctttgctgtgaattctgctggtttatgtaccctgaagccatttatgagccagtctgtgcgtgcaggaccttctttgtttttgtttttctgagaggaagtttcactcttgt

SEQ ID NO: 66024 - DNA, 1609 bp, Homo sapiens
atttcacctatattcacttaactttctcaatgtggctgctaaaaaatttaagattgaaaatttggcttgcattatattcctagcagatggtgtgctctaaagagtggcaccatgattccggatcctcataacccttactgccactggtccctgcctgcttcatccagcagtcagaaagtttaattcattgccgcaagtatttgagtactttctgcttgcaaaacaccacaccagggcattcagagacataggtggcatagtccctgtcctggttgagtttccattctcttgcaggaataagataggtacacaagtaaccatggcacaaggctgtggagctccagggtaggagagaagatagccaggtggggatcccagtgagctaactaaagtatagacagctaggccttttcagtttctgatatttattgtcaggattattttattaaaagaagccttactatatttaattactagtaatttttaacacatcacatattttaaataggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatggtaagctgtgtttccaaggtgttggcgctagtgttggccattcctgctaactgctagaatggccttgtcaacctcagtcaaacctttatcttcctttaaaggagaatttgaaatagaaatgtttccacaaacttattaaaataaatgtatattcctttagttgaacttgagacctaaactcctatcaaaagttgtaaagttatatggaaagcttatttcagatttctataattgttcgtgtttcagatcttatcaacagttaattgactttatcttttggacatttttcagattgcagacctaattgtaaggtaagcattaaaaaaattttcttcaagtattttgtttttgcttcaggtgtgagtttcttactgagttacttttattttagtttgtgtcaactggtcgagatacagcatgtgtgaaggctctaagagacattgaacctggagaagaaatttcttgttattatggagatgggttctttggagaaaataatgagttctgcgagtgttacacttgcgaaaggtaaggtattaagtaaaatgttcagcctaaacattttttgttaacaacctgattatggggattaaactcacattatctctttgttgtttaaatgcagagatagtctttatgttctttagcatagcggctggtgcagtgtgtatgaacaaagtcaaatgctgcacagctatttagggacattggaatgtccctcaataaatttaaaatttccctttaaaatcttaatattaccagctaagagtgggccagaatacagatgtgcttaaggagagaatggttaatagctcacacacatgcacacacgcaatgccagaatggggttgccgctactcaaaatgtcaagtggagttcaccactgatagtcgtcttgcatattatcaagctgtgtcttctggaattttggttt

SEQ ID NO: 66025 - DNA, 1022 bp, Homo sapiens
actttgggaggctgaggtggaggattgcttgagcctaggactttgaggccacagtgagccatcatcacaccactgcactccaacctgggtgacagagcaagaccctgtctcttaaaaaaaaaaaaaaaagtatactgctgttcaattctatgccttttctcctaagtgtaagatatatgatcattaatgagaggttttaatgttaaatttggtaaaatttaataattgaaaaatccttagcttataactgatgtagaatagatagaagactgtttagtgaaacctatgagaaaaatcaaaaggcacgttaaaagttaaatactataatcgaatttaaatagtaagggaaccagaaaaaaaattcatgttagaaaacaattgtaaagttgtctttagcattgatcagattttttttttttgccattcccctaagcatactgctcacatgcacatcttaccctccagtgaactcacacagatactcctgtaacatgaaagagacctgagatcaagtaaaaattcatgttttgtgtttgtgttgagtatcattaaaggtatgtccaggcatgtctttttgtgaatacttcgaagtaatttatcatttgtacttttctatgtgtttgtggaaaggaaattgacctgcgtctggtgtagttgagaatttgttgggcagcagtgctgggttctactcgtgagactgctgcaggtggatcatgtggttttaggcatgtggcctcagtttcatttgcaaattgaaggagttgcactgatgatcttaaggcatctttggctctgaagttctgtatttttgccctttatcgtagggcctttttagtctgacttgtactaatgcataattcgataatgaggtggtatcatggacatcctttttctcattccattagtagtgagtgtgatgtataatatcctcatttccaaaggtcattataaattacaagcatcccccactattcagatcaatcggttcccaaattcagatagtaagagatacatttacatta

SEQ ID NO: 66026 - DNA, 1898 bp, Homo sapiens
tcagtgctgggtaaatcccttggggaagtgatgctgcccatcttggagcagaatcccaattccattttctcagagcctgattgcatcatttctgtgaatactcacgaaagtagaaggcacaaagccttgcacagtagtcctcaggaattccacttcgttttcctactcagatcatctgtattactcccatccagagatttaaccaatctattagtttaaaaaaatttttttaacacagatcctataagcgctctgaaggcttgccttctcaaattaactaacctattcccatcacctcccactccataattttaacttacatttgtcttttctggcctgcgagtcagtctctctctctctcgttcctgatattgccctctgccatctgtttcttaaagcaaagccccgtcttcctcacaagtgcgtgttttaagacattgtgtccatttagaagttctctgttgtttctgagcaaggctcacagatcagcaatagcccatcctttccacgagtttagactcataaaataaaagtatttgcttactgggcacctatagtccttgcctgagttggtaactccctccacagagtggtccctgtcatgcctggctctgcttctcacttgttgctccttttgtgatcctgtgctgcttctcctcctcttgacctatacatgttaaagtgcccccgacacccagtccttggacttcattgatctgcactgagtcctagatttcatctgattccatggcttgaaatgccattaatactttgattttatttgaagataaaaataccagatttttatcttcagcttggagctggactccagaccctggtatccagctgccaactccagttggatctgtagtgggcatctcaaaagtgactaaaaccaaaaaagacccccaaaaaggaagaaaaaatgaccaaaaccaaattcccacaccgcagtccttgcggaagccaatcttcctatagtctttgtcacatccctaaatattaattccattcttcatttgcaggtatttttgagtcctctttctcctacacctgcattcaatctgtcagcagttcccgactatcagcggaaccttcagaaaagatctcgaagccaaccacttcttgccacctctgctgctgcagccactagttctcctctggctagcagtagtcagttagtaaatagactactactactaataacgtctccctgcattctcttgtcctagaaattattagtagcttcattagaactgcttttttaaagtaccatgtagcaagctgccagcatggtcctttaaaactgtgggttggatcgtgtcactcctctgctttccctctcactgggagtaaaggcccaagtctcagcagtggctttgaagcccttcttccctgtggcagcctctctgacctcatcctcccactcttcctccatatttgccccagccacgccagcctctgggccttgtgtttgcccttccctttgtctactgcatgcttcttgcctgatgcctggctgtcccttcacatcccttgctgtcttagaaaacagccactatcaccctccttctccacctgaaacactccctgccaccataaatggcttattccccccaaaaggtgccgacattcattcgttaatttattatttcctagtgcttttttccattagaatataagcacagatgagggcagaagccttattttgttccatgctgtattctcagtgcctgcaacagtgtctggaatatagtggatgtctaattttcctgacatttttatattgggaaatcagaacaggatttgtaactaaaaaaaaaacaacgcaattactttattacttttgcaccaagctaatacaccatttaagaagtggtcagtaatggccgggcgtg

SEQ ID NO: 66027 - DNA, 1064 bp, Homo sapiens
aaatacaaaaattagccgggcatagtggtgcgcgcctgtaatcccagctactcaggaggctgaggcaggagaatcgcttgaacccgggaggcaggggttgcagtgagctgagattgagccactgcactccagcctgggcaacagagtgagagtttgtctcaaaaaaaaaaaaaaaaaaaagtgtgtcttagctagtagggaaggcaggtgttaccagataattacacagagtagtgagtatggttgtaataagcaccatgctgagaaacgttaagggttaaaatgtataacaaggaaatctatatagctggagaagtggggttgggcagggactgaggagcagtgtggcggcaccccaagtgcaaaggccctgtggtgggaagctgccaagctgtttccctttcctttgtgtaagtatctttaatattttgttacaaaagtcacagatgtttattttgaaaagttgaacatgtagcaggtaaatattgcttgtgatgtcattctccattgtaatctcactcactgttaaccagtggtgtactggattgttttcttaccaaattataactaaatcacttgaaaaatgttttctttgcctttctaaataaagatttatgaaagtcctctaacaggctagaacctgctttttattatttctttgagacagagtcttgctctatcacctaggctagagtgcagtggtgcaatctcctggactcaagccatcctcccacctcagcctcctgagtacctgggactacaagcacgcaccaccacacccgactaatttttttttttttttttttttggtagagactggggtctgaccatgttgcccaggctggtcttgaactcctgggctcaaggaatccacctgcttcggcctccctaagtgttgggattacaggcgtgagccaccacacccagccagaacctactttttaaaaatgtgtattgacttttctttttcaaccacttggggattgtttccctgccactggataatttctctaagataaactgtttgcagacaagttcagcatgtcaactggctagagggttct

SEQ ID NO: 66028 - DNA, 1061 bp, Homo sapiens
ttttattgtaagttttaatataaatagaaaaatgttcaattacaatgctattcaggaagatcatggttatctggcctagcaagtgtgtgagtaatcagaggtgtaattaagaggctggctctattttcaaaatctatataactcagtagctgcattttataccttcagttgaaggatagtgtatgatttaaactttttatttatttatgtttttaaaggtgaggtctcactctgtcacccaggctggagtgcagtggcatgatcatagctcactgcagcctctacctcctggactcccatgatccttcagcctcagcctcctgagtagcagggactgaagttgcgcagcagcacaactggctacttgttttttttgtttttttttttggtagagatgagggtctcactttgttgcccagtcttttaaaacttgttttaaatacactgttttaaaagttgtttaaaatcttttttcctgtgacatgttggaattttatgtatttttggagtgtggtaactgtaaagcgtttctactttggtttagtttttcataatctctgttatgtggtcactgtaacaaattccataaacttagcggcttaaaacaacagaaatgggctgggcacggtggctcacacctgtaatcccagcactttgggaggccaaggtgggcggatcacttgaggtcaagagttcgagaccatcctggccaacatggcgaaaccccatctctactaaaaatacaaaaattagcctggcgtggcagcaggtgcctataatcccagctactcaggaggctgaggcaggagaaattgctggaatctgggaggtggaggttacagtgagctgagatcgcaccactgcctccagcctaggcaacatgtgagactctgtgtcaaaaaaaaaaaaaaaaaaaaaaaaccggaaatttattctctcacggttttcgaggccagaagttcaacatcagtttcactgggccaaagtcaaggcgttggcagggctgtggagggaagctgctctttgcttcttccagcctctggtgggctgcagcattccct

SEQ ID NO: 66029 - DNA, 1038 bp, Homo sapiens
gtttctgagctttagcctccttgttgtagtgctaatacctgtttcacctgatagggttgctgagctagcgaatcccgagtcctgcatgttaggggaaccagtagaaaccgaatgtgtgtgttgtgacacctgtgtttctaccttgtgccacctttataggaatgcctggtcagcacatctctaatggcactcggcttgcttctcaggccttacgcaaaaggcccattcagtgaagggtcattctgcttcctagtctgtacttttctaccctgttaactttttttccccttatgcatctgtttggttttcttccctgactcaacgactgattttcctgaaagtagaagctctcatacgccctctagtgttccctggacatgaccagtattccagcaccacgaacagtgcctggcagctctgggaggttcttcataagtttgttgaactgagtggattctaggtcggcccgatgaattgttttgcctgtctgatttgtataacacggttgaaatgtatgatacattttaatggtctctgaggagtatttttattttcgaggcaatgtttatgttgcatcatatggagaaatagatatttttagtaagaaaaccaatctgattttaggaagctgcagctttcctcactgagaagtaaaagggggcttgatccttcagccagtgagccagtggcaccataggaaaccccccttcactttcccccttggaaaggaaacaaaaccagacgtcattcagggtcctggagggtttaaagcaaatatttgtttggtgcatataaataagtaccaggagggcttttgacccaaaaaaggtattttttgtttgtttgtttttgagacagggtcttgtagcctcccaggctggagagcagtggcataatcccagttcactgcagccttagtctcctgggcccaagcaatcatctcgccttggcctcccaaagtgctgggattataggatgagctgccatgtctggtcttgtttttatatttacaattttgatttatatttccctgatcat

SEQ ID NO: 66030 - DNA, 1360 bp, Homo sapiens
gatcatttccaagtgctctcgcgcctttattttcatctgctttcccaaacaccctgaactgctcatgcagtgaactttttattctcgcagcaaatgccaggggacagtagtggggaaggtggaggtggatggagggtagcggactctgacagggagagacgcgtgtgaaggaagtgtcccggtgtctgcgtgtctttcagcagagaatttagtgggtgggggatgttggtgatttttctcttgggttatttaaaaaggaggttgaatctgattttcctttacctgattatcagtttgtgggtttatagggcctgggttcgtggccaggttgtgtgataaagagatttgtgtgtgtggcatctaagcagctccctgtccacaggaatgcccttcccatggcttacagagcaaatcctttcagataaatcgccgtggtcccattatttcgtgtttctgtgtaccatgtatgagctttacattggcaaatctctccattggcaaaatccttctccgtggtcaggagttccccgactatgtcagccttagaacgctctgatggttaagaatcttcctcacacttttgacgatagggaccatgtgtcctccctccgctccatcaccctgttagctacaatactgcatgttaagtaaatgcagggggtgatccattatgtgtctggatggggttgatttggggctagccggtctccgaatgagacagacttgaacaccaggccatcttctagggccgtatgtcaaatgatgactgctgtatagaagtgtaattttaggaatagttgaaggaccatggaataagaatcaattcttattccattctctgctctatcactgtttgtataagtcattgatagggcctagactccgtctacaaaacgactctgaggtcacttccaatccaaaattgtattaatgcttcatcttttacacttcactgccatcctattttctcctaataattattttaatcatattttgacatctctctaatcaccttagttcatctgcatgtttcatgtagttttacctcctttttttgaaatgtcattatgagatagttaatcagttgggttttagaattgagagactagggtatcagtgtccccccccccaaagcttgattgggggcctgtatgactcctacaatgccagttgcatttctataagctgtcttagtttgtctgttgtaatagcacactaaagaaaacagtaccggccgggtacggtggctcacgcctgtaatcccagcactttgggaggccgaggcgggtggatcacgaggtcaggaattgagatcatcttggctaacacggtgaaaccccgtctctactaaaaatacaaa

SEQ ID NO: 66031 - DNA, 1104 bp, Homo sapiens
ggcccgcggccgcacgaggggagcagccccgccgctcgcgattgggggactctgttttcccttttctccaatgggcagccgtgaaccgtctcgcccaatctgctcccactgccgcgctgaactttttgtttttgttttggcccgagcgcatttcggagccctcccgagctcgtcctgcagcccaccctcctccccgacggcgcccctggccgtggcccggcgaccccgcggccgctgcgtcccctttgtgctttatccgctctccctgcgtcccctggtgtgtgtctgtccttccacgtattcgcggatgatgtgcaccgttgtcacctccgccttggaaggaggaacaatgacaactcgatgcaacttgctggattaagatagaaacaagttgggtgctgagaaattcagtctatttgggtttattggacccgggtctggaacagtaacttaacgatttattaagtggtggaactttcggaatactggggaggtgaacatgtgttctttgaagttaatttttaagaatttgccaaatgaaatttacctggagtggggggagttttccttagaatagagggcaggtgaattaatttgattgattgtggttctttgtgatgtggacctttttcgatttaaaccagtttgatataaagtgtagttgaggatggccatacaggtctgaactttgctgtgtaggatctttagaggaagcagttgccagctataacttttttcctttagtctttaatattgagaacacgcctataatattgataattagtagtaaaaagaagtattttcaaaagaggaggaaaccatttttacctgaaataattacagataatgtgtgcatgttgaaatacataaattgccgcttgctgtaaatacagatttattgtgtatctgaaggtttagcaatttgaaccagaggtgtggccctgtccctcttggagcgccttatattcccaggttagagtccacaaacgctctaatcccggcttgtgtgggaactccagcccatttttcactttgtaatctctaaacattcgacattctggtccctctcccaagctctggctccaatagcttcccatacctggt

SEQ ID NO: 66032 - DNA, 1061 bp, Homo sapiens
gtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccacaatcgtgtgggtgcatcctgctccttggggagccttgctttctgccgtgcacgtggcagggttttgttctgtgaatgtgcaccatcactccgcaccctggaggttgactgtgtcgttgccactgacttgggtttctccctggtacccacgcccgccctggtgcttgctgggaggctcctgggccccagaggaggccacagccagcatctttaatcctttttctgacctgttcgatgaacctcctggagccagccttaggggtgaaggagctaaattcaacacatcacccccgtggtgtggccagctcggcctgaacctgcgcagaacagaatctgatcctgccctgctcatgaggtggggtcactattgctagtcctgaatagtgcaagtcccttgctccaggtaacccaggaccccagggccagtcctgggattcgaccc

SEQ ID NO: 66033 - DNA, 1318 bp, Homo sapiens
tatctgctttgtaaacctgggtgtgcgttcagtgggcttttaatggtgaatcacacctgttgtgtgagacttttactctgatgttttgggaattggatcaaatagtgaaggtctgaagccttcaatgggcagggggttcatagagggcaaaggagttttaaaatcaaattgacaagggctttttcaatgagctgcatgccaacagtgggaagagagatggggaggaagcatgttcgcacatcacctcccccgactctggctgggctgaggagggggccccacaggcctgggtggaagccgatccctgagcaatccccctgtgcaggattgaacatgattgtctctctttttctcctttttctgactttaaggcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcc

SEQ ID NO: 66034 - DNA, 1153 bp, Homo sapiens
tcggggcccaagtgcttgttccagggccggcctgtccaggcaccccctctccccctggaggttcctcctgtagatgcccaaggccaaggccgggccctctgggagagcccagaagggctgagtggggttaaccaagtgctgtgtggagcaccctgagagagtcccctccaaagcagggccccgtgtgtttagctcccctcttcagttccaagaaattcgccggtgaacccgatccagcatttgttcagcactttcctggggagattcacctcgtgcttcctgtcgtttttggaacccgtttaatttcagccgtgctgtgtcactgctcaggcatttagtagaactcacacacacgggtgggggatgtaggcaggtgaggcctctgagttgctttctcccttgcagcgacgggttgcagggctgatgggggtggaggggtttggggtcagacccacctgggtttacatgctcagtggctgtttgacttcgggcaccatacctagtttctgttatctcaccccgttcctctcccaggctatggggagccctaactgccctgtgtgagacctttagccccatccctggcagagctgcagtgagcgcagttgtgtgtcagcgtcctcgatctttctggccccagccggtctagaggctgttattacaatagtctggatttttcctgtatgaccttggacatccagtccactgacaaactcactcactcaccgctgcagccctcgggggcaggagtagttagttagcactgtggacagagcccctgcgcccagggtctgattccagcctggccgcttcctgtgctgggaggcttaggaagctgatgctacctttgtgtgcctcagttttctcacctgtaaaatgggaatagaatccttcctaccatgaattcagtgagttaacgtgcacctggcccggtataatgctgttgctgttttgctttggtgtctgctaccgagtgaagtgctagggttgagtgcgatagaatggcagataaggccccgcccctgcgggcagagcttcccatgtagaggggaggacagggaaagaagctttgcagctatgcagaggtgggcccacgggtgctccttcaccctcggggtgtcctgcgagaggcccttagaggccagatcatgct

SEQ ID NO: 66035 - DNA, 1255 bp, Homo sapiens
gccagatcttcctctgtctaggaagcctgcctggttcacccacagccgtgtcttcttcctctaggaagcctgcctggtccacccatagtcaggtctacctcctccaagaagcctgcctgatccacccacagccagatcttcctcctccaagaagcctgcctggtccaccaacagccaggtgtacccatagtcagctcttcctcctctcggaaacctgccaactccacccacagccagatcttccccatctagaaagcctgcctaccccacctacagccaggtcttcttcctccaggaagcctgcctgggccacctgcagtcagcttatccatccccaggctccaggcattacctgtccatgcattcatcccaccttttcttcttgggtggttttgtgtgtgcgtgtgtgtgtgtatgtgtgtatatcctgcccaactaacctgcaggctccttgactctggagccctgatgtcttctgtttctctgtctcttccatcatgctggcactggacgcaggatcattcctgactgattaatctctagcttgtgtccaggctgcagcttgctccgatgagcagttggaggcctagtgtaatgcttggtgaatatatataaggcatggactgaaaatgttgcttattttggtatagtagcaaaggattgggttaccttgaattgagtcttgtttggtgtaaccatgtaaataaacagtgtaaaatataggctattggaatggaagcccagacatctgttatgaattctatatataaatattggatatgcttacatgggttaaaatgagattgttggcacttgggttttcaaactcctgattctgctccgggtaggactgatcacgggtcctgggactcaaggcaggaggggccacgagctggcctttctctgacactgacttgccagaagtgggcgttcctgggagtggcagacatgcacccactagagatagatctgaatcaccccctcacattctcctaatagtgccaagaacccacagcagagtgcggggtgtactgagtttgtgctgagcaggggtgcctgaatcccggattgaagaaagtgttctacgcccgattaaaccaactgggaatccaggcaaaagaagacgttcccaggggaagccagcctgcccagtgtgcatggtgccttttaaacaaattatctgcattcccattgggatgaagttcacttgacaacattactcattggtttttttgcttttgtttagttttttttt

SEQ ID NO: 66036 - DNA, 1224 bp, Homo sapiens
ccaacaaaggggatgtggcttctctgcagaacaggacagggcccctgtagcctctggaggacgatgtgggaggttttgggcatggcaggaagggtcacccatatctgggggaacagacgtaacagttggtaaacaaacaggtgctgtcaccgaatgtgggaagaaggctgtttgctgcgctgcaggagcctctgaatgatgcgggccggggctgcccaggcaacttcctgacaacgccttaggggtgggaggaaggaactggaggtcttgggcatgggcagggcagtaccaggagtgctctgggcatagtgctccatcccagggctgtgtatcttgctggcttagccagtggccctcacggtttgcttctgccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctgcgactccacctgggtccagggggcggggagtgtcaccatctctctctcgaatttgcatgagcccaagttgtttttcagaaaaagggtgtgactctgaaaatgaacccgtgggggggttggctcaggcctgtaaccccagcactcggtgtgactctgaaaatgaacccgtgggggtgttggctcaggcctgtaaccccagcactcggtgtcactcttaaaatgaacccgtgggggggttggctcaggcctgtaaccccagcactcggtgcgactctgaaaatgaactcgtgggggggttggttcaggcctgtaaccccagcactcggtgtcactcttaaaatgaacccgtgggggggttggctcaggcctgtaaccccagcactcggtgcgactctgaaaatgaacccgtgggggtgttggctcaggcctgtaatc

SEQ ID NO: 66037 - DNA, 1029 bp, Homo sapiens
attccatcctgagtgttttgaattgccttttagaggttcatttacagcattttcatggtagcaaaaaaatcagaaataacctgaagttctttaaaaaacttacagcagagtacactaggcaatcatcaaaagaacaaggaatctttctatccacaagaagggaaggtgcccagaatttactgttaactgagaacaagttggaaatagtatattttgattgcccagcttaaggcaggaatacctgaaaccatacctgttggttatttccgatgggtgagattttagggcaagttcactgtctgttgtttcatgtctgcatctatgcagacaaaaacaaaaaacagatctgtgttagctgcttctcttgccctgcccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccacgcagtcctggggcacccctttcccctttgtccccagggcttttgaaggcgttccttcttaactcaggcctacagactcttctctgaaactctggggccctgaggaatgcaggacttctcagaacttggaacagcgtcagggtctgtgtggcatttgccaccagcccttgaatatttctatagcaaatgtggcacgttcattctaagtagggcagaaaagactatctgtagcccacacccatgcacagtttttttttttttaactttgtttttttgagacagagtctcactctttcacccaggctggagtgcaatgtcataatctcagctcactgcagcccccacctcccaggctcaagcgatcctcccgcctcagcctcccgagtagctgggactacaggagtgcgccaccacacctggctaatttttgtatttt

SEQ ID NO: 66038 - DNA, 1099 bp, Homo sapiens
gctgtgtttgggaggtgccctgtgcacgccgggagaaatgtacgagggcgccagctcctggggctcttgacctggcctcacttgtctggttgaaagcaaatgggaagcctggcatggtggcgcacgcctgtaatcccagcgctttgagaggctgaggtgggtggatcacctgaggtcaggagttcgagaccagccttgccaacatgatgaaaccctgtctctactaaaaatacaaaaatcatctgggcgtagtggtgggcatcagtgatcccagctactcgggaggctgaggcaggataattgcttgaacccgggaggcggaggttgcagtgagctgagattacatcactgcactccagcctgggcgacagaccgagactccatctcaaaaaaaaaaaaagaaattaattgggtcagcagcaatgactgacgggggaccctcctgatggctcctccaccccgcttccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttctgtgagtgccggctggggcgcgggggcgagggtgcgggggctggggggagcgggggcgcggggcaggggagtgggaggatgcgggggcgtgggggtgcgcgggcgtgggtggggtgggggggcaggtgacccctccctgcagaagcccatgctctggggggccccctctctaaaggggtacctgctgcaatggagggaggtgtgtggctggctgggggacacgggcctgcagaggacccctctgcagagctcatgggggctatttcaggctcagcagtggcaaggggatttccaaggaaggttgcctcgttttcaaggcccagaagaagttgtctgtgtgtgtgtgtatatgtatttatatacacatacacgtatgtgtgtatatatatatatggttatttatatatacatatatatgtgtgtgtg

SEQ ID NO: 66039 - DNA, 1020 bp, Homo sapiens
ggcagcctttgcagaggggtgtcctttgggggctccgaggagctggggagggtgttctagtcataggagcttggtgggaggaagcagatggggagatgtcactccatgggcaggtcacatctgggtgtgagggtggccaggaaggtcacggctggttttggggaaattgcaggccgtctggccaggctgagggccccatgtggacgggccagcgatgaggcaggtggaatggtgccagcggggaggtccctgatgccacttgaggccgatgtttgggcagagggacacactggaggctgtcacgggggacgaggcaggatgtgactcattcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggcctggcgggaatgggttgcggccgccgggggtgccccagaaggaacctcggcaaacccgttcgaaatgatccacttggcgggtgtggtgattcaagtctgtggtcccagctactcgggaagctgagttgggaggattgcttgagcccaggaggtcaatcctgttttgttttgttttatttttgccccagatattttccacttttttactctccgccttggtcctcaggcacttggtgcttcctgggactgtgttgcagtgaggcatggctcttctcctctggggcaccggctgaggatctttctttccaggtgtcggttcggggcgggcccttcgggaaatcacacacgttcaggatgcagctcgccttcggggatgctcccgggcctgggatagccagtctggcctctggggctgaccctggggcctggcaagcgagggggtaacgagaggtgtca

SEQ ID NO: 66040 - DNA, 1034 bp, Homo sapiens
ggacaggccctgtggtgattagaggaggctgcctgcgctcacagggggtggttaggctacccagaggaggaggcccctgcaggctggcagggggcctggtggctctggccccagccctgggctctgtggcatggagctgacaccacagacacctgtggggttggaccgctggactagcagcgagccctgcccttccagttggatagcttttccattccagagccgtcagggccgcagggctgagcacgcagctccacgctccctagagactcagccgtcaggggtcacctttctctagtcttgtgggaactgtttttgccctcagccgtgagaggcacttttacacataactcagttggagcatgactggcacgcaggagaaaaacattttgtgtcatttataggccctgcttgggcgagactctgggccgggaacgtccacatgcagccagtgtggggactgttttactctgagcctgaatctttctgctttggttccagatgccgtgtgtagggtgttctgtcaaagggaggaaaaagctcctcaatgagacagaaagatgcaactgggagtctggttttgcatgaggacgtgagcgtttcagttcacttttttttgtaagcatggttccccagtctgacctcagagctgcctggagatgggccccacccgcttcccgttaattaacaggctggtgctcggtgtggatgctggctcctccgtctccctgccctgggcccttttgaagctgaagtgttccaggggcagctggtgtggaaatagagttttctagaggttttagagttgagaagaaacctaaactcttcttagaagcatttcaagggtttgtcaccaggatggctctctgcaaatttgaggtggttctagaagatcttcccatatttcttaatccagagggagatggggatgggcgagaaacggctttgtccttaaggaagtcatgttctggttggaggacaggcacggcctagcattgaagctggtgagtcagagccggacctgtgagcggggc

SEQ ID NO: 66041 - DNA, 1414 bp, Homo sapiens
tttatcttcagtggcgagctttgcgcttgcagggtgcggggcctggtgggacgcccacgttgcccagacagaacccttgtgcggctgcgggcactccttgccctttccgcatttggtgatgactccttgtttcgtttcactgaccgtgccctgtgcctctgctctccctccccagttccgtgtgccctggggtcagtgatagaagacacggcccctgggccccaagtctgctgagctgacacctcgggctgccgctcacctgcagagagacactagaaggctccgactcccttcctggcccccactctgtttttctaccttttaccgcctattccaatggaaatgcacgatttgtttctccctgtgcacatctgagtgtggacctccctgcccctgctcgtgctgtgcccaccacctggagcacccttcccctgccccctgcccccggccacagcgcccctccatccagaccccactcctgcacacggctcctccgcccgtgcgcagccctctgagagtgtggcaggtgcaccaggctctgctctagggagcttcttcctcttcctgtgtcccacgggaccaacatcgggacccaggaaacaggctgggagagttcggtaacaccttcaagagggtttgagagctgaggttctttggtcttcagtggagctggcagtgactttcttgactttgtcaagagaagccccccgtctctgtgccacctctggggatctgattgaacggaaatcagagcatccgagttccagcctcagccctctgctgtgtggctgtgaaatgtaggccctgtgtgccttgctgacctgggagggtcgaaaggacggtgtctggggaaggatgcataagttgtagagtgccctgcacttgtgataggtggggccgcgtgaactgctgatagccatcttctgtcagttggggcagtggcattgtcacatggttccattctaatccgttattttggctactgccactgaggcggggtgggtgacaaaagtaacgtttcttgggggccactgcagcggtcatggtcctgagccctatacccaggcacgcgtcctgggagctgtgtgaggggtcgtccgtggctggccctgcttcttttttttttttttttttttttttaattgagacagagtctctctctgtcacctaggctggagtgcaatggcgcgatctccgctaactgcaacctctgcctgctgagctcaagcgattatcctgcctcagcctcccgagtagcttggactataggcacccgccaccacactcggcttattttttgtatttttagtagagatggggtttcaccgtgttagccaggatggtctcgatctcctgaccatctcgtgatccacccaccttggcctcccaaagtgctgggattacaggcatgagc

SEQ ID NO: 66042 - DNA, 1399 bp, Homo sapiens
gaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctca

SEQ ID NO: 66043 - DNA, 1380 bp, Homo sapiens
gcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgcgatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtgga

SEQ ID NO: 66044 - DNA, 1208 bp, Homo sapiens
tcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtaaagttgcggctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcag

SEQ ID NO: 66045 - DNA, 1454 bp, Homo sapiens
cactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcgcaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacccgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatcca

SEQ ID NO: 66046 - DNA, 1175 bp, Homo sapiens
ttcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatccccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcggtgattagagctgtactgacgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctga

SEQ ID NO: 66047 - DNA, 1216 bp, Homo sapiens
ggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcatctgtttttgtgtccgtaagtgggtatttactcgccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacataccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacg

SEQ ID NO: 66048 - DNA, 1066 bp, Homo sapiens
gcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgct

SEQ ID NO: 66049 - DNA, 1469 bp, Homo sapiens
aagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcat

SEQ ID NO: 66050 - DNA, 1095 bp, Homo sapiens
cttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtggg

SEQ ID NO: 66051 - DNA, 2020 bp, Homo sapiens
ccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagac

SEQ ID NO: 66052 - DNA, 1026 bp, Homo sapiens
cagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctg

SEQ ID NO: 66053 - DNA, 1326 bp, Homo sapiens
cctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggacta

SEQ ID NO: 66054 - DNA, 1904 bp, Homo sapiens
tgtggcttgaagtccctccctcttaaagaagcccattcactgtttacttggaggtgtttcctgttgaggtcctgctggctgtgatcacaatttagactttttaattataggtgaacgggatgggtctttggatgtacctccgtgccctgacgtttcaaccgcgtgacttaatgtcattttcctggtacttcacgttttctctgtggggctttgggtctgttttgcttttatgggagggggtgcttgacaggcgttccctttcatcctcgcagcacttgttgacggggtggtgtcctttattcgtgggacgtttactttgattttgtcctcaaggtcatgttgcagataggcttcaagggggacagggactccaggtttccaaccaccgaactgtgcctcaagtagcaagtgtatgagacccagttatggtggtggttgggttttcctcactgtggagtggagtcagtgaccactttttagctctgtgaccttgggcaagttacccagcttctctttttttttctctgtagtatgggaataataataagtgtcccagccataagtttgtcaggataattgccctaatacatgtaaaacagctagagctgtgcctggcacatacagtcacctcagtggctgattagtggttaggctagttaatggctattattgtttaatttaaatttgatttttaaatgtttaggtactattgggaagtcagatgagcatttgagtcccgactcttggtgactgcctttagaaagctctgtgtaagactcagttgggctgaaaaagtaaaactataagttattttaattttttcaggacagggtttttgaccattccttaaattaggaacatttaccggagtaattaatgagtagtagcgcctcataatgtttaaagagatggttaaatacagaaaagcccatcacaagcttaagtcgggctttgttcctcatgtgcttttggatactagtttctgggtgactgccacccgaatcagtaactagggtttcttagtgtaagtcctccttgttactgaaaactgtaagggtgccgtggattgcagtattcttcagcaaagatagtttgggaaatagcttttgtcctggagggatactttggaaggtattctccacttcagcatgtctggtcagggagtctagaacattgaacaaaatgcctgcactcagtcagaaataaactcacaatcctttaccgcttgcccgatactctcctccatggtgctcgaaaccttgcgtgcaccttcccctggtattgttgtgtttacttgggacttggtttgctgtattggagatgtgtgttttgatggactcagtcttaagtagagatgagtatcttgctggtggaacttaaggacaggaagaagattgttttcggtttagaactctagcctttgtgtaaagtatagcaaagcaaagtcaacaagcaaaaagttgttagtttcaatgaactaattgagaatttgagaatcagaccatagctgagcagaaaatgaatagaagtaacattgacaggatgaggttgcctagctttttaagataaagctttggccgggcgcagtggctcacgcctgtaatcccagcactttgggaggccgaggctggcggatcacttaaggtcaggagttcgagaccaggccaacatgtgaaaccttgtctctattaaaaatacaaaaattagtcggtcatggtggcgtgtgactgtaatcccagttatttgggaggctgaggcaggagaatcgcttaaacctgggaggcggaggttgcagtgagccaagtccagcctaggagacagagcgagactcagtctcagaaaaaaaaaaaaaaaaaaaaaagatagggctttgcacctatttggtagattatgtgcttgttaca

SEQ ID NO: 66055 - DNA, 3118 bp, Homo sapiens
tggttaacgtctggaattttatttttggtagtagtatgtgtcagttttttgtcactgtatagtagttgaggagttcttttttgttgacatagagatacacagggtttgtattgcctttggacaatggacaggtctcatctgtctcttttgtctgcaagtgagaccctgccccttctgagtaaacaacactctgtgaatgactgtcccttttcactgtggacttcttgttattacacccttagatggactcagcagctatgagatcctcccatcataggtatggtattttgtaacaaaagtacagaaacacctccaaggtgcagtgaatgatctcaaggagagaaatggagtattataggatcatagagaggcctcgaggtctaaccagctgctctgcggaagtcagggtgatggtggtttcagtgttggggaggttacagagttagtgttgatatgcaaattttcttcctccaaatttggagtatgttatatatgttttaatgtatataactgtgaatatgaatataacattagaacatatataacataatttctgctggtggagtagagatcataaatttgaggtttgcagtttgctttctaaaacatcttttaagtttattcttttctggcacacaggacgttgtagggtaactttgctgtggagtctcacattttatatagaatcattttttcaacatagtgtggataatcacatacgccttgaaggatcaatatatgttaacagatgattggatctttttgattttgcacttaatttctttacaaattctgcattataaccagacagctctattgagggtttgcagattttttctgtaaaggaccagttagtaaatattttaggcattggaggctaaatggtctctgcaaggactcatctctgcttttgtagtgtgaaagcagccatagccaatctgtaaacaaatgaaggtggctgtcttccaataggactttacttataaaagcagacagagagttggatttggcctgtgggttgtagtttgtcaatgcctgctctaatctgttttgtctttgtttatctttttgagatagagtcccaggctagagtgcagtggtgtaatctggagtgcagtggtgtaatcccaggctagagtgcagtggtttttgtttatttttttgagatagagtcccaggctggagtgcagtatagctcactgcagccttgactgacctccctggctgaaacgattctctcacctcagcctcccgagtagctgggactgtaggcacatgctactacacccaggtaattttttttttttttttcttgtagagacaagatcttccgatgttgcccaggctggtcttgaactcctgggctcaagcagtcctcccaccttgttttcccaaagtgctgagataacaggtgtgaactaccatgcctggcctctaatctgtttttttattttaacttgtaattggactatgaattcaaagagtatatatcagcatgtgcccagatattaaacattagaactgacacttgtgtacccactaaccagcttaggaaatagaaggttgccatacctttggctccctgtgtcctcgtctcaccacttccctctttctgacctccccaaggcaaataccttgtatgtatcatttttctgctttactttatggtgttgcaaagtataaatgtatccttatataatgtgacttcatttttgcattcctttagacaatgtaaatggagtcactttgttctttttttgcccccactcaacattgtttctgtgatccttttattcagatgtttgagtacttaccatgtcttaaacactgttctactgctgggcatgttaacagtaagcaaagcagatgaaaagtccttgttttcatggagcttacattttggtaggggaaagacagttaacagataaatgaaagatacagtagccatatggtaatacaaacagggagaaaagtaaaccaggagaggtggggtgtgggggagtgcttgtctgcagattgaaatacagcagtcaacagaaggagtggagggacccagccacaaggctgtgggtggcagtggggtaggggcagcattataggcggagggtcagcaggacaaggtgctaagaaggaggcatgtctgctgtgttggaggggcagcggaggccagtgtggctggagtgaggagcctgagggagagtgggaggagggtaggccagatggatgggggagatggggggagggcgtaggtcacactggccattgttaagattttgtctttttctctgagtgagatgggtaagtcatttggtgttttgagcagaggtgtcacatgatgtggtttctaaaggtcccactgtcctgtgctgctggagggaggttggacgctctggcagtgatccaggagagcagtaatggcagctgggactgaaggggagcaggggtgggagtgagaagaggttggctgctggatccttcttgaaaaggaagagcagacaggatttgctggcagattggagtgggtgtgagagaggagtaaaggatgataccagggatttttgtagctggtgggcgttgccatgtataaggaaagggaagacttgggaagaacagcgtgtggaagtaagatcaggagttgggttttgtgcatgttcagtttctgaagcttttggagagcagattggagatatgctggattggggtgttcactgctcaagggagagatctaggctgcagatagaaataggagtctttgggccgggcgcggtggctcactcctgtaatcccagcactttgggaggctgagacgggcggatcacaaggtcaggagatgagaccatcctggctaacatggtgaaaccccgtctctactaaaaaaaatacaaaaaaattagccggcttagtggtgggtgcctgtagttccagctactctggaagctgaggcaggagagtggcatgaacccgggaggtggagtttgcagtgagctgagatcgcgccctgcactccagcctgggtgacagagcgagattctgtctcaaaaaaaaaaaaaaaaaagaaaaagaaataggagtcttcaatatttaggtggcatttaacagtcccgaggttgagtgaggc

SEQ ID NO: 66056 - DNA, 1602 bp, Homo sapiens
ctggagccacattcttgggaaggcagcaggaagtgggtgggtgcccatgtggagagttggcatccatgggctcctccctggtaggaggagggagagcagactaggggagatgggatagtgggagcatgtggacgttggcttttttttttcttggtgaaatggaagagttctcagcagtcagtgagaatgagggggtgtcagggctggcggggtgtgaggagagaggaggaagtatgacatactctgtgggaaagtaagaatgtgtgtgaatggaatggcctacctgagggtagcagtcctgagttgcagtgaagacagcacgatttgttatttttcctggaaggagagtaggcattgcttcatttaactggggttgtggtttccctaatcagaaatagcaaagcaagagagaggccaggaagtgatgatgttggtgggacgtggtggtaaagccgggaagggaaggcgtgcagacggagaggtttgcccacattggtgcgtgtggttgtggtttatccttcttcacttctctgttacattgcagactgaatatgtctcattttcttctttgtcctgccattggagaatataagtgtttctagtaagaaggaacgctgccttaaacaagtgcagatgcatttctccagggtaccacccatgtagagaattgcagggtagtgcgacatgtacatcttcaactttactagatggtgcaaattgttttccaaaatgattgtacctctttacctcactaccagcaccgtcctacatccttgctagcccttggtattgtcagactttaatatttgcaggtttggtggatgtaaacttatatctcggggtttttttttttttaatgacaacattattgagaagtaattcacagactattcaattgatcaatttaaagtgtacaactgatggattttaatatattcacagaactgtgcagttatcaccacaatctaactttgtaacatttttgtcaccccctcaacgacaacaaaaccaccttgtacccattggactattctggacattgcttattaatagaatcatacaataggtggtcttttgggaccagcttctttcaacttagcatgttttcaagtttcatccatgttttagcatgtatcagtatcagtccttcattctttttagttgctgaatagtgttcaattgtatggatataccacattttatttatccattcatcagttgatggacatttgtttcctttgaaatatatagttgattttcatccttggcatagtttccgggcatacagctcctaaaatctttggactttccaaaatgataagtgtctttttgtatgcgaatgagttgactgatggctagctgacctaggtagcttcaggttaggggctggtcactggaaagaccatgattagagggttgggactttcagctccacctccagccttcagtgagaggagatttgctgaacattgaattgatcaactgccaatgatataatcagttgtgcccaagtaatgtcactgccataaaaatctggaaagactgggttctagaaacttctagaacacatggaggttcctggagggtggtgtgcccatagag

SEQ ID NO: 66057 - DNA, 1436 bp, Homo sapiens
tggttaaatcagcagtaaaacaaaggaatgtctatatcaggtaaagcattatattcttgaagaaagtagaaattgttttttttttcttactatgctctaagtcaggttctttgagagttactttttttcattaaaatttttcaagattgagaaatatacaggtgggtctggtataggccacacaatgtatatagaaaggtgcctttgaaaagagctgtgtagagcttgtccttctgccctgaccctctactttttcacgtttcacttaagtcagtaggctatattcctttctccagatacctgttaggattctttcgagtggattctttcctatttcatatatgtactgagttatacgccataggaaaggatatcttacaatatctttatggatgaatgcacacttcagtttaccttattgcagctaaaagtaagtgtaccccctgtcaagagagcatcccgttttacttggtttggctcattgacaaagtaagcaagctcctggtacaatttgagagccctgaaagcagcaatggggattctactatagctgtctagtgtaggaagattttcttggtcaagtttttgttgggggaaagaacagtccaaacctttgtgagctgtgtgttctcatcccagctacacgcacctgactgtatagaactttttgcagtttggccttctttggagatagcagtgtgtttttacgtgtggactaaagcaaaaatgaaaaactaggcacgtgccagtagaccaaatcagcctcctagcagagcacattgacattgtacaactttacagcctctgtcattggggtctggtttcaatttacttcatttcttaagagtttaaactggtttttataatttttccttatttctttgagtatcttggtttcacttatttgttcttttctatgtcttcttagatctaaaggaatgaagaattttaggatttgaagtgtcttaagtaatcatttagtctaaacctctcatttacagataagaaaacaagctcagagagatgtggtgacttgctcaaatagtgacagaacttcctcggccatatggaggggtcatataatacccttgtgtcttcagtttgaggtacctcccataattttaaggggtatgtggctttaattacattactactgtttgaatgaagaatattaatttatatgctgcactagttcatttagaatcgtggacacaatcgagttgaactcttacattttttggttgagaaagttaagacctagaagatgagaatttattcatctaagattacaggccataaacatttattctgtgcctagatttttaaaaattgaattattgttttttatttatttagagagatagggtcttggtatgtgtgtgcttagttttaacgtgagtcagagcagtgctgtctagtagaactttgtattaggt

SEQ ID NO: 66058 - DNA, 1020 bp, Homo sapiens
tgtgtgttttttaaatgtacttatcactaatttagcctcagacttttagccagttacatattcagatcttccctcatctttatccttttgaaggaatctttctagtttggactgctggctctcccattctgtgaccttgggggttctttttacctctttctccccattggatctcctattcctgtgttctgtgttaccttgttgctctccttagttttagtggagcatagttgccagtagttttcagtgagaaaggtgtataggagctagacctgttgagactgtgtgtctttctgtgtactcgtggttgataaagtttgactgtgtatatgcttttggattggaaatagttttccttctatattagtctgctcagggttgccataacaaaatatcataggctgggtggcttaaacaacagaaatttattttctcacattctgtaagctagaagttcaagatcaagcttcttgacaatttggtttctagagagtggcctctttctggtttagagacaccatctcttctcacatgtggtgccaatcatcataccagatgacacagtctggagcaccataatcccaaatgttggaatacctaaagatcagaatccctgaagatcaaaatccttaaagatcataatctctaaaatcctgaaaatcacaaaagattaaaatcctgagtgttgaagccctgaaagccaattaccggggaagggacagtatgtttttggttgtgcgtaggatagttgcatcacgttagacggaactattaccttgttattgtctttattcgtaaattaagtatggtttaaggagatgcgtgtgggtgccaggttgacaataggtggacttgtggactcagttttagatgacaccttaactaaggagtacctagaaacctggtgaaacattaggttttgggtgtgtctgtgagagtgttttcagaggagatggaaaaattctcaaacagcatctaaacgcacttgcttaatcacaaaacgtcaggtatgaatgtctg

SEQ ID NO: 66059 - DNA, 1099 bp, Homo sapiens
aatgtttaacattatttattatcttacttgagggaaaatgttgctatcacaatgtagtatgagttttatgggggaaaggcattagatgaacagcattgttttggaaatgccttgtagattgcattcttagaggatttctttttttttggccctgtcaggcttcactacttagaggaattctaattagttcaatgtccacagtttaagtcattttccacagtattaagctatatatgaagtgcataccttgaaagataatttctattcttttcatgtgcagtgtttggttaattgacactagagactgaatttgagtacagctagaacttcagtgatcttaatgttctactcacgcttcctgataaaacgtattaagtggactgccagggggcatttaaaggaaggaaattgtaaaattttagtattttttagtaaaagtgtggtgcctttatagtggaccctatgttggataagaatagaattgatgttttcagaagacaaaggtaagaatatgtatttttcttcttcactcattgatagtgctattatgacatctgtatttacttctgagatactgtttagggtaggataaaagctaaggtagagagatgacagtgctttttttcttatgttcatatagaaaaattttagtgattaactagaactttttaattccctgtggtatagttctgtgtggcccaagaccctgacccagtatgctttaatggcagctatcatcacaccaaaagagaacatatgtgattatctgcttttttttttcttttacaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtaagaccattacgattagcaggagtttccttccattaatgacatcaaggaaagctgtggttctattgtgagaccctggagtcttagcaaaccaggtggagaccagtctctctgagctaggtacaatatgattctgtggtactgtggtatttttaggaa

SEQ ID NO: 66060 - DNA, 1048 bp, Homo sapiens
tgattttttgtactttctgtggtggagacaagatctccctttgttgcctaggctgatcttgaactcctggactaaagtgatccacctaccactgtcccctccaaagtgctgagattacagatgtgagccactgggcctggctaacgttggcttttatcataccatcttacctctattcacacaccctcacctccagcatgcacacgtgcatctggaaccagctgggtgttccttgcctctcctcggtttccttcatctcttaagaagacaactggcaaaaactcgactaccattgtgccatccttattacttgcctttccccacacaacccctcagtctcacttcaatgaaacttgttcgtagtagaaataacccatgctttgcatatacttggactgaagtttttgaaattgtggaaaataggcacagaaattcctgtacattcaaggtttcataatgagaatttgtagaggaacacgttactgtagttgctttaatttgaactagttgacaaaagtaaggctggattttttggttggtggttgactttaaaaaagtgaagtgaatgataaggttgtacatcttgtcttgctgttagcatcttagcagtgtatttggagttagtacagggtgtatatatagacatttgccttctgagggttgtgtatttcccagacagcttagaattctaaaggcaagtataaatttgtatcatttgacaccaaagtacagctccagaatgaagaaaaagtggaaattagacttggaggaggcagaatgctggtgacattggagaagtaatggtcatttagtgtgaaatcttgtagcggataccttggctttgaacgtagaggccattgcaaggcatcattttctgctccggtgggcccctcttcattaggctcacccctctccaatctgtctttcacattgttgacagttaacgcattcacactccagatctgctcttgcagactccagtgtctgtcttagcaccgtgaccagtctctacagtgccccacctcaggcgtcttaccttcatcccctt

SEQ ID NO: 66061 - DNA, 1001 bp, Homo sapiens
aagtgggtgttaatgggacttttatttcctgtggaacaaaggacactacacttttctgcaaaagaccaagtagtaaatattttaggctttgtgggccgcagatggcctctgtcatatattccttttttttcttaaaacaacccttaaaaaatgtcaaaatcattcataactggcaggctgtgagctggatttggtttgccaacaccttcttatttcatcacaactaattaccactcttctttagaaatccagtgtttaatgagtttcctttataataaggttgagatttgggaagtcagtttttacttgaggcaaaaaagttgtatcttgattcataattcagaagtgtcattttatctaggttttaggcatagcttctcacctgattggtgaacgtataccctgtttattattagctaaaaataagtgcttgatgccagattcactttttttctgatttatttcttagtatttttcatactttgcctttaatactaagtgtggggaagagtagtaaaaatatattttaaaaaaaggttttgtgatttttaagaacgtagaggtgcatgagctgtattattccaccagaagcatggtgggtggcactggcattgttattctgtgccctcagacagcgaaccacttctcttcctctggggaatgaatggaaacccaactttttccctcttccattgaagttatcttttggtatacttttgtctttttttctacttgttagttgtattagtatcaaatggcataataaagttactttgtttgccatttcccactcatctgaaaatcacaaaaagcatttatttctaagatttatatccactgaccttttccccaaagttattttcctgttacttgtatttcatctttgcccttatttctttaatatttgtattagaattagcttgctcttgtttccttcacggcaaatgtgttacattgcccactgggtggcttctgcggatgcccctacccacccctcgtct

SEQ ID NO: 66062 - DNA, 2172 bp, Homo sapiens
aaaagcataaaatcaggatgtattcctgtctgatctcctaaagtgggtgggttttttttgttttgtttttttctttgttttttgtttttttgtggaaacagggtcctcaccctgttgccctgctggagtgtaggagaacaatcatggcttacaacagcctcagcctccttagtagctggtactacaggagtgtgccacaatgcctggctaattttttgaatttttttttgtcttatagagatgaggtctcactatgttgtgtaggccgttcttgaactcctgacctcaagtgatgctcccgccttgtgcctgccaaagtgccaggattacaggtgtgagccactgtgtgcccggcccaaatacatacttctaaaaatgtgtgctatacatggattaccatcctttgcagcctccttccttttacctaggctcttttaaatagcatgtggatattcatgcttttttggagataatgataatggtacacctcactaagtgggtagtgaagctccagcttatatgtaggttttcgtttgggggttacagagagtcagtatgtattaacaaactctggtttaggaattctgcagtgagcatttagacagataggaaaggtctttgaatggtctctactgaggtcttttcctgtgatgctatcatcctgtcatgtgtctcaaaagtggcatttgagatcatcccatcatgaatggcagcctgtagatcatgtagtgaaccctctgttttatatttccatttgtaacaaataagtactttttttagctctataatttgaagtaacaaactctgttttccttgttgaggaaggatgggcatgaagctgaggaatgaatatgtatgtggcgtagtgattaggtttcattgtcatgttttcctagtaaacagaggagaatcagtttctctaactcctcaagaattagttttcagtttttagtagtatattaagaatggcacagattttaccagtttattgcttcaggcttttgactatgaaagtactggtttgcagtgatcatttagttctttagtcttctgaagccttctagatatttaggcctcactgcttatcacttgttgctgaagatattctgtttttcacccttaagaaaagggtgacttttctcctttcccagcatcacttcttaatagtatggatgaattacttttgcaggttaaaatcatcccaagttttagctttgagcattttcaagtcaaaattttttatctattaaaatattttcttttctgagaaggaaaaaatcctgccagtaacgcattaaaaagtattttataggttcagtgtgaagcttatttaacttatgtgagccaagttggcattttagattgtaaaactgaactgaaatatgaattatggaaaattaatttgtaaagttgaaattttatgaaatactttctgcattttgtttagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtaagacaattcaatcttctctgtagagtgggactaaagtgaagtgggggtagaatatacagctcttgttcaaggattctccagtgtgactgttgccatttacagaagggtaagatagtcaagaatgacaggctcggtggagcgcaaaatccattctagcagtaagtccagggaatcacaagagtttaaaaatgagcgttctgaatttcattcaaaggttttctggaaaggcagcgtgctttgtaaacaatgatgataaatatctcaaaatagtaagatgattaaaatatttactttgcaaataggaagatggacatgatgtgactatgcagaatcgcacagcagatctaagtcagagcttggggttgtgaagagcattgcttatacaatacattctgacctttcattcactgaaagtaaaggaatgggtaccatgggtaactacagtggattttgtctgctagtttaatctgcttacaaagagaacgacag

SEQ ID NO: 66063 - DNA, 1119 bp, Homo sapiens
acatgctgtacaatttgtgcagttaaggcaattatcacatggtcctgaagtgacatacatcctcctcaactgacaggattaagagattaaagtaaagacaggcataggaaagcacaagggtattgatttggggaggtgataagtgtccatgaaatctttacaatttatatttagagattgcagtaaagacagacataagaaatcacaaaagtattaatttggggaactaataaatgtctatgaaatcttcacaatctacgttcttctgccatggcttcagctggtccctctgtttggggtccctgacttcctgcaacctgtgccatagtctgactttgttccttaggagtgctctgcctgctctgtggttagggactgtaggaggacagaagtggaagtacagttggctgcagtgatcagcagagaaaaacaagatcttagtggacctgattgttgagaagcggtcagatttccagaggcactagatgaagttagaactgaaggggtttcctctaggtatggaatgggagataaagtgtcaagagtgactatgaggattttggcctgggcagttaagaggatggagtggctttatggcagtgaaataagattgcagagggaaagggcaggagtttgggtctggccctgtcacatttgaaatgcctgttagacatgaggtggagatgaggcctagtggtaggtggacagaggacatgtaaagccacaaggctgaatgagatcgcctgcagagctgatggagctagaagaaagcttctgaaactggagatgggtagtgtgggctggcctgggttccactgagggatggaggagtgattggatgcaagaggagaacctgggggctgctaccctggaaaccaagggaagtctggcttcaggaaggaggggggacagtgggttagcggtactgctcataagaaaccactcagtttgtaacatggagatcatgggccccatcagtacaggttctttggaggggcccaggtgaaagcctggaggcaagcagagacaactctttgaagtgatttcttgtaacaggagcagagaggaagtggtaggtcgaggcagatttggagtcaggggtggtgtggggttttgttt

SEQ ID NO: 66064 - DNA, 1046 bp, Homo sapiens
gtagcccaggctgatgtcctgttccccccttcattatagtaggatgcttactctcttaagatgtaatatagacttagtaccatttacaacccatctaaagataaaggctggtccaggtccctacagagtgccttaagtcattacaaggtgctgcatgcagtgcagtttcctggaaaccagtgtcctccacagttgtccgcaagctttgctgcttcccatgccagaggaggctgtagcctgatggctcgtacgtccagccgctttcctcgctgatcgtggagaaggcccgggccctgcagcatgacctctctgggcttctgagtactaggtgcgctctagtttcttcagggaaaatgtattcttgttaaagcttggtttaaaaacaattttttagatagtagaaaatttattttagtctggaggtaggttgaacagaatggattgaaatgatttcctgatttccagtaaacgattttatttttttcacaaaatcttgggaagcctttctgatttgtgtttatctttatgtaattaaactgttaataaagatgatgatgtaaatatcctgttcttctaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacaggtaaatatgattttccaaaaggtaagtattagggctgatcatccccttgaggtgatcccccagtacttgttgctttaagagttctaactttgccttaagttcaggttgtataagagaatgtattttaaaccttaaacattctaagcactcacatactatttgtatgttaatgaatatttctaatatggcataatctcaaatttcacttaatttgttagcatactttagtttcctcttttgagaagtgggtagaagatgagaatattgggtacccatttgtga

SEQ ID NO: 66065 - DNA, 1365 bp, Homo sapiens
ccgattttcagtgtacacataaagagagagaatacacttaaaaccttgccagttatgttctgagacaagagcccttcggccttttgcttgttacacttccctgtcaggactgtatgaatgatagcaagaggattcagtggctgtgagttaagatcaaacttggcatttctttatcctttgccaattaggagtgtaaataaaggttttctgttatgtgatagtattagtaggggtgtatgcaactgtaaggacaaaaattgagactcaactggcttaaccaataaaggcatttgttagctcatggaacaggaagtcggatggtggggcatcttcagtgctgcatgagtcagcaccccagcggggtcatctgtgccacaggtccctgttgacagtgctgtactgtccaccacactagctgggatttattcctttgggctccaggtttggtgtttctggcactgaattacggaatacttgggacacatgtgacttttttcgtcctttctcctctactgtccttttaaaaacttgtgggatccaattgtgagtgaattatttatgtgtcatatcatttcttgaagttttatatcataatgcttgacctcattgtctagagaagcaatgtgtgttggttaatcctgtatttatacctaattgtatgaagcagttttagttgtcatttctggctattagacttcatgtggcataatggaaagattgtggcttttgtggcatacatatccaattttaaatcccaggcagccaccttttagctctggaagatagtttctgagccttggtttcctcatctctaatggggtgtggcggtgggggtgagttatccaaccccccacgccccagagcttttgagaaatttcagtgagatcctgttatatagcagctgcgacactccccctgggactcgcagagggtttgggaatagatgacacgtgcgcatggacagaggcagaggcaacaaggctgtatgggacacagggatgcatgggacagagtcatctccctggtctcccagagcagaagagaccagcagcaggggcctgatttccgtggccattctcacgttccttcagggtagctctctgcctctccaccagctgcccttcttgtgctaagctattggagtaaattggtgaagtcaaaatcaaaggcgatgtttgtgtagccaggtgagttagttattttgactagagtagaaatctttgttttgaaatttttttctcatgcttgttagagtccagttaggattttgaatattacttattttagtgcaaaatctaacagacatgctttatgttcataaactgtaaaatggtatattctcttgctctttataggcatattaaa

SEQ ID NO: 66066 - DNA, 3526 bp, Homo sapiens
gattctcggagaatttgtgtgcacattttaaaacagatattaaaatatgaagttgggcctctacctctgtggtgcctacctaatagcttcacattttcctttgtttggtgttttcgttgagcagccagagagtgtcagggtttcttctctgttccttaagcaaattgtgtttgatttctgcccccgctgcccgccctagtctcctttagctttccgggctttttatgagcagaggaggggtggtgtcctttctaggtagtgagctgccttgttgatgatggtgttttgggcttcttatggcattaatgttaagccagatgatttttcctttattttttctgaattcggattccttttatgttttcattcactgtagcatttcatacatggattaaaaggagatggccatagctctttgccagcacatgacagggcggaaaaactctgcctctgtgcttcctccagcccccacgtttcctgcagtgggtttggttttgtaatctaaaagtcccatttgttcatcctgtgtttttcttaacccagagacttggtgctaaatattgctcttctcaatctttctgaagcttggaatgaacgtgctcttacagaaaatgtataaattccatccttcttaatctcccagccctctcttcttaagaactaacctacaaacccttttagtcctaaatgtctggaggtgacctcatggctaagaagctgatatatagaattttagtgtgtgggtattgtaatttggggagttgttggtactgttggccattgttaaaacaatatattcactggcattttccttgggggacttttaattttctgtagtgttcaaagtccagagaaacctgtaacattctacttaaaatgtgatggatatttccaagtatgttaatctacattggggcttgaacaagagccactcattgctatgattacttctacaatgtgttttacagtggttaaatgaggagaaaattatccagaggcttgtggaaatagttcatccatcgcaagaagaagatgtaagttcacttgtgtgactgtaaacttgattagaaaaaaaaaacaaaaaactgtttattgggcacagagcatacttatattaaatgtgaacatgatcagagcatacagggagaatagcagcgatctagtgttcttaaagttgatacttttctaaacaatattacattttgccaatactcagaaaatttccagaagtgtacaacagcaggcccttgttatagcaccatctcctttctagagccggtatttcatgctgaaccagctggtttttgtacaaacctcctttgtttatgctcctttttactttttttttcccctttgagacggagtctccctctgtcgcctaggctggaatgcagtggcgcgatcttagctcactgcaacctccacctcccaggttcaagcagttctctgcctcagcttcccgagtagctgggattacaggtgcccgccaccaccctggctaatttttgtattgttagtagagaccggggtttcaccatcttggacaggctggtcttgaactcctgaccttgtgatccaccagcctcggcctcccaaagtgctgggattacagccgtgagccactgtgcccggcctcctttttatttttatacccatctgtagcagttgatgtggccacatttgcatttgttttatccagtctgtttacagctttgcaggcagtgaagtgggatgttggtcaccattgagcccctacagtaactttgttatacttcctagccgtggctgttaagctctgacaggtttggccttagtcctaggtgctaaaggttgacttggttacaggattgaagctagatttggagtttgcagattgaactctgtgctgagggaatgcctgttgggaccagtgggtgtgtgtgtctctagaagagatctataaggttaccaccttaagtatcttggccaagccgtataaaattggcagtagtcatccatttttacctacagacatgatagttctctatggttcagcctaatatctacaaaggagttggtttaagggcaattcaaagtttgtcctgaagctgggagaatctccttgtgtgtctctaggttgcaggttagatgggagagcgagcacagcagaggagctgtgcaggaagagacatgcaatggaggctcctctctctcacagaaatacattttctgtgatagtagagcgaaaccctttcactctgatccattcagaaacttttcatacctggactttattaaagggactgtcacttccccattatccctctttgggagaatgcaaggtatgctcctttgcagtagttgttactgttagcagagttgacattgtggacacatccagtgcagacatggattgggaatgtgggagcccctgcttagaaggtgctctcaacctagctggggtgataagccctcctcctgtgggcaggggagtgtggttctaggagcaggtttccctgtgatgacagtgtggcctgtgcaggccgtggagagccatgacaggagtgtggcctgccccgttgacagggaggagtttccatgaatgaggcttactccttgctaggttcatgttcttgagcagaggaacttgattgctcaatgggctaggaagaggattgctcagtaggggctgtctgaagggcccaggagaaattgataatggagaagtccaattctgcaacaagttttttgagaaggacactgcattgtggacatgagtaccttctctgcatgacttagaagaaagttaattttggtttttggacagtcctgttgacacttctgttttgtattaagtgatgaattccatgttaaaattatactggccagttgatagttaccaaggaaatgctaggctcctgattccagtcagtgggtttggatatcctaatctgtgctctcctctcttctagaatatgagtgttctgcctgtattgggagcacattgctcagtctttgagttatgctcagtttcttaatccagagaataaaatgtgtttgggtgctgagattttagagcttttctgtaaggtcaatacactgagagaaggcttaatatttcttatccattggcattttccagaaaactgtatttgcttttactttttttttttttttttgagacggagtttcgcttttgttgcccaggctggagtgcaatggtgccatctcggctcaccgccacctctgcctcccaggttcaagcgattctcctgcctcagcctcccgagtagctgggattacaggcatgcgccaccacgcctggctaattttgtgtttttagtagagatggggtttctccatgttggtcacactgggctcgaactcctgacctcaggtgatctgcctgcctcagtctcccaaagtgctgggattacaggtgtgagccactgcacccagctgtactttcacttttttttaattcaaaaaaagtatgtgcatccttctatgctgataagagtgtattttggggatacacgttgagtat

SEQ ID NO: 66067 - DNA, 1971 bp, Homo sapiens
cttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttcttgttcttctttcatattgatgctgttccatgtgttaccattgtgagtgattggtaagtgttccttatgtgggaatcatgtgccttgaaaataaccttgggtgggtgagaaggtagggaaacctgcttcttttatctcagtagaagtttggcagggtaagaagataaatgacatttatatctagactttgagttttccaattatttgtaaaatggaattctgtagagccatcctaagatgtggtagtcatttagaaataactgtagtcacagcttccaagggtcttttgatgaagaatagtcttgtgtaagtacgaatgttgtgcattttattcagcagcttttgtcagatgatgtttaaggattcattgtatctttgcagccgattagggacagttatctcatgtttaggttgaagacagcttggggatggggtgctgttttttctagattcacatgtttttaaaaagaatgtttactgtcaacatgggcatgtatatttgacctgcattcaaacagctgaacgttattttaatagagaataatcaggccactcctcactatgggagaataattgggaagtatgcatacagctagcattgttaagtactaatggcaatcttgcttcggtttacttctattgttgtttttaatgcttttgtcaatcctttttattcctgctgtatattgaggctgttttgcatctttggcttaactacctataatgccgttttattaaaataaaatgtattatttcctggacatatgtaagacaggcagggaatacattacagacaagttaatgtgtcttcaaccctgtctttgcgaagtggaattgtgttttcctagcatgtagaatacgaaggggttgagttctctgaagtagcaaaactacaaaagattgccggcttctgagtaaaatggcatcttacctgtcccattttagtaattcttgcactatggcatatatagtcctttaaaacatataagacaccccacattcaaatactaattgtgatattaattaggttgaaccttgtaaaattgccatttcagtaggttagaaatgttgaatatcagcagtttcatatggctcactacagtgctgcccagtggaaatagaatcaaagccacatgtaatttaaaatgtttttgcccaaagtcttggaaatccaatgtgtattttacacttagaacatgccggtcagacgagttaaattttgggtgcttgatagccacatgtagtgaatggctcccatagtagacagtgcaggttctgcctgaatatcagactgcttagtagtcattgctaagttcttcgtgccactccaagccttccgtccacacagctttatttggacccaatgtgtaacctagccaccagagcccatgtgcgcactagcttttatatttcaagctgtgttttagtcctagatcaggtagctaatttctggatgaagataggtaaatgcctagaatttacatcattaaattagttggagtaaatgtgttcaaatacatggacctgatgaatcaatggccctgttgccaagtaaaacctccattgcatttaacagtggaaagaaaatctgtcatagtgcttcccacagtctgtttgagaataagaaccaaccacttctaatatttgacacactgcacatctttttagtgtctgttgattcagacaatacacagtgagaaaagacttccattttagtaaacttattaatcataatagcatctgtatatatttgatatattatgtgataatatgtaatatctatttgataaatcatagttatttaataatgatgatattacatat

SEQ ID NO: 66068 - DNA, 1643 bp, Homo sapiens
cgaggcccggctaatttttgtgttttttagtagaaatggggtttcaccatgttggtcaggctggtctcgaactcctgaccttgtgatccgcctgcctcggcctcccaaagtgtggggattacaggcgtgagccactgcacctggcgtccatttcttaattcacatggatttcgaaaattactgagaggctaagaaactaaagttttccttgagaatgttcatataaattcaatgaactggtttatgttaattgttatcttactatgtatgagagaagtgtaatggaaagagcctgcagataatgctttttggacatttaatttagtcacatttatttcattgctgccattttattttgctttttcaaattttatttgtagagtaaaatgcaacaactgatgttttcttttttctgttttagatctttgctaattacacatttatgcttttgtaggaaaacattcatgggttctaattagcctttctgaacgttttcccttctttagtgagggtgaaaggttctatgtcttcttgccacccccagccccagtcatcatcatcatcagagtcttggtttgagtaggaggtgacttggtcttgagattctgttggctctcgacaaaattggcaaagacaagcatggcccaggttattttgctgagggaaagagatagaagggtgagtgagtgagtgtgtttgtgtgcgggtgcatgtgtgtaatttataaataggatcaattgcctactttaataagtatatagaaataaaatagtaaaacaaatatgcccaagtatgaactcttcagtgatgcttgtcttgtaccgtcgtctttttttctgaggttgttggtgataagtgatactgcagttagtgattattgatttgtttccctaggcaagaaattatagagcagcttctatcaaatattttccacaaggagaaaaatgagtcagccatagtcagtgcaatccagatattgctgactttacttgagacacgacgaccaacgtaagcttttcttatatcttacaaaatgaaccatgttgttttgctttcagatttaagagttaaattcttagtggataagctgtaatagcgtacctttgaattgcagttgctgattcttcttctgctatataaaccatagcctaattttatatgaataccacatattgggatgcagttgaaaattatgttttggtgacactatttattggcagtatttagactctagtcatatatttttttggtagtggtagttaggaaaatgcttactataataaatgctataatcaaaaacatgtataatggctgaaaaacagagaagcttatttcttgctcatgataattaaaaataggtgttcctggtcagtgggtagctctcctggccattcagaacgtctctctgtcttgtgattcctttcattcctttctgcagatacttaggccttcaggtggtgttttcctgggtttcacatttgagggcacttgagcagaggctgtcttaaaatgcatgggcaggtggcttgagctttgaggacaaatttcttctacatgttttataatcaaaaataaagtcttgcttttcacatgtgtggccttcgcccctggaccagccatttcatgtgtgtcatgttattctt

SEQ ID NO: 66069 - DNA, 1033 bp, Homo sapiens
tttatgttttgtagcgatggagtctgtgttgctacattcagaggggagggggcgatgtgagactgcatctgtttacagatgacaggattgtctttgtagaatatcctaaagaacattaaagaaaaaaaaaaacgcatactcctagaactaacaaatacatttagcaagattgcaagtatgaagtcagcactcaaaagttaattgcatttctatgtactaggaatgagcaattggaatttgaaattttttcgaagtattattttttatagcatagagaaaagaaaatactaagatacaaacctaacaaaatgtgtgcaaggcttaatgccccaaaactatagaatattgatgaaatcaaagatgacctacataaatggagagaaatactctgttcatggattagaagactcagtattgttaagatgtcacttctccccaaatggacctgcagattcaatgcaattccgaacaaaatctaagcaggattttttagaaatcaagtgaattctaaaacttgcacaagaatcaaagtacagtagccaaaacaattttgcaagagaaaaggactcacactctgattttgagacttaatacaaagcgacagcaatcaggacagtgtggtgaaagaatagacatacagatcactgggacagagcagagtccagaagtagacccatccccatgatcaggcggtttttaacagaggcatgggggcagttcagcggagaaaggacagcgttttcagtaaatcgtcctgaatggttaggtattctatgcagaacgttggactttgatatatattttgcagattatgcaaaaattaactcaaaatggatgatagaactagacataaaactagtagttctagaagcaaacaggagaaaatctttgtctcagagtcatgtacagattgtttagatacattgccaaaacccaattcataaaacagaagttgataactcagactacactaaaattttaaaattctgctccgagactctgttaagaaaattaaaagataggtcacagactg

SEQ ID NO: 66070 - DNA, 1024 bp, Homo sapiens
tcttcagagatcttttttccaaagaaggtgacatttgcaggccctacgtattagaatgtggacgtatgttttgggtaggagagcatcattcagcccactacttagctaaaccagacagacagaatagacagtactcagtgcagtatgcagggcaactggaagtcacacacattactgttgggaatggaaagtgatacagccacttcatagaaatgtttgtcagttcttagaaagttaaacattcataatgtcacccagaattcttatccttgagtatttacccagttctcattctacctgtaattgttttcctgcaagaagtaggttataatgagtatagattgaactttatgtagaataattttaaaccttttaaataggaaataatgttgattatctaagaaaaactgtatggaacaagtataggcctgttcattaataacaccccaaactggcaggcaatttggggtgccctataatccagaggttggatccctttcgctttccaaatttcctggtcacttagagacttgttactgtataatagttatgaagacttagaaggtttagaatgggaagaaatcacatgtaatttcttacctgatactgtagctgtttgggttgcaggttatagagtctgagcctcatggaggtttcattaaccctcttctgcctcattatgcttttttcctagccttttttcccgcagccagaaaagttgatataatcattaagtaaagacatacatggtcgataaccttgaatgatttgttctgaaattataataactaaaattccttgctttgtttcaagatttgaaggccatatagagatctgcccaccaggcatgagccattcagcttgttcagtaaacaagagtgttctagaagccatcagaggaagacttggatcttttcatgaactcctgctggagccacccaaggtaggggagctatgttaagcatggctgcccagcgagtaatttggttgaaacagtcattcgaatgtgtacgggccttaggag

SEQ ID NO: 66071 - DNA, 1401 bp, Homo sapiens
ctgctgctgctgctgttgctactactaccacttcttcttcttctttattcttccttcctcctcctccttcctccttctctttcctcctcctcctcctccttttttcttccttcttcctttttttgtttttttgagacagtgtctcactcttgctcaggctggagtacaatggcacaatcacagctcactgcagcctcaacttccgcaggcccaggtgattctcccacctcatcttcctgagtaactggtactacaggtgtgcatcaccatgcctggctaatttttgtattttttgtagagacagggtctcaccatattgcccaggctggtctcaaactcctgggttcaagcgatccacccacctcggcctctcaaagtgctgggattataggcatgagctactgtgcccggccataacttcttttagtttagatttctggtcagattttgaaatattgtactttttcctaggatattctgtagccttctgctttcttctcataacagcttggaatgttgaggcagggagacacttgatttcttataaaatttatgatccagggaaattccttgcttttttttcctttttcctgcttggttatttcattgtatcttaaagatatcaagagcagctttagatgttgtttcaggtgtaaaattcaggccatgttgtttgcagggtttaaactagtgtcatgtcttagcaaatacaccatttgctttgttcatttaactgaatttaattggaaagctttttcttcttcagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattggtgagattttccctgctcacagacattttaatttgccattgatatttcatggatatttaaccaagttacaaccttacaaatttacattatgtcagtgacttttcttggtctgagcataaatggtgttttatgtagtttttgccttgagtttattataaatttcgaatgcttataattgttcactaggcatctactgttgctttatataaagaattgtaacataggattttgaagatgattaagagacatcggcttttccctcgtgctccgtctcgtggacaatgactgctgggtgcagcattgttttctgttcatatttagtgaggggacaaacctttatcttcttgccactgggaggtatctgtataacgtacctgacgccatatggtcttaattgatttgagtctggattgactcttccttgagacacagttattagcctgcttactgatggaaggagaaggaaaagcccagggatgatt

SEQ ID NO: 66072 - DNA, 1083 bp, Homo sapiens
cagcattcctctctagtgccctggaagcctttatgtcaccccgtagattctgaagcatggtggcataagggcgtgtttgggaaacactctgaaggcatgcttctgtgtttgtttttaagacaggtttattgagatataattctcatatggtaaagctcattttaggtgtacattcctaggaattctgactgatgcctgaagtcaccatcaccacaatcaagacatttctgtcacccccaaaatttctctcatggtcctttgtagttgatcatttcccagcattcttgttatgtgtctctgtgtctccaggaaagctagatgactcttgggagtcagccttactttgtgaggtttgattttttttttttaaatcgtttaataagcactgctactagggttttgatttggcttcatgtgggaaattggcattttgtttgtttgtttgtggcaaggggctagtattggtagacctcagatacattcttccaaatggagctctttggagatgctgtttgtggcccagttgacatctctggttatatgtctgactccgtcttggcttctctgtgtccttcccaacctccagtcttcttgctgcctcctcatctggccagggctcagatatcctttgtgccctgctctcctggtgagtcccgttttctggaggcctggtgaataccattccctctgtctagggggatcccgaaagaactttccttgtttccttgcacaacagcctgaagcagtttgaagctgtgggtcaccttagagatgggcctttgttttctttcacttgtgtacttgagggtgtgcagaagagtgactcagttgcctgtaggtaacacctggctctctggatcttactgaagaactaaaagagactctgagcaactcagtgaagattgactctggccaggcacggtgggagatgcctgtaatcccactgctttgggaggctgagatgggaggattggttgaggccaggggttcgagaccagtctggacaacatagggagatcctggctctacaaaaaattagccggatgtggtggtacttgcctatagtcccagctactcaagagg

SEQ ID NO: 66073 - DNA, 1119 bp, Homo sapiens
gtgtatggtcaagtactagttgactgtctcctatcttggccaagtctcacatcagctaatatcttaacttgagacatgtcattggtagataattatttctattcattgatataataaaaatttgctatcttttaagaaaatgaaccagcagaattcttacctcagttccttataatctgattaaggtttgaaaaagtttcattaaaaagatgtaaaataaaatcacaataacattaggcatcagagaaggtttatttgatcttttaaaaaataatgtgttattgacagtgagtgatgatttttgagattcgaataaactgtggcctgttgactgaggctgccatataatcttttacaatttcacacccctccctgaccatgctgcatggtcatattctggcaccttccattcctttgtttttcttttcttttctgtccatcgtcattttcttcagtgccttcagggtttaaaatgattgtttaaaagtccgcagtatttaccgagtgtttcatcacttcatcctatcaggaatctgagtatttgtcctttacctcttgtcagggctgagggaggaagacggcatggttacatgggacacctaacgaggatagctaactgtatcgtgcacagcactgacaagggccccaacagtgcattagtgcagcagcttatcaaaggtaagttatttgtgaaatttgaattacatttttgttgggttgcaggaaggatttaagggtcaagtagaaatgcatgtagcatttttaatagtgatttgtgggacttctttatatttggcaaattatgtatttgaatgaggttcttgagaatgtgtttgaacagtgttgttttttggttgtatttatgttcatgtagttacagaccattccataagcattggcaggcttggctggattcagcatataagagtcacctattgtcattcttaaagagcattgcttggtgaatcatgcttttgagtattgtgagtgtgaagtactcatatgctagcagttgagccacttcagctataattttgccttttattttctgaaggcctctatatagcctctgaattaagtttctttaactggaatattagggcatttatcagcatttct

SEQ ID NO: 66074 - DNA, 2428 bp, Homo sapiens
acgtcatggtttgattttctcagaaaagcagttgtttatccttttctttaacatttctctagaaggtagaatttcactattacctgtgtatccacgttggcccatgacacaaatatttaggaaacatgatcttagagcaatttgaaaagccatactaggttctgtggaacattcattggccagctgccaatgagagcatttcaagaaagtgtgcaggagctgtcatttgcagcattttctagacttaacttgaccatggaaaaagatccccctacccccgacacgttaaacacctaccacctttctcagaaaagcttgttggaaacacactttccaggttaagcttctaccagagcattttcagaaacttgttaagttcacaagctaccttagggctcttggcctcatcaagcctataccattgggtagggggattctggttcctgaaagtccatgggatttgggcctatggaaggtttaataattccatttctctaagagcactgggctggctgtcacccagtttctcagctgatagggcctgctcaccattgatgaaccaggtgagtaggcccacttttatattacctgcttactttatttgtctccgtggaggtcattgtggtgataatgcttttttgcttttctcactctgaagatcttcccgacgaagtcagggaacgatgggagacgttctgcacaagctccttaggagaaactaacaagaggaacacggtagatctagtaggttttacaaggttacatttttattctttcagtgctcttagcctttgcccatttattcagaaagatgtaaaagatcttccatttacctcagtaactgtgagccaaagataaattcttatctctttaccagggagagaggtcagtattcacaatattcttgcccatttgtctagtccactcctaattacctgcctgggatgacagaaggatattgagaagtcactgatttctgctccacatcctacttagtgtccatttccctccatgccctgctgccgagcacctcaacagcctcttgccttcctttcattctgctgggtttgtggccacatgccactgataaccctgggtgcttaggaaagcgaaagattcagttggatatttttctgatattattgagttgagtataccctcgttttacatcattcccaatgggggaatattttgtagatgactttgaaaccccagctttaaaatttttttaccagaattgggactttgagccagggaataatggcattgataatttttttaaaaattatattggactttggaatgtattttttggtttttaaacacatttaagttttaaggtaagtattgcttttttctgcttttaaagatggggaaagcatttccttttacaagtacatgccagctgatagtcgaggggtggcctttgcttagacagaagcagcacgtgactcgacattgaagtgtttatgtttggcgtttaattctatatttcaaatttggcagtggcagtcttgaatttctaatatgcagtaacaccttgactgttaggaattcaatgatctggcagcctgaagcaacagggaagcaggctctgaaagccagagagcagccacttggtcctcctgtgtcactccctggagggctgtgccccctactttgtagattgcctaaaaatatggtcatctttttccagactcctgacagagtcacactttttaagcggggaataatgatagaattaggaagtattaagagttggaagaattatgaagttgaggtaactattaaaaggaagctatgtggggccatttaattaaaatagacctaaggcctaatagcccgagtgtctctgtgtaccacagcccagcagagaaaatgacattagtattgacagccctgggtcatcaaggaagggttaagtcatttttaatgaatattttacccattgtagatagatactcggactatcgtttaacttgagtgttctggataatcagggttttttttgtagaatggaattgtcctctcccatactgttaaatcatactgcttaattttggaggttcccacgttgattcctttgcaggcaatatagtctcttttaaggggactattgtcttgtcttataaaggaatatttagtaatctgattttgtttgggaaacttcttttaaaattatcctttgattggcttaaaagttagaagtcaaaaatgtccaattaagcttgttaccagacttttaaacaattgtttttatcttaggtaactcaagcatatttcttttgtgagcagttctgtaataaagaaggacttcattacaattcagataatgctcacttactgtatagtatgctgtcagcagatctgctctgggattgtgtgtaaatgttactacatatatccccatagaagggtgtggtcatcc

SEQ ID NO: 66075 - DNA, 4890 bp, Homo sapiens
taccctatacagacctatttgaattctactgtgggtttattgaaccagtgttggaacaacttcgcaaaacagaccaggccagttaggtacagcctcatgagttggcaggtagcagcagcccgtgtcttccctaagatgacattccctgcccaaaacacttctgtgaaaagtacagaataaacagctcagagaatacagtgtaagttacccgcagaaatatagtacttctttctagaagtttacaaactgtccatgtttatcccttgccatatagcaatcactactattagtgctgtacttaattatttgtttatctgatttctaattgttaatgcttcccccaaatattgtgtgacatttgtaattaataaaaatcacttaacgatgaattggtgagcagttcatgtttgtgtttttgcttaattactgaaagttggttgtaagttctgggggcagggtgcacattttcaagggtagatgatttggggtcttttgtgagtgggaagctgtcgactcaagtcacatttagtactactagacagtggttttcttagtgtgggcaggaagtccaagaatttgaaatggttatatttaaacctgaccttttgagtggcgcactggcgcactggtaatccctggggattgcagttggaccctgcaggccccgtacatagaaagggtttctgtgtttcatctgtgccattacctctgtctttctttttgtaaacatttaattggaggtgattatcaaaatcacttaaatggagtaactcacctttcttcttgtctgttttctggcgatgtcagtagtgaggagtggaataactagaagggagtggcagggcagcagcctggcccgagggaaggaagggtgcccttgacacattgggcgggtttggcagcttaactgtgactgactttcatttttttctgttacacgttgagaaaaaaactaaatgtgatttttccataaaaatgctgatacaaatgtccaaaacttttctatgttaaatagtcttttacatttttatgcatataggttacaacctgccatattcattcatccagtgatgatgaaattgactttaaagaaacgggtttctcacaggattcttctttgcagcaagtgagtcacgcctaaagctttgctttttgtttttattttaaatgcttagtttagttgccttttatgaatcagcttcagagtcagattatgtattagaatgtgatttggggttacttattagttagaccaaagcatttaaaataggaagtgctgggtaaatgaaagatagatttgtattggttatgtttcaagggattgttccatccctgataacagtgatgagtcaagtacattttcagaagatttgaatgaactgaatagttaagaaggcatctcacacatgcttgttacacagacctttacaatagttgagttgttgcttaaagatttgtgtagtagagatctgctggtaaaaataatagaaataagacgtttaaaatgtaagtaaaagtaaactctcacgaatacccctgatgtaagttctattatagttacatctaaagtaaatttttagttgaagtaattcattgcaacccctctctgcctgcccctgaatttatcatctccctttaccacctgcttataatctttgtgggggaaagcctcgatatgaataataaatgtactgatttatcatccattgttagttcttggagaagtgacaaatgatttcacttctctactaggtatgggagtgaaaaacagaagcccttttgcaggctatcagcttttcatatggagaagttgtccttagccaggaccagaatgccttggcttacatgttgctttggtgcagcaatagaattaacggggacaccttcccacccagcacagaatgttgttgcttggcttcttttttttagtctctaagcttcgtcttagatgaagcttcacatgcttatgctggccctgtcttttggcttgtaagtcttacacctgtcatattccagtattggttgagctaagcaattgtttgattttaatactcagacagtttagagtttacctttcccaaataggtctgaagtagcatttcagcatttggctgacttctctgttgattcttgacacttctgcctttgacagcagatttccggaggttagggtcaggaagtagccagtccctagggggcactgttgagcagctctcacagcttcctgccttggcttgctattaggctgcacgggccgtggcggtggcccaccatggctcattgtgagccctcgtgcctgcaagcagcccttttcccagagcgctctggtattgtcccaggaagcacctggacaatgggctctccctccactgaggcacctgtagagtactgaaatagtccacccagttggccatgaacctgagtgctgtacattggtccacccctagaatgaagcttgatgatatcaaatgtaaattatcaaggtaattttgtacctgttgaaatacagctttaagaaaaagaacaccttactagtaataatgataaacttggaacttcggctgtcaatttagtctagatttggttaaatttaggcatttggaaagtggattcctttatttctcatgatatctggttccagggtcatacctgttctggggagagttttcttacattattttgtttgtttgaccgacagctcacgtgcgtacgaagccatttcattcacaaaactaacttacaacagcccttgccaagctcttagcttgcagaatttacccacttcatatgaacttttcaaagtggaagaataattactcttttctgattgacaagcttccagtacatttttctttgcatgtttaaaccaatcatggatcattttgaaaataaatacactccaaagcacttcttaaaattttgagaatgcaaaaaaggtcttggttaatttattagagtttcatcatagcctccattaagatcagaatattagtttgtagacttgaacttcaagttctcattcacgtttgaggttgggcatcatgttgataaagtccccgaatgtagagagctcagggcagataatttaaccaggtaacccagccacgtcaccagtggggagtgcctccaggcgtttgtgccctgcccatttgcttctccctttagccttgtctggtctcctaaagtctggtgtttgactccccacctccctgattctgccttatagagtttggagggtgaggcccccatggaggtctggagaattcagactgactgccgcatatgggctctgaaacactgactcatcatttcccactacctcacatcacatacgggcttgctggtaggcaattaggccacatttagttgaccagtagtttctgttgcctgggtggcattactgttaagagatttgcttaaagtggttggctcacttctcagtgacttgaacagtttctgactttggccaggatgacagtactaggaaagtgtgctttttaaaaataattatacagctatattgtgctttccagatataggtttctcagagttcaaagcactttttatatacctttaaataggatacaataacagtcttcacttacatatatttgtaagttttggtagctttattagtaaaaatgagatttgaaatgtgaagttctttgctagaagctgtaattgacttagaactaatgaggattacatctgatcattttccttttttctgtgcattattgcatggaagttactagtgtctgtgtcagttgctatgtatctctccagatggatgaatagataaatatatatctgtatatgtattctgtatgtacatgtatgtatgtatacattcatatttagtatttgcattctatttttgaagcatttaaaatataacaacattttggggaatatttcttcccctttacacccaggagaatcacattaggatcactagaggtataacagttttgagagagctggctgcgatggcatgcacctgtagtctggctgctctggaggctgaggtaggaggattactaggaggtaggagtctaggagtttgagtctagcctggacaacatggcaagaccctgtctcttaaaaaaaatttttttttggaggggaaaaataaaacaattgggagggaacttttccctcacgtgaccacatttctgatctgtagataaactcagagcgtggttcatgctgcttactcaacagaatcacttcatggttctttaccagatctttgaggtactgagcatctgttttgcctcataaaagataaagctgcagttcagaagaactgatttctttttgatgtaattaatattaatgctggctgtcattgtccattcataggtccagaactcagctcagcagcccaggacttgtccctacccttctgctttcagccagacccccgtgctcagccttggtttacactccatgccttaccaagtggccattccacagccagtcgcttgctgccccctgctccctgcccccatgtgctcatctaatatcacctctgggggcaagaaagggggcagcacaaaagtgggagtgagcagaggggcagtgggtgtgctgttgtcttgcatgagcgacaagggaggttttgggttctctctgtctagtcaaactagacatatagagcttttcttcagacctaagcagtatagataccttccaaagcctaatataaggtttatttttaaattatctgcaataattatccatgccataattccctgccaccagaatgagtaatcaggaattaatggtagaggcatttctgcagtgtacatctgcaaggtggaatctggaggctctgcccatatgtggaaccaaggagaaggtggtttaatacagttacagctgcct

SEQ ID NO: 66076 - DNA, 1032 bp, Homo sapiens
gaggaggtggcaaggagggagggggtggtcaccacttgttggatcttaggataaagttggttgtgtccagaggtgactgatacaccttataatttcagactgttccatgtcatgtgatcactttaaactaggcttaatccaaacctctctctaaagataattcacaatagaggacagagtggtcacatagtgtttcttacagtgacatgtgcattagaatgatttgtagaccaaatttcaaacgtttccttttttggcaaattgtgtctgaaattatttgatttttcttttagaaaaacacaccaacttttatagccctatggctatgtaaataagatgatttctggaacacaaatgggcaaatagtatgtagaatatcattagaatcattatatcactgtcactggtcctggggttgccaggccttttctgattatcagatgcaacaaatgacgtccaattttattgaccagtttggcttcaacgatgagaagtttgcagatcaagatgacattggcaagtgagtatgtttttctgtttccgctgttgctcttgcacacccttgctcttggtagatgtatgtgtgattctgcgggattcttagtcttgagcattcgtgagtgggaggaacctgctctttccacggtgttcctctagttccagcagattggccctgggactggataattaggacttaaaataacactgcagtggccgggtgcggtggctcatgcctgtaatcccagcactttggggggctgaggcaggcggatcacttgaggtcaggagttcgagaccagcctggccaacatggtgaaaccccgtctctaccaaaaatataaaaaattagccagttgtggtggcaggcacctgtaatcccagctactcaggaggcggaggttgtagtgagctgagatgtgctattgtactcctgcctcagtgacagagcatgacgtggtcccttttttttggagacagagtctcattctgttgccccggctggagtgcagtggcgctatcttggctcactgc

SEQ ID NO: 66077 - DNA, 1984 bp, Homo sapiens
ctgtctcaataataacaataacaataataataataataaaattattaatccctgtgttgttgactggggcatcacgttccagcagatgaccaggttggcaggaaaagctctgccctacatgtattctcatctctaggtgactcatcagaaggtagatttgggttttttgcaagagccagacacactaaccactcattttgcagtcagggtaagaagcagagaaatgagaattattgatactgtacagaattaacgagtagaaaatgtgtaggtagttaatagaaatgaaaacaggtggtctagcatctgacattgggatagaagagatttataaacaaaatattttgaggtagatattatagctcattgacacagagtttaagaaaaaaaatgaaggcagctggtatttgaatattggatgatgattctcacaggagacacggttatgccacagacacccagtatctgctgtggtctttggaagcagtaaattctcaataatttgttgaaccacagccagtggagcctgttgtttgtcacaggttgcagtttgcagtatgtgagaagctaaaatatttttacagcacgctcttaattgtgctataaacatgccgtatgggcacagtggaatggaggtgccgctgtaaacagcaagagttgaaggctgttacgtgccttgagaattggctcattttaactcaaaaagagcaagaacacaagatattctgtccataccccaggagcattctactcaggctaggatccaccacctcacaccagaccctgcaggtccctgtttggtgtctcgacattcacgtgcctggactcttgcttcatcttcctagttaggatctgtaatctctttacagtctgtattgcatgcttggactagtgattgagtggaacaaatattttaagaatcataagatagcccctcctcttcaaacttatgtttaataagcaatgaattcttttactccctccttgcttttctagatgatatcttgttaacagcataagatttcatgggtgtctatgtattttgtgtatgagtttgactatccctggagaaaactcaagtgtctgacagcttttgtatacttcatgttttgacttggttctttgcaaataacctttttcttggttatattagtatggcccatggaactatggttgttaccatagatgttaaaaatcttttataggaaggattcaagggtgtcccaaaggctttatgtctcagaaggcttctattgcagccctcctatcctacataaattcattaataccaagggagctggcatcatttaatataagaaggttgtttctgtttgttttttatttatagagattttgatgatagtgtaaatatcttaaatttggaaactttcataaatacggtttctgtgagctgatagtaattaatgcttcctacacttttattttgtttttttacagtgtttcttttgatcgagtatcagacatcaactttactctcaatacaaatgaaagtgtaagtataaactctgttgtgagcagtgtggcacatgagaggttaaaaattgggtgagtccctgtgtggatgccacatgctgggacccctgtgctctagagccctaatcctaaattggtgttacatacttcactctgtcccacggcctacctggcacccgtgggcatgtgatttttgcagccctggtttatgacttggtggagctaataagaccagggtcacttgtgattgcagcgtagacacttgacttcaaagagaaggctgcagtttgacaccaacccactgcctttgactcctttgtattgccaggagagaaatgtggactgggtcagggcaagcccctcgttactaggcatttctgtggaaacaccgagacagtcgtgtcacctgaatggagacagtttattgattttatgttgactagcatgagagaccactggcttatttgctgatggagtaaggtaggaactg

SEQ ID NO: 66078 - DNA, 1030 bp, Homo sapiens
actgggagaaaacatttgcaaatgacacattagataaaagacttgtgtatagagttaagaaatctctttactcaagaaaaagacaattcagtttttaaaaagcacaaaagtgtgaaaagacagttaagatataagatggcaaataagcatttaaaaagatgctcaacctccttggtcattaggaaagtacaaatgaacaccacagtgaaatgaacacctccaccccttcgagaaggtggttcttagattgtggcctccactttaagcagagcccatgtgttcctgtggtggaggcttagtgtgaggttgggcagcacgcacgcaaagctgagtcttcccgggcatcctgaccacgtggtgctcagacagatgtgatcctgctgaagcaccacaggaccttttgttgctggatgactgttagaattttctggatttagctggtggctgataagcagtgttaaatacttgggtcttgtttttccttagctcggggagtacagacagtgaggaaagtacagactctgaagaagaagatggagcaaagcaagacttgtttgaacccagcagtgccaacacggaggataaaatggaggtggacctgagtgaacgtaagtggattcattcttcagatcagctgccctgtgttggaattaggtattgtgaacaattggcaaaggagcagttcacagcatctgagatgatatctgaaggaaaggttgggttgaagcgtgttgtcaagtgaattcctcttggaggtttaagtttcagagacagcttcagggaaggagcacagaatgcatttgtggataaggtacctccccttcctggtaggaaatgaacgtcagctgtgtgggtctggctggaggacagagcccactgctaggtcagtcttctggctgtgtaccctgtgtgctcttgcagaaggaaaaggccctgtgttggtgggaagaggaggacatggttgtgttgtgtggcttcgtgagtggaatcagccaggggacgcagccttagcttaacaagcatttcagtg

SEQ ID NO: 66079 - DNA, 1053 bp, Homo sapiens
caggcgcggtggctcacgcctgtaatcccagcactttgggaggccaaggcgggcggttcacgaggtcgggatattgagaccatcctggctaacacagtgaaacctgtctctactaaaaatacaaaaaattagccaggcgtgatggcgggtgccagtaatcccagctactcaggaggctgaggcaggagaatggcgtgaacccgggaggcggagcttgcagtgagcggagatcgtgccactgcactccagcctgggcgacagagcgagactccatctcaaaaaaataataataaaaagaaatgggaggtttgagaatgtgggatcattgttagagtgccctccaggtggctgtgccctgtccgctcctgccctcattggtgagagtgtctttctcccacagctccagtctcttttgctaatgtgtttttgataaataccttgtggtacatgaaacgactgaagtgttttccaaatagaatttctcccctctttttagcacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgaggtgagcgaacatgtgctgtctctacacccttccacgggggacctgggaatggtcaggtgtttgctgttaacgtgtgttcttcaccttgactgacttccaagttgaatatactgccctgaaaaagattaaacatcagcatactaacacagctctgtgttgtaagaagaacaatcaccatcttcctttcctttcctcctggattaattggaaatgggagtagttcttgaacaaagtagcttgtgaggatgcggtcccagggagttagcaggacgcagcagaagatgcatctccgtgagcttttctggcttcatagagctgtcaggacagaattgaggagaagaggaatgaggtgaagccaagaaatcctgacaggcacagcacctctgtgtggggtgtggcaggc

SEQ ID NO: 66080 - DNA, 1613 bp, Homo sapiens
cctaccccttactgctcaggcatttggtgtttttttactatgtttccacagttccaacaacaaatatcattaagagggccagtctctcccaggcagtgtggctgaaaataagtaaaggtttttgtaaaaccagtcaacctgataaataccgttgccattgcacaatgtacgtctttgctgttcaagctctgggagcctcctagtgactatggtgggatgagaagttgggacatgatgagcctgtctagaatgctttacaaagtccctgtcttactgccttgctggcttaacagaacatttgcctgcccgcactcatgtccttcttcaaacagctactggcacttagatccatgtgtcactggagtttgtaacccagtgactcttacacagatgctaatgtctcctaacaaaaacttacttgtaaaggcttattgtgaatcttggggtaactgaggaccattccctgctgctaatatctgaattttctcttttttgaaagcacaaaagattctttaaggagtaattctccagtggaaatggaaaccagcactgaacccatggaccctctgactcccagtgcggctgccctggcagtgcagccagaaggtgcgtgcagagaggcctgggtacacgccagggtcacgtggctgctttgtcaaaccagacctgattctcaggctcaggggctagtggagcccgggagtgagatggtgggtctgatgtccacagggcagctgatgaaagaaattgtgcctgtccttctagaaccacagcatgctgactctggaaagagtaagggctctaagttaccaggcatgcagtgtgcagattaggaaactgaggtctagagggaagaaggcctaagcccatagtacccagggtgaataaaactggaattagacgtgtgcagccaagcctgtgtgtagttgtcccttggagtttgctttgctcaagcatgtaggtgtatctgggtttgtttagagctatggggctggttattttcacttcgccattgtaagcagattgaatagtcctgggaatctctaaagttccagtgggttttcctattactctacctagtcaaatgtgttccttgcacggccctgaactgttttcaccttgatggacggggctttgggaggagggggatgctagcaaagggagtgtgatgggaaccaaaaggatgtggagggcacgaatcatgaggtgggcttaaggagtgagttcttagaaaatgaaatgaggttttggtagagggtgtgagaaccctccttcccaggggcaagggaaaggaataaaaccaataactaatgctggtttcatcatcctcctgaacatttgatacagattcccgcatttgactcctcagtggttctgtaagtgggtgcactgatcccctttcctggatgaggaaactcaggttatagatgaggttccttgtccaagtagtctacagctaggaagtggtgatgtcgatgtttgaatccaggaagcctcacctcagccaggctcatcacctatgttggcttcccattagagaacaaagaaacgatccaccagcaacaccacaagaaagtaatttttaaaacaaagcaaagcaaatagagcccaac

SEQ ID NO: 66081 - DNA, 1057 bp, Homo sapiens
gctttgcctccgcggcagtcatgactccagagccatctgcatgtgacctcatcctctggtgcctaggtgctggtccctagggtgtttgatgtgcctgtcatcctctttactgcagtgaggaagggaaactgtctacctctcaagatgctgcttgtaaagacgcagaggagtgtcccgagactgcagaggcgaagtgcgcggcgcccaggcctcccagcagcagtcccgagcagaggtaaccacccgcctcctcaaacccacccaggccctgccctgaccttgcctgttgcttcctgggagttgggaggggactatagggatcgtttacagctgtgctcaagtcttaggccgctgacctggcaggacagggttttctcagtccttaatgagctgagtccgactgagctgagaacttagaaacagcagttcctctccttagcgcagaaactgaaaaccagtttttagagactctttaacatcactcgctcttttagaagtggctccgaacagaggggtctcctcacccttgttgttgaggtactgagctgagggtggcattgagcccctccaggacttgagttctcattggccccactaaagtcatccagccgccaggcacgagcagatcgtggtgcctatttgcccacattcctgccctgtgtgacacaaggagaacttgctggagccctttcatacatgtagctaaataattcttagtgcttaagtgactccctgtaatcttaagtatgaaatgcccactcccagagctgtgtgacttagaatgtgatgttttgtttctagtcactttttgcttagcctgagccagtggtctgaagggatgggccagtctaagtctcagccacccggagcccatgccaggcccttagcaagactgagcatggcccaaagatgaggctgcacccctgggccacaggaagctttgttcagcacttcccacaatcaacttctgtgaacaaatgtagctaagattgtatattccttccataaggaataaaatgacctttaaagctatttcagagaagttttaaccccccac

SEQ ID NO: 66082 - DNA, 3560 bp, Homo sapiens
cctgtggggcgtggggagggttcttttcccattttacagaggagaaaacagaactgagaggggctaagaaatctacttataagatcactcagcttgtttaagtgaaggcaagttagttatataccagttatgtctagttccagaagtctcgattcctatgtctctcatacacggagccaccatcagatgtaagtaagtgagcagagtggattgtgtgtgcagagctgactttttggctcactgtataaccagcaggtataaggcatgagtagcattctagctgtaaattgtgaatgctagtggaaaagtgcttgtgggcatcccagttacggccctaagcaccctttcccaagtctgcttgatacaattttggtcaagccttcccgaataggttatatattcaggttgtaattttggcaggaaggcaaaacctggacactttgttatatactgtcccacctgttattccctcccagttttgagcctaacatttgctttgtgggacatgttcttcaagtggacacctttttttttttttccagtagtttatttgcaaacctcctttcctttccttttttcccccctttcctagtagcagaatcctgtttccaagtgaaatagtatgtggattccaatctgtgggtcacataaaagctttcttgaaggagcggtgaacacatagctcctgaaggctctggaagccacagtttataccccactgacctagtcactccctgtgcttcttggaggccgcggtggggcggttctcccagagcatttgctctgctgctgcccttgctgaatgcctgctcacccggtgatgaagcttagatgcactcactcagatttttctagagcttttgctccattcatttacatatcattttattaaaaacttactaagttcaaaacaatgttaaaataagttgtccctgcccttggggagctcagctaagtaggttttgtttttcatatttctgctgcaagtgcctccgatgcctgtctgttgctccttaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaatctcttgtaccttgcttggatttttaatgggttgatgtgtcctgccattaggtcccgtgttacactaggtcctgtgtgagaaagactgcactgcactgtgtgagagagtggcctctgggatcaggggctcatcctccccactgccatagcccaggtgcccagaagaggtggtgcctgacaccggctctcagtcttgggacggctccaagggttcctctggacctccagcttgttacttttatgtgcagcgtgtcccacctatgttgtttggctc

SEQ ID NO: 66083 - DNA, 1048 bp, Homo sapiens
taggagggagttgtaataatcccttcctaaaatgaggaaagtccccaatgatcacatggcacacttaagtgattactaacatgctttgatattgttagtaatattacagcgtggactgctttagcactggtatatctgaagatgaacgacgcttcatctattgttctttaatttgtacttcccattagcattcagattttggcggggaaagagctgttcagtggggagaggagcacaaaaaatagagatttaaataggtcagggggagaagaactccaggaagacatcttgggaagggtgaagagccttaggaccctgctccgcatgcacactggctccctgggcatgtgtggctgtgtttggtggtgctagttccatcacattggaaactcccacttcatgattaggcatctgtcaataatacctataacgatctggtgttgagattctcacaatgtgttgaaaaacaccagatgcttagctaattctctatataaggagtaaccagctgaatacattttcttttttaatctttatagagtaactcttagttcatgggacacaaagtctaaaaagccatgtaactgtaccaaatcccagtgtctgaaattgtaagtaatcacaaatccttcattattaaatatgaaataaggttacttagaagtcagtaagtggagcatagtctagagaaaccggaacggctagcactgcacgtgttacagttacttctcagcaaccttgtcctaatgctcgttgtcaaccaaaacagcgagaagcagccacttttgcatgaagctggtacgaatttttggtattatcttggccaactaatttagtcaagatactggtggctcacacttcaaggggcgtaatttttcttgggttttggtttgcatcctctagcccctcagacaagtgctaacgatgtcattgttgagcgttaactgtaatatttccacatcccatttttaaaaagttttatgaattggtttattctacattgaaattttctcagaaagttctcccccagccaggaggtgtggtcaag

SEQ ID NO: 66084 - DNA, 1047 bp, Homo sapiens
tttgtcattaaatttatttcataattgatagtctataaaaatgaaaaggagttccatgacaatacccctggccagctgagtgacagctatggacggcctccagcccgtggaggccagccctgcatctttgcacacttccagacatctttgcacacttccagacaggctgtgacacacctcagcactagaccttccgaatgtcagtggattccttgtggtaataaggccagacatggttataaagggatggtgatgtaaacctttagggaaaaaaagaatcatttttatctagggggctggctgactggaactttaaaaatccttgctaattcaaaatatccttgcctttgactttgaacagcttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacaccttcatgacttctgagaaatgtttttaccatcagcaatgccactaacggtgttgctgtctgtgtctggtttcactggggctgcaaaggctgctggaaagtctggcccataacctgcatctgtccctgtcctcctgtccgctgtcctatgttggtgtttctgaggcttgttgccatttatagctctttgtcttcattccatgttgattcaaactgtactggcctctcttttttgctgtcgtccgtggaaataatggtgtggcagccatgcagcatgaacggggggctgcagagtgccctccagctgcctccgcccgctgccttccatgctgagttggctcgagctctatggcaggtgctaatgcatgatctgtcttcacatctccaggtggacataggctgcacttatctgggacctcatcttgctatttcttgcctgtcttgtgtttataatcttgctatttcttgcctgtcttgtgtttataattgttgc

SEQ ID NO: 66085 - DNA, 1199 bp, Homo sapiens
cataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagcccaccgtggtgaggagagagtggctccacgaccccaagggatggccttctcctcccacccggtgaggggaaagactcaccagagggtgatggagacagtatgccggctcaccttggtgaccagccaagatgtctcaagtgacagtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagtttcactcttgttgcccaggctggagtgcagtggtgcaatctcggctcactgcagcatctgccttgcaggttcaagcgattctcctgtctcagcctcccaagtagctgggattacacgcccaacaccatgccctgctaatttttgtatttttagtagagacggggtttcatcatattggtcaggctggtctcgaactcctgacctcaggtgatccacctgcctcagcctcccaaagtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaaagcgtccaggcgcggtggctcatgcgtgtaat

SEQ ID NO: 66086 - DNA, 1022 bp, Homo sapiens
tgagtagctgggactataggggagtgccaccacacctggctgatttttgtattttttgtagaaatgtggtttcaccatgtttcccaggctggtcttgaactcctgggctcaagcgattccaaagtgctgggattacaggcatgagccaccatgctcaggatggtcattgtgttttccgtgggataaacgcattggcattaggggaaggcttagatcgacaacacacccgcacaaacacatcagctgtcatctctttaccctcagcatttctctggaatgtctaagttaagctttaagacgttggtcagatcttagagaactggcagaaaggaatttcaatgaaacattgggtcagattgcaaatgaaaaagcttgaaatgtggggatggccacgttttaataggtttttggtttttgtttttacatgaaaggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttgga

SEQ ID NO: 66087 - DNA, 1089 bp, Homo sapiens
aggtacagtagcattgagaagatcagtaagttggtacacagaaaaggtttggagcagagcctggcatgagggacgcactcttacgcacttactgtgacctgggctgccggaacttacctagggtggttcctgtagaggggagggagggtgtgtcagggagcgtggaacagggtgatctgggtctgctgcttcctggcggctttgcccacggggccagcctgcaatctggccgttcatttagtcagcatttattgaacaaaaaatacccaccgctccccatgctgtggtctggagaccaggagcaggtgagagtccttccagcaaacagtctcagatggggaacatcatcaacatggagttttccttcgagaaattctgaaaaactgcaaaggtttgattgtgtcatttcaaacatcacgctccatcgctgcaggtcgggctgcctttaatcgtatttcatcttcactgcagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtaccgtccttaccttctgagagacaggagtttgcccatgagcttggaagaaataccctgtgtgcctgacactcacccctaagtatctataatgctaagaaagaaggtggcataaaaatataaccttcagttttattttattttattttttgaaatggagtcttgctctgtcacccaggctggagtgcagtggcttgatctcggctcactgcaacctccacctcccaggttcaagcgattctcctccttcagcctcccaagtagctgggattacaggcgtgtgccaccacgcctggctaatttttgtatttttagtagagacaggatttcaccatgttggccaggctggttatgaactcctgatctcaagtgatccacccacctcagcctctcaaagtgctgagattacagatgtgagccactgcgcct

SEQ ID NO: 66088 - DNA, 1022 bp, Homo sapiens
aagcgattctcctgcctcagcctcccgagtagctgggactagaggtgcatgtcaccacacctggctaatttttgtatttttagtagaggcaagatttcaccatgttgaccaggctggtctcgaactcctgacctcaaacgatcctctcacctcacccaatgtgctgggattacaggcgtgagccaccactcccagcctcccactgcgcctggcctcgggtaatttgtttgaggtcataatctaatgagtgactaagctgagctcagaagtcaggcctctccgatccagagctttaactccaagctgtccttaatcatttaaaacgtcttgaggaataggttcctgaggctgcctggagagacgcagagcagggactcccatgccctttgcagagtcagggtacggtcgtctcagcacgtgctgaacttgggactcttggttttgtgtctccaacctgcggccggctcagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacaggtgcgcagcctaggtcccttgtcctgttttggggggtggtggaggcgctcttcctcactggggcccatccccaccagggcctgtgggaatcctggcacgggactccccacctcggctctgtttttctctggggtctcccggcttggcaggtctcaagagcaatggggacatggtggggggtccctggccacccctgtgtgtgtgtcaggcaaatgtgtgtggaaacactccagagtccaggacagggagaagtgaggattagaattaggctttttttttttgagacgaagtctcgctctgtcacccaggctggaatgcaatggcactgtctcagctcacagcaacctccgcctccca

SEQ ID NO: 66089 - DNA, 1038 bp, Homo sapiens
cctgtgttccttggccttttcttccaattgtggaaaatgcagacatttggaacagggtctcaaaatttagaaagctgcaggcacagctctatataaacaactattttaacctttcattgtgtctcatccagaaaacttcctgattgtctaattgctccccgactaatttttgctttcctttctctgtgttacgtgagggtatttggtgcaaatagttatctttaatagcgcagaagttttagaggacttatgttctcataaaacatttacaaagtcaaagtggagaaaatcaaattaccatttattttgtagcattgcagatgtaaccgaatatgtatgtatattgatgcatctctagaaatattgtgacagtgtgcaggatgtgctgtgattatttaaatttgcttatctttccctatgcaaattctctccacctttgtcgcttttcaggatctgctgtatatccttccaactcacattcaggcagcaagagccggcaacgccatccatgccatcctgctttacaggcgcaaactggaccgggaggaaatcaaaccagtaggcaaacaaattgctttaaaaaaattattttcaaacagctttacagaggtataattgacatattgcacatgtttaaaatatacagtttgtggccgggcacagggtctcacgcctgtaatcttggcactttgggaggccaaagcaggcggatcatctgaggttagcagttcaagaccagcctggccaacatagtgaaaccctgtctctactaaaaatagaaaaattagctgggcgtgctggcacgcgcctgtaatcccagctactcgggaggccgatgcaggagaatcacttgaacccaggaggtggaggttgcagcgagccaagataacaccattgcactctagcctgggttataagagccaaactccatctcaaaaaaaaaaattaaaaaataaagtgtagagtttgctaacttctgatgtgtatatattgatgcatctgagaaaccatcatcactgcagtcaggatggtgaatac

SEQ ID NO: 66090 - DNA, 1378 bp, Homo sapiens
gtggcccagaatctcctgcgcacctgccggggacgcacaggtcggcagggcatggctctcacggtggccaggtcctggcctcacagcatcccctctgccgttggtcctgaggtcctggaggaagctgtatctttttccagaagacacaaattagccctggttggtttcgaggccacccgagcagatcgggctgaagggacctctgggaagagagcaaacaggcccgccccgggcgcctgggtctgccagctactttcggcgtgattggttttggggtgaggaggagagtgcccgtgagtgttttaagagctcagttcctgcaagtgctctccctctgactttcccggctgtacctggggcaggctgctggaccctgcagcacgtggtgtctgtggcgtcaccggtggtgttggtggcaccgtgtggcctcacgcacagcctcccttgtctgggtctgtctccacagcaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatggtaattgcgtgtccctctggctgtggagggggtggacagtttgggctttgggaagaaggacacccctgcggaaggacacccctgcgaccttttctccctctatgcttggttggtgacttgggcctcaaccttgaatggctggagaggtttgagtcaccatgacacaaaagcaggggccaaagagtgcttctcttttgtgacattagtgagacctgcagcattttatattgaggtctgctcggtttgtagttcaggtcattcatcaaataaaagtgctgtccatccggttctttgtagtgttcttgactcacttgttgtcaggcattaaatggttaccttagctgacccctcagacaggctcccgtgactcagacttagcttctggaatgttcctccagcttgctttggccctcagcccaagggtcccttatttaaggtaatggctttgccatatatgtggatgcttgtccaaatttcatgatttaaatgtttttcttttttatttatatttatattttttcattttagttttttttgagatggagtttcactcttgttgcccagactggagtgcagtggtgtgatctcagctcactgcaaactctgcccttccaggttcaagcaattcttttgcctcagcctcccaagtttctgggattacaggcatgcaccaccatgcctggctagttttgtatttttagtagagacggggttttaccatgttggtcaggctggtcttg

SEQ ID NO: 66091 - DNA, 1009 bp, Homo sapiens
ggcctgggcccctagaagccgacgtcccgcttctgcgccgggccggtgttacagcggaccggtgttccccgccgggcccgtgcgttacgcacgcggttcgcgtcgtttccgtttccggccgaggctgcggccatggcagcatcttccctgacggtcaccttagggcggctggcgtccgcgtgcagccacagcatcctgagaccttcggggcccggagcaggtgagacctgggatatgggaggaagggaggacgcagagcgagcgctgctccctgcggtctcgccacgtatgtgcctgggtccgacctggtgccttgtgtgttgatcgcatttgtggtgaatatagcacgggttttggagtcgggggaacccaggttcagattttgattccttcagttagtagcctgaatactgacaatagcccttgaactttggtataggccctatgttatgggggagaagagtgaggctcagaggagctaggtaacgtgcccagggtcacacagcggggaagtggaagaagagtacttcaggcgcagtcatttcggctccaaagcctgtgcttgaaccactgcccccaggctgcgagctggtctgaaaaatggtgatggatatcctcgcctaatctgaactcattctgcaaaagaaacagccgtatttaaggcgctgggctgatacgaggctccaaaaaggttatgtccgttaaaaactctataaatctctgcttgaaaatggttggagtgtgtatttgtgtgcatgagtgtttatgtatgttttaaacctgggtttcatgtctcaccatgacccccaaaaatggaaaactggatctaactctatattggacgatattaaaagaatagtaccataattcccaaaacttggaagcaacccagatgtccttcaggagatgaatggttacataaactgtaggacatccatacagtagaatattatgcagcaataaaaagaaatgagtcatgaagagacatggaggaaacttacatacatgt

SEQ ID NO: 66092 - DNA, 1241 bp, Homo sapiens
acacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggag

SEQ ID NO: 66093 - DNA, 1017 bp, Homo sapiens
tgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccagggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtattcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccat

SEQ ID NO: 66094 - DNA, 1923 bp, Homo sapiens
gccatccacctgtgcctcttcaccatgttcactcccattgcccttgcctgggtcccagtgggtcctggctgggggagagacagccccgccaagtggcctctggttcagagcctgtgctgtgccctgtgaccctaagctgacagcgttgctgagtcttcctaaggctctgggacccttcctacagccagctactgtgggcccgcgccggggctgccccagctctttcacctgaagcagcatttgcagggctgtgagtgggacacagtgccccacagttcattcccaggtcctgggatggtgctgggagaggcgttggaggcagggcaggcagattcataacctgcatgcctgtctgtccagggaggacagatgagcgatggttgtgggcaagggcccctctgttgtcagggggctgtctcgggctggtacctggccctgcctctggctgagtggttgtgctattggcaccaggcatagcctccgtgtctgtcgtggtggttgctttgtgtgtggtggagggagttaggagcagggtggctgagggaagaggcctagctgcatccacaggatgcctggtcctggccagagagcctcctctccacgatgcccatggtgggcgttcacatggggcaccagctccttaggccacgtgccctgcagaaaagctcgttcagagcagctggtccacatacttcctcccagacctcgtgcccagtcttccactcttctctctccacgcccctgtcctccacttgggaacatcccctttctcagtccacacaggggactgcccaaccctgcccactgcagagctttcccttctgcagcatccgtgcagcgctttcttgatggaggctgaaatgtgcgtgtgtgtgtttccggctgggccggctatcattcagcacgtctgcaaaccaggcctgaggttttcctctgtggccagctgtccagtcataaagaactcctacaggcatggggtggcttgcagggaggactgggtgccctccagccttgtggccgagtgggttggataatatggaggctgccggtcactgttgggttttgctcgttcactcttgtctttgccagggctgtttggacgtggtttttcctcaaggccttgggtctgagggtcccaggggcttgactggcattgtggttggttgtccttggaggctagtcacctggatgtaccttcccgtccttatagaggcctcatggccccagctgtcaagggaaggccctcaggttgggctcttgtgtctggggaagctgtgctgtggtctgtgtctgactacaggtgagggtgcaagttcctgggcaggggaggggacccagcagcatcttcagcacctccttggcctgtagaggggctgaaagaagcctttgttatcaggccctaagaccagagtttccaaccagtgggcaatgaatgggttccgggtgagctgggcgcacagggcaggggccagagccctgagcagttctctgttcaccactgttctcttggccttctcagtcctgcgccaggccctggggtcccttttgagaatggtgattcacttggagtgagcgctggggatcagtcacttgcagatgttctggagggcctgccgtgctgctgctggctggaccttggtgaacagaataggcaggtctcttgtcctctgagacccccttctggagtgagagagagactgccagcgcacagaagtgccagacatagagtgtgattcccaagtgtggtggtgggtgccatgccggagaggagcccggcagccctggcagaggtggcgttctgcaggttgcgggggctgagccggccggctgggcagacactggcagcttgagggccgtggcctgtgaggtctgggaaggggctggactgactggctgggcctgttccgtggaccccggaggcca

SEQ ID NO: 66095 - DNA, 1053 bp, Homo sapiens
ggattagggcccattctaatggccttgttttaactaaattaccttttaaaaggccctgtctccaaatatagtcacattctgagctactgggggttagaggttaaagatacgaatttcgagggagacaaaattcaacccatagcaactgtcagctgcttcaggattccttgtcggcccctgtggctgcaggaccctgtcagaggtggttctctaaaaaacattgttttcctaaggtccttccagacctctgtagtcaggccctgccccagcctgagcttgagtgccacgcactcgtccccatcctcacttcgggcatcctctttagggctgcattcctcattgtggcacccccagccccttggggcatatgggcgatgagtgtggtgaggatcagtaggtggcagtttgaatattcacgccatcaaacctctgtttgggacaaggctgggcaatgcgttatcaacttaaggttgacttgaagatacgaaataaattttaccaggtgcagatttcacagaaactgtggagatggtcctcagataacagaaagttaagaagcaccattctagataaaggcgcttgtcctaggggcggagctgtttggggctcaggaagcagctcttagcggctgtcgtaggctaggtttgctgtgatccggcccatgtttaacccagacggacaccttggccaagagagatttcagcattatctattatgtctaaattgttacaaggagaaggtgttcgtatgttagctgtgtaactgagagataactgatatgactaaaggggcaggcagacacaggctgggagaagccagtcatcctaaaggttctggaaaggtggtttttgttcctcaggctttgctcctggtgtgttctgggccatctgggctctccctgggcagttgttgccgttccctagggcgtggttgagtcctggttgtccagagctgactctcccacccttttccagtgtcaggatttggtgagacctggaaaggggttcctcctcccgtgatgatgtggaggaagggcggatggattgctttggc

SEQ ID NO: 66096 - DNA, 1022 bp, Homo sapiens
gtgggcgatgggggcaggaaccaggggatggggctggcgcaggagaccggggcaggagacatgggctcacgcagttctgctggggcctgagctggagcaagtctcagtgtctggaacctccatgccctcccgtgtggacagagggtctgtgtagaaggagggctgcagccttcccgcaagggctggctgggaaggtgttggggggatgggggtcgctccggggctgcaggtggaagcggagcagtgagtagcccaggccccgccctctcgccaccctgcagaggcttttctgctcggtgttggctgtggggtgcactcccgtcatgccctgttgccctccctgcgcctccgtccaggaacccgcgcgtttccttgtctcctccctgtggggctcctgggctcctcccaacccgcctcccgtgtctctccccaggaggccggagatggtgggcctgctgtcgctgtgggacatgacccgcatgctgaacatgctcatcgtgttccgcttcctgcgtatcatccccagcatgaaggtgtgtgccggccccacccccactcgccccaccctcctgggtcatgctgctgcgttgctccagggtgggtgagcctggggcaggaagggcccgaggactgtgcccgtcaccctgggctccctggctgcaccctcagctctctgccgtgctcttgtgatgctggggaagggtcattagaagcaggagagcccagccctgcatttctgggttgggagaggaaggcgggcaagggtgtggcgggtgcaatgctttggccagtggcaggagctccttggggctggagccctggacaccagtgctcccccaggtctctgaggttcccagaaaggcctttgccatggctcccagggtgctattaatgaggggcagtggtatccctggccagggagcttgtttccaggatcctctaatgcgggcgcaggtggctcatgaccatctctgagggctggtttctcttaatgcaccggttaggagcaatgggcaccttaa

SEQ ID NO: 66097 - DNA, 1047 bp, Homo sapiens
ggaatgttgacaatgcagattcccaggctctgccccagagtttctgattgagatggccaggcttgaggaagtacacgtgtgaaaagtttcaggtgctgctgctggcaggggccacatgtgggggtcgactggcctaggagcgccagcttccctccctccttcccttcttttctttcggcaaattgtaaggagcacccagagctgctaggggccagtttgaaactagcagtgctttgggaggagcagctacagaaaggccctttctctgggtggttggaatgaacccagcctctctgggtaggggcatcagggaaaagtgctggctgctcagtgctgccgtgcccccggccacactggcggacacgtggcttggccggtaggagccaggcaggacattggcccatctgccttggctatgggatgtgtgcagggtgcacgactggatgtggagagcctggccggaccctgccacactcaggggcacgggtatcagcaagagcccctgagcatgaagagagcagagatggggtcccggcctctgtggggtctggaagttcccggctgatgcctcccatcccccagctccatgctcctgggcttttgagcccctccactcaccctgtgaggccttgtgatgtggagaaatttgtagatatgcatgccatcgaatgccagaaagaacagaaggtagcttacatctggtgctgtagcatgcagtcagtgtttatctgaggttactgtgagccaggcatggggcgctcacgttctcacctggacgtaccagggggatgacagcagagaaaaggctgggaccaggaggaggaggaagaggctggatatgaagcccgaagacccactgttactccaggccagcttggagcttcctgagggcctttgggaaaagggaaaaggtttctacctgaagaggcacgggtcttgttggtgagccctgcccttcctggcggagacatccctgggtgggctaggcctggagaaggctaccacccagcgttggtgaccccagcaccatgttgggaaacatcggga

SEQ ID NO: 66098 - DNA, 1051 bp, Homo sapiens
gaggggatggggtcggcccagccccctccccaggagggctttcctgatctcccccatcagaacaaccccctctcagctcctaccacctgttctgtctgtcccaacatcgacctctccctcctgtctcacagctggctgtgggcctgtgagtgctcctggatggaatgtcccagatgccgtcggtcccaataaatgagcccgtagcatggcacccgatccacccaaaacagactctccaatacatatggaaagcggggtggtgggggagctttccagcattgttccagtgattcccaaacattcgtgtccatcgggattcctggagggctcgtggaacaggctgccagccccgcaccagggttccaatttgtcaggcctgggagggacctgggaattccgctcctgaccagctccctggtgttgctgatgctgccggccgggggtcacacaatgagaaccacatcccagcattagcatcactgtagtgggctgagcggggatcccccaaagtatgaccaggtcctaacccctggcacctcaaatgcgaccttatttgggtaatagggtctttgcaggtgtaattaggttaaacaccttgaggtgaggccatgcgggatttagggttgccctgaatagaatggctggtgccttataagaatagagaaggcagagaccacagaaaagaccacgtgaagacagagggcagagactggagtgatgcggccacaatccagggaaggctgggagccctccggggctggaagaggcaggaaggaccctcctctagagccctcggtgggagcacagccctgccaatgccctgatttctgacccccggaactgtgggagaagaaacctctgctgttctgagctccgggttggtggtgatttgttgtggcagacaggagaacagtgcagcccccgaattgtgctcattagcagccacttcccggtgccaagctctgcaagacctcacatcgcgacctccaggcagccaaggccacatggggcaagtgcaacgatttcatgcttctgcgccctgctgtttctc

SEQ ID NO: 66099 - DNA, 1033 bp, Homo sapiens
ctaggctcctgatgatctcttgggagctgcccttggtgatgccgagctgcctacaggggtccttctggggcctgaggccaggtggtcactgggcccctgcccctcggcccctttgtgaacccagcaaaacctgcacctttggcgcatgacctccagctccttgggaacctatggctgctcttccagaagtccctctacctggcaatgggccctccaccgagaactcctggtgctgagatggacggatcatgatttccttctgtctgcaccaggctttgcttaggagagaaaatgccagaaacaaaaaggcttttctcactctcagccttaacataggatttattatgaataaatgaaactcccttgcagggcagttgctctgcgaccagcgtggcctaggaaggctcagctccaagtgatcagctctgtcctacagagactgaagcttggagcagctggtgacaggaccacgggcacgtagcctggattgggagaagttgggagtggcgatcactagtgtttgcggagcacttgctaggaggcctgagccaaggatgttatcttattgatgtacgttatcttatttaatcagagcctgccaaacatcccagtctgccccaaagtcccgggcgacacctgtcgccctggcgtcatcattaataacccccggaaggtgaaaactctcagagtgcccttgtggagctgagaaggagcacggtttcactgtgcttagtcctctgtcgagccctctggaatatccctatgatgtggatgaacaagctgtgggtcagggggatggagggacttgcccagggtcaccagctcggaggcagggttggattccaggatttataatctcagaggtgggatttaaagccacgaccctctaatccttcccaagcaacagaaggcacggagtgtgttcgcggtgtcagggagggtggtgggaaggcaggggcggaggtcccttcggaggcctgaccttcccaggacccctcaccagcggtcagcagccggggtcccgggaagaatt

SEQ ID NO: 66100 - DNA, 1032 bp, Homo sapiens
cgggctgcagcccacggtagcccagggtcacatagtggggcccagctagagtttgaacccagaactttgtgaccttgcaccctgcaagcattccgcttgaccattagggtggtcagcacctgtccctgccgccgaatgccagctctgtgaggttgaggccccacccaccactgcacccaacactgagcatggtggtgagtgcgcgccaggtgcccaagagtcctttgctgagtgggcgacgggtggggtcctcctacttccccctgccctccctcctggcccttgcaggggctaagtacctttgtacccctgggtgcccccgccacgaccctccccgctggcccacttcccccttccctgttctagccttcaaggtctgcagtctctggtctcacttctctcctcccctggttccagtagacagcggccagaggaggcgctcctggggttggattcactgttggttttaggaactgagaaaggcccccaatccccgagaaaatccagggcagaatgtggctgaggagctggagggaggagaggagaccaggcgccctcccagggcctccacctcaggcctgtagatatgaggtcccccaaggccttgctgtgtgacctgggcaagttactccatctctctgggcccggatagggatcaatggatcctatcttgtcggaatgcgggggcattgagggcagctggagaatgtaagcttagctcccagactggtgctcgggagggccggcgagggttctgctacgtttattaccacctttactggcgagttcaaaaggagcaaatcagcaaaggccccaaaacactggggcccaacagacacgcagtttccccttgaacaatgcacgtgttagggttgcgaccccctcccccatgcagtgaaaacctgcatgtaactttcgactcctccaaaactgaactacgaatagtcgactgttgaccagaagcctcactgataacatcaacagttgatggacagatattttgtatgttacatgtattacatgctgtgttct

SEQ ID NO: 66101 - DNA, 1128 bp, Homo sapiens
caccatgaatagcatagaaaaagagaggaaatattcttccggtattcaagaatcatggccaggcatggtggctcacacctgtaatcccagcactttgggaagccgaggcgggtggatcacctgatgtcaggagtttgagaccaccctgaccatggtgaaaccctgtctctactgaaaatacaaaaagtggccaggcatggtggtgcatgcctgtaaccccagctactcggaaggctgaggtaggagaatcattttaacccaggatgcagaggttgcagtgagccaaggtcacaccattcctctcaagcctgggcgacagtgtgagaccctgtctaaaaaaaaaaaaaaaaaaaaaaaaaaatcattacccagttcagcaaagaagtatctcccattcttgacaaatgaggtaaagttctgatattatgcctttgttattttatgtaggtgttatttgtggaatgaaaatgtcaaccaacagaaccacacttgttcataagttgatccatacgttggctacagatacagaattcagcaaaatcaacacaaacattcactgagaatcaattggcagtgtggaatttacaatagagagcattgtgtattttattattgtttataaattgggtctgggctttggggagggctccctggcagaactggttgaaaatcataatggatagccagggagaattcttaactcatgcctcaaaaaactagccagtcttaagtgcacagatcaatgaattctcaccagctaaatcacagaccaagcagcaaaacattgccactgctcagacacacccatctgcttgcttccagtccctctctctcccacagtggaagtgccttcctgactggaccccatgggaaatgtcacctgtttttgatatatagcatacattcttttgtgtcaggcttcctttgctcaatattatgtaggtaggatccattacattgctgcaggtagctgttaatcattcattctcatggctgcctggtattcaactattcaaatatttcacagcttattcactcattctattgttggtggacatttgtgttgtttccagtttgggattactatacgtcagtgttgctatgaacaatctcatgtgtctctttacg

SEQ ID NO: 66102 - DNA, 1072 bp, Homo sapiens
tcaacgcggaagaaaaaactccagcatcttggatgatggtcgctgattctgacactcagatatgttgtcggttaaacagatagctttggctcagtgatatcggacaattgacctcttggtgcacagactcccagcagcctcgctcccaaagggggtcttaggggaagccaggtccacagatcaggagcccctaggggacctgagatgggtctagggtttcagtttcatctgtgatcttttcggtgaggtgtgttcagtcagcgacttcctaggaggaagccttcagctgcatggaaagaaatttaagttcctattctctgtccccagagtcatttaaatggggccagtgtcggagaccggagcgtgatcctgcgctgtgcccgtgtgcgataccatctcagttgccactgagctcggcctgctggggaggaggaaggtggcctgccccagggagtcaagaaattcaatccaagtccatttttaactcgatgaacattgattgacaatttagtaggtcttacgtggaatgcaaggaggaatacattaaaagacagagtctctgctgaaggtaggaatgtacataactagcataatgcaagtggggatgtggtatgtatattaagaggggcacgagaatgtgctgcagaaatgattctatcttggagaagtggggaggcactgcaggtggatgacagctggatcctgaagggcaaatgcagtgtcagtgaatgtagtagtgtcttgatctgctggggctgccatgatgagctattgcagatggggaggcttaaacaacagaaattgatcctctcaccatcctggggctggaagtcccagattaaggtgtcacagggctggttgctcctgagtcttctctctatggtttatagttgactgctttctccctgtgtcctccagggtggtctttctgtgcgtgtctgtgtcctcctctcctcttacagggacatcgatcagatgggattaaggcccacccatgtgatctcactggacttaaattacctcttcgaagtccctgttcccaaaaacagtgtcacatcctgagatatggggg

SEQ ID NO: 66103 - DNA, 1041 bp, Homo sapiens
ccggcgctggaatttggggcccggcggggagcgccagctgcccagcccccacctgggggaaccctgcttggcggcccccgggtcccccgagggggccaatacctctgggcttttgagggtcattgcttcaagaagcgcagagaaagcattttgattttattttttccaaagagaaaagcaactttaaaaaacttttcggttgcagttttactttacactgtcttcttaaaacccaccacgaagcaggaactgcggattctgggctcatttaaagtgctctgttcttatttcttggtgaccatttggagacaaagggcaagtggcccagtcgggagggtaaccacgttgtttgaaagaaaatccaaaattaactgaaatcaccttcacgctttcctcgccccctggcccccgccccggtgaccgcggcctgggcggatggtcggtcaggagaaagcgaattccgctgcaggcgcgtgttcgccaccgtccctggctgtgggaaccttcattcaggcgggggaagggagcgcgttcattcaggaaccggcgcgccgcgacgcagaccccgggactcagcgcggctgcgcgccgcggggctcggggcttgggttgggggcgggtggtgcagggaccagtcccgacctttcgccagcgacctcccgcacccgcttttccaccagggcggctggcgggcgggcgcacccaggtggggtcacctgcagccgcatacctggcggcgacttgaaaggacttggctcaggctccgcgagttttccattgttaagcccttaagtcgcccgggaaaacgcttccgaaagccggcccctgggctccgaaggcgctcgagctccccttccccccacactgcttgcttttggggtgcgcgtggcggcccacgtgctatggcagctctgcttcgcttacgtagcgccgatcccaggcgccccaaaactgcgaggtgggccggggcgaactccggccccagtgcccacccgagacagccacacgctcggcacatggacagccgcaccgcccccccca

SEQ ID NO: 66104 - DNA, 1075 bp, Homo sapiens
gttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtgcggggcttcgggcggctctcttaagacttccctgcaacttgttgcccagacccacgtttctttgctactcacccccctcccttctctcccgctagaactttgaagtttgccgtggtgtttctagggatccgtattttcaaaataaaaattgcgggtattttctgaaggaggaaggggtgggggtgggggtgctagaagtagcgtttcgtgggaggggagaagggggtccgggaggggtgccttcgggagaagccagtgccaggggcaccccaatgggcccgagggtgcgggctggcaggctgggtgcgctttgtgtcccccgcctgcgccccagcccggctgcgcctcagcggccgggagccgccaactccggggggagggggcatagatttgatttttaaattaatatccatggacacgtatgcaagggccgctcgtgccagtattatgcgccatctttgctcttttattgcaaagcaaaagtgtttattaataattgggggcagggtgggggcggggagcggccgccgggcgctggggccgcagctaagggccgcgcggctgccgggagcccgcgggaggggcgcagggacgcggcatgggtagttttggggggacgccgctagggaagggggggcctttgttcaagcagcgagtcccggggcgccccgaacgggcagcctgggccggagag

SEQ ID NO: 66105 - DNA, 1019 bp, Homo sapiens
cccgcctctgacatatctgctcctccgagggagggcggccccgccgccgggcgtccctgtccggggagcgggcgggatcctagccgccctcgtcccgccgccctgtgtgcgcttgcctgcgactcccaccgcgttcgcgccccgcggtgtggccgaaaagtgggcggcgcgcgccctccagcggctgcacgaggagcgccgcgctcggcgctgagcctccagttccaggtggtgggaggtctttttgtttccacttgcagagtcttttcacgcggcgggcgccttttctgttttgatctgggattgcgtgttgccccagctcccttgagtccccagcattcgccagccctcccctccaacatccaggaccgcacgagacgcaggggccagtgctctgagccggaggtgcggcgtggcccggcccccgtgctgccggcttccccgcgcccccgggctggcccgcacctcccctgatggccgctcaccctgtgttcgcagcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacaggtagggcaggcccggcagcccccggcctccccttgagagccggctccttaggtgaccctggccggcttcttgctctccacctgggtgctgtctgggaagatgtccccagaccccctcctgcgctggagagcgctcttccagctctggtgagcagaggccctggattgtttgtcgcgctggatggagggagatttgctccctcacggccaccatgcagtaccttgggcattggtgtggacggctcagcctgcctgtgtcccgttactctggcctcgtccttcaggccaggcagcctgtggccactccatgctgaaaggggtttaccttggccacagggccgcctcctttctccacccacctc

SEQ ID NO: 66106 - DNA, 1586 bp, Homo sapiens
ttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagg

SEQ ID NO: 66107 - DNA, 1098 bp, Homo sapiens
ttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccagcgtggtgcctgcctctttgcttcctgggctggccgtgagccagg

SEQ ID NO: 66108 - DNA, 1049 bp, Homo sapiens
aataaagctttattggcacacagccatgctcactcattcacagagcggctgcagctgcttttgcacagggcaagagaacctgtggcccacaaagcctgaagcctctctctgtggccctttccagaaaacctgccaatccctgacctagcagatgggatgattgtgtgcgggagagtgtaggctctgggagggcagggctgtgtctgtggctgccaccagagtgtcccctccctgtcaccaacccatggggtcgttgcaaaactcagagagaaactgtgttcggtgttgagcacaaggcacacagtgcgtgctcagtaacctccagctgcgattcctcccgtgattaaacaaaggcaaggaggactgcctcgacaggctcagagggcccagggtctggaataggagctgatcctcgggttagaccactcagctcttaaagtggctgccggttgagaggcttgtctcagctgccgctaggtgcaaattaaaaggattaatggacaccgccgtctttgaaaggctcaaggcccaccgaagccccttcagcagagggctctgcattctctcttccccagccctccttgtgtgccctcgtgagtggcggtgacaatgctcccggatgtgggccccaaggccagcggccccagagctgcccgcccacccgtccgcctgctattgtctgctcaggcctggcggtgtggcgctgggcttgtggggccctggcgggcaggggactgtgggaacggattagaggtcctgggcttgctttcctcgtcttgcataaactcttgatcaaagacattcctgggatgacagagccctgtgagctgcgaggctggcccagagtgcgggacgcacaccccacgctgcagcccctgcacaggcctgcccttgctggccctcgctggccctggctgcagtgctgactttggggactagccttatggtgggactggtgatagagcgggtgccagcaggcaacacagccttccccaccagattcagaggccaggcccccaatgctgggcagagcgaggctgtgactgctt

SEQ ID NO: 66109 - DNA, 1113 bp, Homo sapiens
agctaggcacacacttgctgtcgaggcactgggtatgggcctaagctcgttgctaggtaaataaatatgatttcgtgtaatgagaaaataatcatccagcttttgaacgaaggcattcttagcgcacctgctgggtttcaggaagccagcagcatagctgttgtgtaagttgagcctgttgtgtgcacatgactgagagtctgtatttctgtgctttacagcagaaagatgaaggtcttagaatcattgattggaatgatccagaaattcccttatgatgaccctacttacgataaactccatgaagacttagacaagatcagaggaaaatttaaacaggtgcgtgcactgtgtgtttcctcctgctaggagcacctgattgcgcctttcccaggcggggcagcgcactcccggggccgctgcggcaatggcctggggctgcgtgcgccgcggaactgtccgtagaggcgcctcatccttgagtcgcagtgcaggaaaactgaagacagtccagagaaaaggagttagaactcatttatgggctggccacatagacaggaaaagctatagctagagatagagttatcttctcatttttcagtaaaaatgcacaagattaaaaataccatctcttttgtgttttcagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgacttgacagcctctccggcagcacaggcctagctggttctgggttggagttggctctggatagggtcagtcaccaggcctggactgaaggcagttatttttattattattattatttgcaatgagagagatggttggccccgaatga

SEQ ID NO: 66110 - DNA, 1050 bp, Homo sapiens
aaagctggaggatcgcttgagcccaggagtttgaggctatagtgagctgtgatcataccactgcactccaggcagggcaacagagaccctgtctcaaaaaaaaaaaaaaaaaaaaggaagaaagaaaagtagattccagggccttgctccagacgtactgaatctctgggggtgaggcttttgagttaatatctttgaattttccttgtgtgtttctagtaccctatcaggtttgggaatccctaatttagccctttgttgtagatgaagaaactgggctacaagaggtacagtgacttccagaggcaaataggaagtggtagatctgggactggaatctgtgtcttctgacttgaattttaggcttttcctcctttactctggtttgtcttactgggtccgggtaatacaagagagagaagtttttctggagaaagtattctttctcctgttgatttgatgaagcatgcttcttcttcacaggtttcatggggaagggtatcgggaaggctatgaagaaggcagtagtttgggtgtgatggagggaaggcagcatggcacgctgcatggagccaaaatcgggtctgaggtaagtgggaacccccatctggagatgaagcctcttcatttacaatttataatttatttcgatattcagtgtgatggagtaagaattgtcaggccttttaaaatcacagtgccggatgggcgcggtgactcacacctgtaatcccagcactttgggagtctgaggtgggtggatcgccttgaggtcaggagttggagaccagcctgaccaacatggtgaaaccctgtctctactaaaaatactgaattagctgggcatggtggtgcatgcctgtaatcccagccacttgggaggctgaggtatgagactcgcttgaacctgggaggcagaggttgtggtaagccgggaccgtgccattgcactgcagcctgggcgacaggatgaaactccatctccaaaaaataaacaaaaaaaatcacagtgcctttgcatgggagttaatggactagatggactgttgc

SEQ ID NO: 66111 - DNA, 1085 bp, Homo sapiens
cattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgtatcaaaaggtgcattctattatccgcctagaatgttagggagggtggggaaggggctggtggggggcagcaccgtccacgggaggaaaccctcggtgtgtctgccctggacaccaaaagctcgggtgggaagttagcgggtttgggccagccagctctagtggtggaggctggtttgggccctgctgtcctgccctttcctcatgcctaggggcttggcttcctcagtccaccttctctctagcagtctcagtggttagggcggcctctctgccaggagtgtttttggctgcagga

SEQ ID NO: 66112 - DNA, 5193 bp, Homo sapiens
gcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagggtgggggccggggtccctccaggtggcactcgcggcgctagtccccagcctcctcccttcccccggccctgattggcaggcggcctgcgaccagccgcgaacgccacagcgccccgggcgcccaggagaacgcgaacggccccccgcgggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcctgcccgaggtcggccgtgcgctcccgcgggacgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctgagaccctcggcgggcacctgctcgggggccccgggaaccggggcggactcgggctccggtcccttctgacgcggggctggggacgcagacactcttggctccggcagcccagcgcaacccctgaggtcgggcgccgcctcccgccttcagaaactcgggctccgagcgccgaattccagcgccttcgcccgtgggcacagggcgcgcggtgcagccacagggggcccgagacacgcgccccggcctggcccaggctggggaaccgctggggtcgggctcgcgtctgaaggtccgggactgggtgcggccgccgggggtcccctacacaggcaagctaatctgagctagcgcaggcttgggctccggaggccctagagggcagcttgggctctggaggcccttgggggcggctgcgccgggaaccctggccctttatccccaaccccaccccagaaatagggtccccggaggcgaacaagccgaggggcggagtgggccagggatcacctgccccgcaatgacctgcgccccgcccccaggcctgctggagctctcgcccgtggagcggggcgtggtgagcatcttcggcgtggccagccggttcttcgtggccatgagcagcaagggcaagctctatggctcggtgagtaccgcaggggtctggctaggcacctagttgggaacagcggacatggctagcaggctcgtggcttctccagccccacctgtgcctgggtcttggaggggtggcagggtcaccaggtcacgggaccggcaggcctccccagacaaaggaagcagccccaaggcaggaacaatgaggttcctgccatccctgagtgggcccctcccagaccgaggaaagggcgctattgagagcccttcccttctctagtccagaggggtaggtctcagtgttggaactgcgggcttgaggctggacacggagggaatgaattctctggctgctaggtgcagggcaggtggtgagagcaccagctgttgtgggctggccatgtccccttctcaccctgtgtgggtcttgacaccttaactgctcagcagagacatctcagcccagggtggggggtgggacagaagggggttctgacccctggcttcaggctgggtaccttgcccaagaggtgccccagccctgacactgccctgctttgctgcagcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgtcaaaagttgtcacgagtgtgctgctattctgtgttttaaaaaaaggtgacattggattccgatgtcatcccctgtagtatggcgtggagcatctctgtctggaaaggcccgcctgaggcttgggcagccagttcagggagctcccaggcttggctctcggctagcatcctcagaggcccactccctttgtgccctgttgctattaatcgggacatatcggtttacttcgggtacagaaagtgcggtgttgaagtcctcgctgccactctgtttttagatctgccaagactgacctttgaactttcctgtagtcaatcttcctcgatctaccagatgggagagacccttggacaactttataaactcctgtttgccttttttggatcagcgacagcccccatcgctgtgactattggggaaaagacgaagctctttcataaattccatggagaggaatcaatatcccactggaaggctagaaatggacaagatagtgtatttgcaatcacaaacaaaaccctagtgatgaaaaataatttgtgatggcagatgcttctgatggtgtgatagaatatgtttttgaaaacaaaccatcgaaccccccgccccacccccaaaacgggcttccctgtgtttagggagctttgggctagaactagctacgatttttaggtgaaatgtccttgtaattgtacaaagcacttggtgcagtgtttgcgtggagcagcctgctgctttctgatgcattccctgtttaagtgcgtttaacatctacctcacaagccctgaaaccccaggcaaaacccacagaaagctcatacccggtgcaggagtttgccatcccaagtggctttttttccatatgtagccaaaaaggattgcagatagcgtcggtgcgtcccattcgaaccttgtcacgtttgagctatctttaccctgtgatttacttttagtaagggtgatcatggtgaaaatatttgcagacagctgttacagtacactatatggtcaccaagtaaccttatatttttctttatatattttacaaatgtaacccctgtcattgaagcaaccgtggaagaggcagggtcggtgatgtttaaaaaaagttccgaggtgatggcaaacatttaattttaatgaatgactttttagagtttatacaaaatgaccttagcttgctaccagaaatgctccgaatgtttcgtcaagactttaatactctcctaggatgtttctgaactgtctcccgaattaactttatgggagtctacagacagcaagactggaaaatctgattggagtttttgtctttcacattccttttgaaaactctttgttcgaatgcaaatcatcgacttaaaatactattcttaaccaaggcctggaagaaagaagacacttgcaaagccgctaagacaggaccacacatcttaaactgctgttcctaccatgcactaaactgtttttaagttttaaaccacaccctaggctccaggagtgttcaggaaagatggtgtttgtaggtctccatgctgtttggcgttggggggtgtggagggatcatccgtcgactttctgaattttaatgtattcacttagtaacaaaccatgattgtcttaaatgccttaaattattatgagatttcttgtctcagagcccaatcagattgtcaggaattaacatgtgttaggtttgatcacccttgaccacttcttatagatatttcttcaacaaatcatgtgtgatgcctgtaggaacacaactgtacctttaaaatattgttttcatattgctgtgatggggattcgaggttcctgtatgtgccactgttttcagaatctgtagttttatacaggtgccgaccctcgttgtgatgtatgtgctgtgcacattgacatgctgaccgacaatgataagcgtttatcgtgtataaaaagacaccactggactggatgtacacaactgggaaaggaattaaaagctattaaaattgtgccttgaaatgccaagacctggttccctccccctgtcttccaggggtctttctatttgaggcctgagcctcacatggctgggggttggggtgggggcaggagagacgaattttagccagctgtgtccacacaaatgtagccttgaaaacaggagcctggggggtgtgagtgtcacaaagttttgccatgacagagtcttgcagtttattctcattctcctgatggggctaattcacgccattcccgcactgtaactggccctaaactctgtgcccctcccattggcctcctgttctctaaagcaatttgcacttccctagggggagccgtgaagctccagagctggtcattaggaggcagactcgagaatatttttcaaaatctgagtagacaccatccatgggtattgaactcaatataatgaactgcagctagtcttttatttttaattaactaatttttttatattttttgagatggagtctcactcttg

SEQ ID NO: 66113 - DNA, 1053 bp, Homo sapiens
gaggtcggagccatgtcccaaagagagacccaggggtgggtcaagaaggcatgggcactcagatccacagggcggccttcaaagtgggtttacaggaggggcccagagacctcaggacagcactgcagggcaggaaagggcaggaaaagagaagggccctgaggcagggccttccttctctctctccctccttctctctctccctcttgatctccctttctctctgtcctcctcctcacctcttattcacctctacctctctatctctctctctcacttctctctgtctctctccctctgtctctctgtcctttctcttttcctctctctgtctctctctcccttctgtctcctctccctctctatcattccctttctctcttctctctctcctttcttccccctctctctctcttcccacctccctctttttcactctaccccctctcactttctctctctccccctctctctctccttctccctccctctctgtctccatctctttccctctccctccccttctctctccctccctttgacagccatggggtcagctttcagggttcccattaaagggactaaagaagatatggccaacatgttttcttgcaactaagacccattagcctttttgaagtccagcctcaaagcctgctggacattatttatgtccatggggtcattgcggagaacgccacacactaaactcttggctgtgtgtgctggggggcggctgaggcccacactgccctgatgttgaacctgacccaggctttggtagatcctgagaaggccgtggacattggaaccctataaaagtctgtttgctttcatgtcgctgcccagggctcaagtctgtaccccactggctcgccgctggttctccacatgcatccccgtagtgggtggggctgtccccgcagcagcatctgttcgccatcttcatggatgctgcttttgaaaagcaagtgagggcggactccatgggagaagggctgctttcagacaaagcccacggctggatgcataggtggtggagacgcaacctcg

SEQ ID NO: 66114 - DNA, 1052 bp, Homo sapiens
gccagcgacctgctgtatggggaggtttcaagggcagagttcaggcccctagaccagggcagtggctccgggttcctgccctgaagccctgagtctggaggagcccactcctccattctgtcaggctttcctccagaggacccagccggtctggttgttctgtcccaccctgtgtaggctccggctgggtgccaggaagacagccctgcctggcacagcccatgatcccaagaaggcagcctagagctacatccatgctcctgattgacctttaagcaggtaatccctgctgagaggctgaggcaccgaagccaaaatgtttccggccctccctgcttgttttgagttagccctttaagtcttaaaagggaaaggggagaaatgaacgtatctgagcacctactgtgtgcagagccctctgtttagaaggaactgtacctcatataacctgtgcagacacagagactcagaaaggcttagtaatttgcctgaggtcacacagcccctttggaggagctggggccaaaagccgtccctagtgacactctgcaactccagtgcctcgctgtgtccccacctcatcccgtcatggaggccaaatgcatccctcttcttggcagccactactgcatttgtcttagggattgactgtcaacagtttaaattgactggcgcaaaactccctcatcagctggatctatttattgtcagagagccagcctcacaagaagcatctccaagatccatgcagacaatctcctctttcaaaatcttcatcgtgccttatgcagccatgtggggtctgttcccaccttaaagatggagaaacaggctggaggagctcagaccacttgcccaggggcgcacagcccagaaggagtggagctcggaagccctaggctgtgggtggcaggtatccttagggaatatggaagtttacagccacagattttccatatgactgaagggcgcccgtgctgctaagtaccaaagctgatgtttaagcatttggggagatgactggttctggcctgagccgcgtgcacccatgt

SEQ ID NO: 66115 - DNA, 1052 bp, Homo sapiens
atcaatgcaacctgtccacagcacacagctctgcagggcagagcgggggcagagcccagagccctgtccatggagggagctctctgggtggtctcttcccttgccgtttcaattagaaagattcaaatagaaaaaaaaaagcagtcaccatcttgttcagaagtcaatttcaaatgtcccttctgtgatgtccctgtggctggggaaagttggcggtgaggcccagtcccctttgttcaaccccttgggatcccattccctgatctcctgaccctgatggcttgggatcttgattttgggggtgataaccgaagtcactgggcacacacagtgccaaggagcccgaatgaatttcccaaagtgagccactcgcacccccagcggctggtcagggactcctttgggagtaataacctcaggcgacaggggccgcccctccacatagcctgaaccccagactttggtaatgaagcagaaggacacttgtctcctatcatgtgacccatgtgtgccttagctgaatctgagatgtttcagtccagcactgaaatttggaaatttggggaatttccaaaaccatgggaaaggccacagctacaaaggccacagtccacagtcaccctcaagcagcagtaaaccttaaaggaacccagggtcacccacccatcccggctcacctgtatccatttaccttcatcctaattcttaagaaagttgtctttaggaccgggcgcggtggctcacgcctgtaaccccagcactttgggaggccgaggagggcggatcacgaggtcaggagatcaagaccatcctggctaacagggtgaaaccctgtctctactaaaaatacaaaaaattagccgggcgtggtggcgggcgcctgtatcccagctactcaggaggctgaggcaggagaatcacttgaacccgggaggcagagcttgcagtgagctgagaccgcgccattgcactccagcctgctcaatagagcaagactccatctcaaaaaaaaaaaaaaaaaaaaaaagttgtccttagtggacaggtcctat

SEQ ID NO: 66116 - DNA, 1316 bp, Homo sapiens
cctcaggtgatctgcccgcctcagcctcccacagtgctgggattacaggcatgagccatcatgcctgaccgactgaccgagtgcttttttttttttttaaagcaaatattgcctttgggcttctctctaatttcattttaaagtttcagttgcattttcaaatggagattttattttaaactggagtgcagtgatttttacagtctttttgaaagcaacaaatgagatttttagaagacctcttgcttgaagaactcttttgtgtgaaacctagaagagagactgttcacctttcattgcaggtgaggtcccaaattttgccagtctctctcccaatctgccaatccctgaagcagggggtacaaaactcagaagattctaaggaatgaggtcttcaaatcaaatccaaacttagtgaaaaagaagtctacctgtgtcaggggtgttccctgtcaaagtgatgggtgagcttcagctggttgcagtggaaggtgtgctggatggattgaggaggcgagagggtgcaagacagcccatttaggaggcagttcctgcaatgtgggcatgaagtgttacagcccaaactaggatgctagaatccgagggcagagggcagtagaaaagaacaacctggcggaattgtgtaggactagaggatgacagccgagtggcagataccagggtcaagcttgcggggagaagggggacgggggtgggggagagtaaagaggagacgctggtgtttggtggtgttgagaggtatttgtggttgtcacagctagggcagggatgctcctaaacattctgcagtggagccccctcaacaaagaattatctggccccaaatgttggaagtgtccaggtttaggtataaagaatcagaagcttttctcaagtattgctgttaggttggtgcaaaagtacttgcggattttgctttacttttaatggcaaaaaccgcaattatttttgcttcaacctaatatgatgcaaaattggctacaactgtaatttgttgagtgctgcaaacaaggtacttgctaagcttaactttagtgaacaaattaggaagaattggaataaggtaaaactagctaaatgactcttccctgagaataaatactaatgactgccccttcagatggtgccccctcatctgctttactgactgtttcttagtagtagttggcaaaacacctcttaaaataccatacttgttttcatcgtctttggtgtatgaaatagttgaatatatcctttcagaataatatttggccatttacatctctcttttgcacacactgaatttgccatct

SEQ ID NO: 66117 - DNA, 1063 bp, Homo sapiens
cgatctcggctcacggcaacctccgcctcccatgttcaagcgattctcctgcctcagcctcccgagtagctgggactacaggtgcgtgccaccacacctggctaattttttgtatttttagtagagacggggtttcaccatgttagccaggatggtctggatctcctgaccttgtgatccacccacctctgcctcccaaagtgctaggattacaggcgtgagccaccgcgcttggccagtcgcctggctaatttttgtatttttttgtagagacagggtttcccatgtttcccaggctgttcttgaactcctgggctcaagtgacccccctgcctaggcctcccaaagtgctggaatcacacatgtgagccaccacactcggccagtgaatagtttagaagcaggccatgtgcgtcctttctgcctgcctctgtaggtagattccactccgcctcccctgtgtggattcccacattggagcgcgggctgggtgggtggcaaggagagcagtaggtttgtgtggagcatgggcttggagccagctggactcgcatgtcccctttcccttgttacctttgtcacgttccctcatcactgagccttctgtttcctcacagtaaattagagataataatcatttgggtattttttagcaaattcgtattgtctactgtgtgtaaggtaccgtccaggggctgggtatatggatgtttgggagatagaatgagatcatagtgaatgtttattgcctctaagcctctttataggaatgagcccccactgaagcctcgtgacagtgctataaagcaggacactgttatgaccccattttctagatgaagaaattggaaactcactcaggatcccatagatattacatggtagaggctgtatttgaatccaagcagtctgactccagagttcttcaactgcatgaaaaagtgggcacaacagtatccttcagacccctctgcccccttatagtattactggagtgcacacacttatggttctttaacggagggacttgtctctcagttagatccccttccactccttgcac

SEQ ID NO: 66118 - DNA, 1051 bp, Homo sapiens
tgggattgatacactctccagctggacagtgcagaattgcatggaattagaggcacacagctgcagaactgcatggaattagaggcacacagcggcagaattgctttacacccccgacatctggtgtcagcagtggtggtgtgtgtggaagtagggaaaacactttgatttttcctatcctcattagccagggaggtcagcaccccctcattttactagagaagtggggatgttaatcaagtgccctgcccttctcaagttcaaggtgcctgagacactggcacccctcctgtcacctgcatatatttacttcatgttttgattgtcccatcactgccagcatcaccaggcatgaccaccgtgttccagagcatggtggcagtttgtgagtgacagagtggcagccagtggcctagtgtcccgcaggcagagcagactctttgtttctccaaggcaaggatgtggcagtgccaccaaatggtcgtgtcaattgatgcccaaatggctcaccaaaagctgagtgacagttgccacagcaaaaaaaggggagaaaacataggttcagaatttcttggaaatgtttgaaatgcatgtgatagaactctaggtgggaaattggcttgttagatacagtaacttagcatgcaactagagtaaacagtttgacctaccaacccaccgactcatctgtttattttacttctttttttttgagacaaggtctcactctggccaagctggagtgcaatggcatgatcacggctcctgcagcctcgacctcctgggcttaagcgatcctctcaccacagcctcctaagtaactgggactgcagaggcacaccaccacgcctggctatttttttaatttttgtagagatgggttttcaccctgctgcctgggctggtctcgaactcctgaggtcaagcagtctgcctgcctcagctcccaaagtgttgggattgcagacgtgagcccctgaggctggccccatttgtttgttctaataaaaatgtaggactgaatttgactcacagttgactaatttacatt

SEQ ID NO: 66119 - DNA, 2381 bp, Homo sapiens
cagctccttgaaagggaagaagaaattgctgaactgaaagcagaaaggaataacaccagggtgagtgtgacctttctgttcactgcctgcccctggagccactgtcaggaggaggggcggtgtgtcaaaacgaaaggacgacccactctgtctggcctgaaatacttttcataccttttcccactgagcagactgtgattagtcagcatgatcacacattaatggcttgaaatttgtgatgagaatttatgatattttaatacaattgagaggaatttgtttttctgcggaattgaagggacttcattttagtatgagactgtaaaggagttatttgccccagattcaatcatgaaattaaaaatgctgtttaacaagtctttattttggccttttatttcagctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgccatcagccacataagtcttggtttgtgcacatgctgtgtattaggccagcttcacaagtgttggtgtaacttttgttttttgaagcttcttgaattcttggaaataacttctctaagaagacagggttttgtaggtttaaaaagtactaattggcttaaatgtcttaaaattactaatgtatattgatttgctgttacaaattgggtagtattaggttgttgcaaaagtaattgtgggcaaaacctgcaattacttttgcaacaacctgatatttcgggggaagatttatttttctgaaacttaatttagagccattaacaagttttcttgacagtaagatcaatgacagacattaatggtattttattatgttatattacactaatatatacattaagtgtatatattacacttaactatatattaagaataaaataaacagtatacacacacacacacaaactcaaccccttttattttcaggtgagagagcgattacgagtagcacttgaaagatgtagtttgttagaagaggaattaggtgccacacacaaagaggtaagcttgagacttcatcatgagttgaattgggggggggttatttttatcctttaattattaaaagcagcataaggccagacgtggtggctcacacctgtcatcccagcactttgggagaccgaggcgggcggatcacctgaggtcaggagttccaagaccagcctgaccaacatggtgaaaccccatttctactaaaaatacaaaaattagccaggagttgtggcatgttcctttagtcccagctgctcgggaggctgagacatgagaattgcttgagcccaggaggtggaggttgcaatgagctgagattgcaccattgcactccagcctgggtgacagagcaagactctgtctccaaaaaaaaaaaaaaaaagtaaaagaagtataaggactgtagttgtacatatcacatgttacttatcttcccaattgaggaccagcctatctgagtcattttaaggactacaaaatgatggttacctaaggactcgtctggccagtggataataaattccatcttcaatgatctggttattttcggattgggtagcattgccatatgctttctcttttatactatgttaagcagtttttagttgtgtttttccaaaaggagttttgctatctttacttatttctcttatgtaaggtattttacactcatattcaattttttgctttcagctaatgattcttaaagaacagaataatcagaaaaaaactctaacagatggagtgctggacataaaccatgaacaagaaaatacaccaagcacgagtggaaaggcaagtctgtaggctttgtctttattctgtttgatttcatttgttcacagtatgtgtcgggttatgtggaaaacagttgctaaagtaccggcttagagctgaagtggtcatgaaagttgtgtaatccaacagattgcataagtcagttttgattttagctatttcctggaagtatttttattttatagctcaccaaacaagggtatttaaggatttttttttccccctatcagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagtgagc

SEQ ID NO: 66120 - DNA, 1032 bp, Homo sapiens
acctgttccttctagcaagtttgttgctaacagctgtaagaacctatcctcccactccatgatctgcttttaaagtctcgatttcttttctcccctgttatctttcctgtcccttgtcggctttgtagtctgaccttttgtcttctgggagctctgctgctaaggaagctaaactgttggaacttacttccaagcttaggaaggtagaatgggtgcactgctccttgcttgtgcttgccgctgctttctgctttccatgcttactaaccagaagcagtccaaggatgggagaatcacgactccattgagattgggcataggggttggggggaaaacacccagtcagtcgccagcagcagccatgcttcagaatcaccaacacaagagggctagccacctcatggcccagcacgtgaagccccgtaggctgtgttgatggatgagtacatgctttccatttagtatggcggagcagcccacgcagagcatgttgtgcctgttgccactgcagtggtatgcagcatgtcgttaatgaagtgtaaggatgacgtcagcgtacgctgtttctgctgacaggctgaagagagacacggcaacattgaagaaaggttacgacagatggaagcacagttggaggagaagaatcaagaactgcagcgggtgagcatgcagccctgagggtgggggcgctgagtgggtgctgcaaggtcattgctcggctgtggggagctcagggcctcccacccctgactgagatgttggtcctccagctcagttctggtcgcgtgcatttgttttgcaccctcatctgtgagtcgcctgctaatgcgtacatcccacacagtagttgttttcagtcagtattgggagctgcggaagaaatttgagatcctaggcagtacttcaggtgtccaaaaatgcttcttgcttgtctagcggcctatcaggggaactgttctaggtagctgtggtaccggcgtggcccccctaccccctgcaaatgtagaggcaggtccattgtcctgaatgact

SEQ ID NO: 66121 - DNA, 1038 bp, Homo sapiens
tgtggggagcaactgggggaggggagggcacacatggggctcaccctgttggtccttgtgcttttaaaataatgatcgaggatttacgtgaggtttataagactttgtttctcctgctttaggcaaggcaaagagaaaaaatgaacgaagaacataataaacgtttatcagacactgttgacaagctgctttcagaatctaatgagaggcttcaacttcatcttaaagagagaatggctgctttggaagataaggtaagttagataacacggacatgctggagctttcccaccctctgccaaaagattgctcatctgcccctgagcaggcgtgtgtaacagtggttagcagctgttaccgaaaatgggaattattctttaaagtggaaaaggtatgcacagttatccagtcactgaattaacttattgtttgctaagtccatgccccatttgtgtgtatgggaaattgtttatcattcttattctctagaatgagagtaggtaagtggtttttataaagggccagattgtaaatattttaggcttttagtagttatgagtaattaaataattttatgccaatcaagtcattagcacaaaagcagccataaataacgtgtaaatgaatgagtctggctatgttccaataaaattcatttgtagaaacaagcagtgggctggttttggccgtcaggttctagtttgccagcccctgcactaggatcattttttgggcccaaccctcacccctttattattcatgcattggaagttaatttctggctgggcgtggtggctcacgtctgtaatcccagcactttgggaggctgaggcaggcagatcacttcagccaggagttcaagaccagcctggccaacatggccaaacgccatctctactaaaaatataaaaattagccaggcctgggggcacccgcctgtagtcccagctacttgagaagctaaggcatgaaaatcgcttgaacccaggaggtggaggttgtagtgagccaagattgcgccactgtacttcattcagc

SEQ ID NO: 66122 - DNA, 1074 bp, Homo sapiens
catagcacatctccatttagactaacccattacagggctcagtagccacgtctggccagtgttggacagcacagctctagaaatgagatcaagtatacccatgacacagggatgggtgcatacttgatgtaagacaattaaacacaatacagagatgcacaggacgtgaatattgttccccttctcctctaaaagagtctgcttctctacgaaactaataattgttaatcatttggtgtttatcttctgaaaagcttttctatgactaagacacagcttttcattcattagggcttacaaagttaatatagtagtctgagtgtttatgtttattgcagtactcttggagaaaattttcccagaattaaaatgtttggtatttgtaactgctgatttaacctgttagggttatgcccaacatctgagcacatttgaagtaagtggttttaaaatctaaaagagatagcagtaatgtaagtcttttgcttttctgtaggatcagcttgtcctaaacattgaagcactgagggctgaactagaccacatgagactaagaggtgcttcacttcatcatgggtatggtattaaccagtgagcagccatattgtcagcacctgtggcaggccagttcttggctatgtgggcagcctaactggatgtggctaatggtgtgacctcaaggagcctgtagcttagtaggaagcgagagagaaaagtaactcaaaggttagagcttggtactgaggagacacatcattggcgaaactccaaaacacaggaggagttttgatcagttaatatttggatatcttaatttaggtgcccagcagagtgtgacactgatgatgtaagagcagaatgacagatcccaagatctcacaccacagatgctggcacgggtgggacaattgcagagcagttgaaggccagcagtggcgtgtggctgtgtttttcgtcagccctgggaaagtggagcagaaatgcagagccagacacctggacccagaggaggggtctctctcatcctagacagctgggctccttgtggctcatcaccttggctgtctgcacagc

SEQ ID NO: 66123 - DNA, 1180 bp, Homo sapiens
cctcaggtgatcacccacctcagcctcccaaaatgctgggtttacaggtatgtgccaccacgcctggcgtgtatcacctagtaatgttaactttagtcaccctgctgatctgtccaacaccaggtcttatttcttctaaggctatatttgcagccattgatcagcctctcttcatcctccccctgcccacccttcccggctgattttcggtttttgtttctgactctgccatctcccagttgtgtatttcgccatggaaatgccacatgtccatgttagggcgttaatatcacaagggtccaaggaatggattgttgccctccccaatttcttaaatactgcctgcttcatgtcagtaccttataagcatggcccatctttctaaaatcttttgggctttcattaaagaattcctaaatttccgatagatttatgtttctacaactaatgttgttactttatctactgagatttggttttcttgtttataggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggtgtgtgcaaccgtgcatgacactcaccacacgcatgggtgtctctgaggaatctcatcttgcctggaaaagtctggatgaaatactattaacattttctaagtattacataataatagaacttacttaacttctgttttaagaattttaaggtctgaaattgcccttgaatataaaattcaggtaaccagggcactctccccacagttacggcactagtacctttctgtaggacattgtgggacctgagaggtccttcccctgagaagctcgccacatagctggagggtgctgaaggggctcagcccagctcccactgccgtcctgaaagctgcacctggaaggccacatgagctgagcacatctggaggaggctgatcggcctaccttcctgatccagagtgcagatgaaaggtgtgcacggtggtgggctgggaagagatgacggactgaagcctgccttga

SEQ ID NO: 66124 - DNA, 1093 bp, Homo sapiens
tgatatttcacatacctcgggtaagcatggcatctaaagctctcgtcatcgtgtgctcttctcctgatggtgttgacgacccagtgttaacagggaatggttattctgtacgggcatctgaactgaaaagtgagaagagcgaactttgcctcctcggccccttctctgtgcctgtggcttatgcgtgtgcccctctcctctttgtcactgcttcccttgccctggatgtggttggtgcactggggtcaccttagaccacaggaaatgtctggttaacacacgaagagatggaaacgctcgcagccacgccgcaaacggttagtcacgccccacagcctgcactcctcccagcgcgttttccacttaagaccgtctgggttctttgcctttttgttgaaaacaaaatgttgttttccattcagtcgttccagataagtatttcctttagttattagttgaaatgtgtaagtagaatttgtattttattttagattttttccaggaacttcaagttggtagactctgtcttttagaatagctttaatctagctctccttttggagagatctcagttgagcctccatgtgactgactgtgtggccctttctccttccatgaatatgcttggcacggagagagtctgctccttgcatgagaagttgaaattgttggttttgcatgagttttgcatgatgctttgatagtctgaactttttcactcagtgaagctgcatcttccctgcagagttgcgttgcctgcattaccgagctcaccaatactaatagttatgttcttttgcattcctaaccacgtaaccccaggaagatgaggagggaagctgggctcaggttggagtctttctctaatatattcttcactacatgtacagcagcaaaaagcaattggagtatgaaaacttgtgtaatctactttttttgatgtttatagcatcttagtttattcggagtacaggattgttaatgatttgaaagcactggtcaagcaaaacatagcatcaaagagtacgtctcatggacaattttgaacatttctcatatggtgccatggcagttatttttaattaatatagat

SEQ ID NO: 66125 - DNA, 1114 bp, Homo sapiens
ctcttgttgggtggcgtgttctatcttctgttgttgggtggcgtgttctacattccattgttgggtggagtgttctatattctgttgttgggtggtgtgttctatgaaacgtcaggtcaagtttgttaagggttgttagtttaggttttctatattcttaatttttttctttttttgcttctttcatcagttgctatgagaaagaagtgttgaattttttcaactataattgtgaatttgcctgtttccccatttagtcctgttggttgttgctttatctcttctctaaaactatattttaactgacttttactgattttgaaatggattttttctttaggaaaacaaagtgttaaaatgtaaaccaaccagagataattttagtgagcagtgttgaattgagccttcaaacttgttcatgagtcgtgatcaatctttgtcacattattatactaaaaactatctcagagaggaaatttatagccagttacagtttttttgtagtttgatttaaaagttaaatttatcacaacgaatcatatatttttcatgttactattcctgttgtataaaaattttactaacaaatttaaaaggtgagaagagatcaaattattttgcaattataaaattatcattagtttagcctttgagaatataggtaatagattaaaaattcattttaaaaatgatataaactacttttgagacttcctctgtaactgaccttttccatttatgaaaagcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacaggtaacttaatggagatagttcttaataattggctaagatttttcactgttaccatctctaaatcatctctcttttcttccaaatagaaacagtttccagtgtggaattatgtgcctgagaaggttaaattatgaccggaaagaactggaaagaaaaagagaagaaagtcagagtgaaataaaaggttag

SEQ ID NO: 66126 - DNA, 1013 bp, Homo sapiens
atgcacattgctgtgattcctaagcttgctttgttttaaatacacattcttgaatgaaacaagcccaaagttttgtggttaattatatattatactaagtgtgacactaatagcctttcagtttggagagactggttcttaaaactgcggactctggctggtgagtggcccgccctctccttgctgttctaagcaattttaaggtctccgttggaatatttgactggtttgttcatcttttatttgtaattggtaacatggagacgtaagccaaaatgaagtcagccaaggagctgtctcattgatgtgcatagcccttgatgttctagccagtgattctcagagcagctacggcacagaaagtgaggggtcctggaggggaggggtcagtgtcggggggacgtttgggccccagcatcagaagttcccgttcgtcagtatggcccggcctgtactgagtggttttttgtttgtgtttattttccagtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaat

SEQ ID NO: 66127 - DNA, 1024 bp, Homo sapiens
gaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaagaatactgagaataagctctaactgttttggaaggcagtgtcaccatatggaaattgtattacagaagtcaattgacagaataaagcagccaggagatgaagtgcaggttcagggcgtcatcctgcccgctgctctggaggtcccgagcctgcatcactgcaggagacaggtgcctggtgttaaattgttaaatgcaaatgtgggggctcacatacacagtcggtgggtagggcccaaaggcagagcctaggccgtggaccgcgcgcatgcacgcatgtcccttaacaccgtttcccagctctgcttccttcctcggtgctggcttcacactcccacctgctctccctgcctgctcacaaaggtggctcccaggcctgcacccttccacactgatggcctctggaaatcaggaagcctggttccct

SEQ ID NO: 66128 - DNA, 1014 bp, Homo sapiens
gggccgggggtccgcgagggccacgaggacgggtctgggcccaaggaggccgggcagggggcaagggggcacggagggcttggggctggggtccgcggaggaaggttagaaaggggccaaattggggtatcagctctgaggggagggtccctgggcgccggggggctccagggcaggagaggggccaggctgggaggggtcttgggtccgagggaataggagagggggatgggctccgagggggagggtattagggcccgagggagaggggctgggcctgtggggttcgggggtctgagcggagggggccggggttcgaggggccaaggaaggtgggtgtggggggtctcaaggaaagggcgaggggtctgagagggaggtgtctgggtgcagagggaaagggatgaggtccgaggggaggagattggggtctgacgggaaggggtccaggcgcagagctactgggatggggtccgagggaagggaattggggttcgaggggaaggggtcggggctcggaggaaaggtatagggtccgaggggaggggattggggctccaggggaagggatccaggcgcagggaaaagggatggggtccgcggggtcaaggcggttggggtgcgcgactttgaggggctcgctgtgggacgtggcggagcagctggggatccgcccggcctgcacctgagcggaggttttgcaatcaggtcagtggaggcagcgaggcgcggctgcagctagtcgtgaggctctaaatttggaaccgtccctccttcggggtgtgtttaaaatcaccagaacggtgctttggggctttctgttacgtttccatcacctggatagtctaagggatgcctgatccctgaagctggaaggccttgggtgagaagggacagggcttcctcccgctggaatctgtggacgtttggggccccttggggaggaattcattttctgctgaaggaagctccggaggcatccggtgagcgctccctggaatcccatgcgctccc

SEQ ID NO: 66129 - DNA, 1047 bp, Homo sapiens
agattgtggctttgtgacatattagccacggttctgaatttatgtgtctgtgaaaggaggatgatcatacctatctcacgggtgtttgctcagatgcccatcgcagtgcctggctggtgggagtgcacccctggtggccactgctattctcattactaatactaatgttctcagcatgacttatttgagaagcgagtttttgtgaagcccgtggaatgaatcagctgagcattccctgctgccgcatgctggggagggcaggtcaccagggatatggcttggcctgcgccgcccactgggccttgcagtgggcctgtccgtttaggatgccagagctcttgcgtcactgccacctgcacctggcttaggaacccagaggtcacagcatcatgtgtttcatatttttttaaatgtcatgtcatgaattcagagagattgtttcagggacattggaaagtatttctccccactttttcatgtgtttttggtcgtcacagtctgctgtaggctttgaataccaggggaagactgagaagcatgcctcccagaaaggtaagacgcgaaaggtgcagaaagagcccgctccgggggccccgatggggagagtcacagccacctgaagccgtttccccgcgctccgggggccctgatggggagagtcacagccacctgaagccgtttcctgagcggtggctgttgccacaaggaggactctgccctcctcttcatgtttctggatcatctggataccacatgatggatgtattccccgttacacatccccctcggagccctggcatctgctgtcattgtggggcttctcccccttgtagcggaagccgccttcccttcatctgggcagcgctcctcctggaaaagagagctcacagattgatcggcagaaagctaacttccccccaaggctagaaaccagagttgttaaattcttgttttccttatacacatacggtcttaactgctggtgattaatcttgattacatcatgcagtctcttttttgaaagaccaaagcatatcgccaccttaa

SEQ ID NO: 66130 - DNA, 1211 bp, Homo sapiens
tttttagtagagatggggtttcataatgttggtcaggctggacttaaacccctgacctcaggtgatccacccacctcgacctcccaaagtgctgtgattacaggcgtgagccccctcccccagcctgttttttgaatttttaaaatattagctaatgatttaacttagagatggggtcttgctatgttgctcaggctggactccgcctcctgggctcaagtgatcctcccttctcagcctcctgagtagctgggctgcaggcacacacccccacctctggttaccactgtttgtgtttctgttattacacataaatagcacctttaaatactgtctgtattattcagtggtcctacagtggacctgaaagatttttgtttttttaatcaaaggataaaatacttgcatgttcactgatttcgttgctccttttaaagtagtccttttttgtttgtttttagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacctgttaatgatgggttctggcctttcattgtgcatgtagactatgtgaaagggtttggaggaaaatttggtgtgcagacagacagacaagacaaatgtgcccttggctgggatcaccaggagaaattgcagctgc

SEQ ID NO: 66131 - DNA, 1014 bp, Homo sapiens
gagatggttttagaagtttgtttttgttccttgcggggtcagttggtatgtgttgtgtctgcgtgtgcctgctgcacattgttttgtcttcactgtttgaagttgtcctgtgtgcccccccaatcccccagttccctccagctagtgtagtcacaaaccctccctgctgacacggggtggtaccccagagagctgggtttacctggaagtgggttgcacgggccaagcctgcagcagggggctgggtttacccaggagtggggacatgggtcaagcctgcagcggggggctgggtttacccgggagtgggggcatgtgtcaggcctgcagcggggggctgggtttacccgggagtggggacatgggccaagcctgcagtgctcctcatccaggcttcttgtctataaagtgggccacggtttttggcaggagatacttacttttgaaccgaaagtgttttcttgttggaatgggtgccccttccctggaaaaaggagcctgagggggctgaaagcctctcagtgtgacccagccctgagagaagcaggagcggggctaatggggctgcagcgccctccgaatctgcagggtctctcctcccgtgtacacagatacgcacactcgtctgcagtgtgcgtaggacgctaagaatgaactgcacagccgggagtgcctttactgaattatttgaagtacagttcttaggctgttccagatcttcgctgaatgttcagattttaagttcattctttaacgttgacctctggagccaccttctggcgctgagcctgggagtaggatctcaaaggccctaagctcaggagagcccttgctttctggaaactgtgtttgatttttgcgcatgctcatgcaattctaacccaactgtgtttcctcttttggttgttttccccaccgttgcttgtggattttcagattataagactggttttggaggcaaattcggtgttcagtcggagaggcaggactccgctgctgtggggtttgattaca

SEQ ID NO: 66132 - DNA, 1020 bp, Homo sapiens
gtctccagcagcattctgcccgaggctgttctgctgttattggtgactgccgtgagccactgagtcaggccttccagatgaggagagaggtgttggttcaaccaaaccactggccatttgaccaggggcttcgtagcagcaagggccaggagacaggcgtgttctgtgtggtttctgtgtttcatttgtggtggtgtttttggccggggttgggaggttttttgtttgttctgtttgatgacaccatatgtgtgtaacatctccacacagagccacacagtatgtacgtgaagccagctctgcatccttccttagagcagttatgttgttaccttcaaaatttggacttggttattagaacctgaacacataattggaaaaacagtaattccctaaccttgcagggaagactctaggctttccacctgcagcgttagaaacacacagcagtgttcaggtgtgggcaggtagacacacctggggtggtcccgcagactgcatggagatggcagtggctctccgtggcatcactgctgcatgacagtgtgactttcatgtggatctgtgttgctgcaacggaagtctttggctggtagaatttccacatggattttttttttctcttaaaaagcaagagaacaaactgcgattgagcctctttttagcgctcagtagagcaggcgcacaggaagcagatgagaataagcccgtgctggtgcggaagactgtgctattgaagtggcgcgttgcaaaggcctgtccgtgccctctttcctcgcttagctcctgcctgctgcccgccgcccctcctgcccctcctgcccctcagggaatgctgaagcctctgcccctggcctgtgctctgcttctcactgcctgtgtctcacgaccatgggtggaagcaaaacttgccttgcaagtgaagcctcgcttggccattctcgtttcttcccgctgtggtgcaccttcttgggctgtttctggatctgtctgcatgcacccacggccacccccatgctc

SEQ ID NO: 66133 - DNA, 1594 bp, Homo sapiens
gagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtgatttgctttggtctgtggtcactccgttctgcagtggaagctgcgtcgacactctcggtgtcctgcgccccggacctgggctggcggaggctctcctgccgtccagtgcgtctcacgcgttctgttctggctttagaccgaaccgtacgttccctttt

SEQ ID NO: 66134 - DNA, 1045 bp, Homo sapiens
gagctcttctgatcaccgtgccccatagttccatatggaagcagtgttcttcaaaggaccatttgtttttcaaattcagagagttttgagctcagaaagatttccgtcattcttggcatgagtcctgtggatccccacaggccctggaatggagtctgtgggctctgagagctgcttaaaagatgcagaaagcccagaggggccggcaggggtgcctggttttcctgcacgccagccccatgccgtgttctgtgctctgggctggcattgtgccggctgccccacggaattctccgggcctgtcccatccgctggagccgatcagcagctctggctggctttcattaatataaaacggagagtcgaggattactttacaaatgtagcctgcttggaaaaccatcatccttggattcagggagagaagaacaaaggccagcagcctgtttctagcttctgagtttgcatgggagaagctgagatcagggacagtgggactggccgggggcacaggcgtgtcatgtgccaccctgactgacagacctcctggccttggcatcagtggcaggagcaggtcacaacattagactcataaaaccaggcaataattcatttttttgcagctgagcagcaagaggggactgggagctgagtttgcacgcctcgtattaagaggtgaacaagcctaagaacaggcaatgctgatggaattttaggggcaccaaagctcccattggtcccataactgttttcttttcattgtggtcaaatacatgtaatgtaaaatgtgccattttaaccatttaaagggggaataattcagtggcatttagtacattcacaagtctgtgtgaccaccaccgagacctagttaaccgccccaaaaggaaccccgaacctcctggcagccgctcccctcacccctccctggtccctggccatccccagtgagctttctgtctctatggatgcactgattccgtatatttcctataaataaaatcacagaatgtggccttttacgcctggcttctttcactcggcg

SEQ ID NO: 66135 - DNA, 1039 bp, Homo sapiens
tttgtggcgtaaagcttgccacctgggggttgtcgaacttgaccagatgagacttaccgacaagctcccaaatcagccaggagcaccaggcttcgctgtgatatgaggcaggatttttccctggtgtctccctgcctcttgatcccagtaccaggcttcatgccatagtcagtgcagatattgtgggtgatatgtttgtttcataaccgttcctaaatatagagtgcatgctaagtgatatctagaagccatgtaaaagaaaacgtttgaaatgtttgcaaagaggatgaggcattgagtggaccagaaaacatgtcttcctaaatgggcccagcaaacggtgctgctgggggtgttttccgttgccagctgagttgtgactcttggcaacggtttcttagcaaccgtgtgtgcggggtaccatgctcagccgggatgggaggctgggacggaggctgcctgggagtgagaacaaggcagcggaactggaggcggggaggccccagaggcctgcagccctcagccctccgagcgggaggggccccaggtttagaggattaatactccaggtcccacgctggcctggtggttgccatggggtgaattactggaaacttctcttcctgcatttttccttcctctacagtgtgtattttatgcacaaacgtgtcttttttttttttttttttttttttttttcatttttgcacagagatccaagaggctgcactgagatttcccccagcttgggcttgtggacctctgggaggcaggggacttggggagcggaggggcctgagtaaaagaggagagtgcagggactggctcagagcccacatcctccactgctcagagcctgctcagatttcctaaggtctgggcctcagttttctgatctaaaatggagggagggaggtctgggtagtgaagcaccaacttgatccaaagagagagctaacctttgccttcacctcctgggaggtggtctctgggctcccagaatatcctgcctgatgtatgtgtctctgtttgcctgggg

SEQ ID NO: 66136 - DNA, 1043 bp, Homo sapiens
gaacattccctgtgggtcagagagtttgctgaccaggtctctgctacatctccagcatgcagcacagttcagagagattaagaagcctgcccagggccctccagggaggtctgaatctaagctgactccaaagcttgtttcttttgcactgtgtctgtctgatgctccaggtaagtcccagatcattgggatgtaatcttaacagccatctttttctgtgtgtggatgctgtacacccagccccaggctacatggagcgaaggctgcaggaggcatagtgggctgacatctccatgttggaagctgctggcgccaggtcctctgatgcacccattggtgcctctgggtcctctccacctgcccccctcctccctcccatacacccactgcccacctcccagtgttctcagcaggctcttgttagtactgatttctcttcgcctttggtgccctttcgtggggagtttcatgatacaagtggttagactggcaaatgaactggaggaaggccctgtgctaagtgccccacaggatcttttaattgatggagtttgtcagccctgggaattagggtgtgtgtgcgccaacagtaagcagagtgggatgagaaggggagttagagctgatgctgtggagccctgagaatggtagccccgctgtggtctcatgaaatcaaccacccaccagcaagttctctacttccctctccccaggatcttcagatgggtcccatggagcagactttcccatgcatctcctttgtgttcagtctccatggcaggacctagggggtcatggagatagacagggacggtcctgggcatgtgcacctccttcagcaccctcagggctggggttgcagatggaggagtgggttatatgggtgagaaggggagatggcacgtgtgccaggccagtgaggagatgaacgtcgccattggacactctctctggtctccggaatgtgccacacccctcctgtccccagacacttgcccacagttttgcctcctccacctgctttaccagggcacctcctgcat

SEQ ID NO: 66137 - DNA, 1071 bp, Homo sapiens
gcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataagtggctgtgtggtttctgactggtgaatgggcctgactcgtgaatgggcctgactgcaggtctgactggtatacgtgggctctgtttctggtatgagaagggatgtctgagagagatgcttgggtctcggcgtcaaagcattgggtgcccgtgggtgcgtggcgccaccctgcccctctccctcccatgtcagccctttgctggggctgtttttgggttgaatgtggagagtattccattcccccccaaggagatgaaaccaggcttggccacctgcccccggcaagtgaatggagaagccagaaagagtgccaggtttgtcttg

SEQ ID NO: 66138 - DNA, 1101 bp, Homo sapiens
aatggtgtgaacccgggaggcggagcttgcagtgtgccgagctagcatcactgcattctagcctgggctacggagtgagactctgtctcaaaaaaaaaaaaaacaaacaaaaaaaaaaaccaacctggccaaaatggggaaaccccgtctctactaaaaatacaaaaaaattagctgggcatggtggtgggcacctgtaatcccagctactcaggaggctgaggcagagaattgcttaaattcgggaggcggaggttgcagtgagccgagattgtgccactgcactccagcctgggcgacagagcaagactctgtctcaaaaaaaaaaaaaaaaagagctctgctttccgaaacctggaaattctgctttgcttggttatttagcctatggccttcagtaagtttctgaacctctcagcttcagtattgatctgttaacttggaagtaataatagtaaccacctaagaattgttatgaagattaaaggaggtcatctggtaaatgggatagagaaaaatggtatctgtaaaccacttggcacatgataacagtattcctatggcctcccatctggtgccttttctatcatgttaggatgactgggaaggtttggggttttagcgatccctcattcatgggcatcctttttcccttgggcgcagtgagattcctgattttctcctcctctcttacttaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtgagttctctgtggcctaggaaccttgaggaagaacacaggaatgacagtcccctctaactactccactaacatgtctcagttcattctggctgagcagcctttatggaataagttttacctgggtgtcaaagggaaatgtggcccttgcccttggagcagatctgtgtggagaactccaagggctctattcacatagaatacaatgtgaatggcgctcctcaaattatgcaacataactaccatgctttgatcttagtg

SEQ ID NO: 66139 - DNA, 1348 bp, Homo sapiens
aaatctagcagaagaggaaagatttttgtgtgcccagtgagttcccgtagtgggaatagtgagctttaattaatctgagccctagagaggagactcaggactcatctttcattcttctgtctttgaagccttagccgcatactggctgtggcctgtgaggactgcttgatgtttagatggcattcactaagagcttgttactgctattgctgcaatctaccccattttgaatgctttatgactgtgagccctttggagcacaatttttatggtcattcgttcaacagacatttgcaaatcaggaactatattctcccttttacattgggtacacagaaatgattcagacgtgaaacctgtccgccgagagcttacaatttgtcaagggacaaagaagacatacccatataattgtaatgtgaggcactctgttaaaggctaagtgagaattgacaggttggagctgtcaccttgagctgtttaagcagaggagaggtgacatttgagcaccaaagatgcattagatttggtaaatgggaaagagaaagaacattccaagcagaggcaatggcatgagcaaaatcgtggagaaaagggaaaaaaagttttggtggggagggtaagaaaaagaccattatggccaggagtatatcaagagtcacggactcatattttcaggagccagatgggtagtaaacatgaataaaatggacagggataaatatttgaagagattccacctaaagacactcagacaactttaaaaactcctttcagcaaggaattgttgaagtaaggtgatggatgcataagttcattatactaatatgtgtgtttttgcatatatttaaaattttacataaaatgtttggcaaaacacgaagtacaaatacccatgtgaacttttttttttgttttttttctgagacggagtctcgctctgtagcccaggctagagtgcagtggcagtggcacgatctctgctcactgcaagctccacctcccgggttcacgccattctcctgcctcagcctcccgagtagctgggactacaggcgcccaccaccacgccaggcttatattttgtatttttaatagagacggggtttcaccatgttagccaggatggtctcaatctcctgacctcgtgatccacccaccttggcctcccaaagtgctgggattacaggcataagccaccgcgcccggtccagaactttttttttttagagttagggtctcactctgtcacccaggctggaatgcagtggcaccgtcatggctcactgcagcctccaactcctgggctcaagtgatcttcctgccttagtcacctgagtagctagga

SEQ ID NO: 66140 - DNA, 1070 bp, Homo sapiens
gaactcctggactcaagcaatccacctgccttggcctcccaaagtgttgggattacaggcatgagccactgcgcccagcccttagattcattatttaatttaataccataaccttataagatatgtactattattattatctcattttatagatgtggaagctgaggcatagagaatttaagtaagttgcccaatgttatacagccaggtaagtgacagaactggggttcaaatccaagactacttcagtgcttgtgctgttaaccacaacgggcaatatgagtactctatactgtccatcctgttctatgctagacatttccattatgtacatttgggtcttcctttccggaggtgatttaactggagtcatggtatttgtcttttccaccagactgtgttctcctcgaaaggaaggcctattcattcctatatcctttgtgcctggcatagagtatgactcaataaatgcttaaatatgtgaactcaggaaagattccagtccctctgtacctcagtttttaatctgtgaaatgataggtttggactaggtgacctttgagatctcttgcagctttgaaagacttggatcacagagttttattttggccatgtttcttataactctcatcaggtactgagtaaatactagtgaatgactgaatgaatgaatgaagacataatattctttttctttttttttttttttttttttgagatggagtgtctctgttgtccaggctagagtgcagtggcgtgaccttggctcactgcagcctccgcctcctgggttcaagggtttctcctgcctcagcctcctgagtagctgggactacaggtgtgtgccaccacgcccggctacttttttgtatttttagtagagacagggtttcaccgtgttagccaggacggtctccatctcctgactttgtgatctgcccaccttggcctcccagagtgctgggattataggcgtgagattataggcgtaaactgctgcgcctggcctataattattcttaataatctgtgctaataattaacattggaatgatagaattaaaaatggt

SEQ ID NO: 66141 - DNA, 1056 bp, Homo sapiens
gagcaatggaggtaagtgtggtagttcgggccctgcagtctaggaactgcaggttaacccagcttaattgagtgatatgtctacccattttgctttcttgtcagtaggaggcagtggctcatgaccggtaggactggtcttttgggatctctctaagtatctgggttgctctcttagtcttgaatgtgtaagcagatgattgcaccaaatcatctatctgggtttcaataccatttctaccatttactagctgtgtgatttttgagcaagttacttaacttctcacaaccttactttgccccatttgtaaaatgaggatcataacaatatctatacctcatagagttgtgaggattaatatatgtgaaaatcttagaagagtgcctggcatgtggtaagcttacagtaagtgttaactgctttgaagatgattatcattaacatcatcattattatccatgatacaggatggggagctctggttaagaaaatgggagatgtatcttctgttctcaactctgcaactaacttgttttgtaaatagaatgagccatcatatatcttatgatgattgctcatcagtaaaagggtttcagagtgcctgccccacgaacttcacaaggtgactgaccaatgaggtgatatcaaccttagaatttaatagtgagaaaaaacctattgattttatttagattaaaactattgactataaaaacatagaatggcaaaaatacctgttcacatgacaaacccagtgtgattttaggtgattttaagcttagtatgaaccagttgtgtacctcagctaccaaaatattctgaataatttaaaagatgttcgtagaaatatgctgtctgctgtaagagaggtgatagtgccactgtggtctgctctgctgaggtcacaaatattttgttctaagcatggcatattaaaaagatctttaactggatcatgtgtagaagaaggcaacctggattaatagtcttcatatcatgttatatgaacagtggttaaaagatctagaactgttagcctcaaagggcacaggaaaa

SEQ ID NO: 66142 - DNA, 1050 bp, Homo sapiens
tgaactcctgagctgaagccatctgcccacctcaatctcccaaagtactaggattacaaacatgagccaccacacccgatccttctttaaaaaaatttagattagtgtaatctagatcctgtaagattcatgagatgcttagttttcccagtcaattcatctttgctctctccaattgaatagttcctgatgattatctccttcatgaacctgtcccacaatgtttcgaagggaaaacctatcttttctgcctatgaacatagtcttatgttctatccttttcaccctctgaatcacctgacccttagacacacactcgccaatacactattcatcattcatacataaagttcattgttattgtctttctccacctccatgtggcctgggttaggctgggacctagaatacttaggaagggtctcttgatgactgacagacaaagaagtaagaggcaaagtggcttacattgtaggagcgtgggtgcctctgcttccactgcaccaggagcagctgggccaccaccaaggttgcgatgaggatgaggaccatttcagcatgcatagcttcatggccacggtgcttggcatgcatgcgtgcgtgctcgaccctgaaagccaaacacatggggtgaatcaagtcagggatgctgtagtgataaagggacagtgctttccagggatatcccaccagtacatagctcagaacacattccctgcttcatagctgcagggtaccacacaaattaggggctaggacacacaccctaacagacaggcatgtcgagatagaatacaggctctacggaccccccagcaaccaagcctagatattggaattagagctaagtggcctgctgcctgcccccatggaagaaacagctgacacctttcctgtagcatgaaggaggtcccaggagaaacctgcatcattgcccatttcaagtctatttcaacctgatgctggaacgagaaagtaacccaaagaggttatagacataaagtctcatacgcttagtcaccaatatttatgacagcagtaaaggagtaa

SEQ ID NO: 66143 - DNA, 1048 bp, Homo sapiens
gtagctcagttttcatcatctattcagagtctaacattactctttagctccttcagggatgttaggggaagggataagtttatgcctggaaaagtatccatcctatttttgaagttctccagggagaagctttcatcatctgtgtctactaccaaatatagtatctcttcacatctctacctcctgaactgctttccctcctggaaccggtgagtggcaaaatctcctacctggaaatctttaaagtactgtagatttttcttagaccaagatattaggattactagaatgtggaattagagaattctgactaaggtggtaaggggttgtaattcactttctatgagaaggaaaaacttctatcttcagaatataacaaaaacttgtagctgtggtatctttatcagcctcctttgagtctcatctacctctttaggctcatttctcacaccttcctcaaatactagttgtcttttctcaagtataccatgtcccctcatcctggaacacccatcatgatgcctttttctatctggacctattggccatcaagacagagatcaaaggatgcttccttcaggcagccttccttggaggggggtgggttctccactttgagtggagtgcctctcctctgtattttcttggtcaccagcccttactccattaaagcacttaattgtggttatttgtttctcctcagtagacttgtgttcttcaggagattttggttttcatctctgaattccccagtcattagcatggcatccagtaagtgctcagtaaatgtttattaaatgactgcttgactgactcgtttgcttgaagtggaaaagatgggaaagaagacatagttctaggtattagaagagtagtcataagaaacatggagtaagtttactttgtgctcctctgaaagataagagttggacccagagacagaagtgacacaaaggcagatttttcaggtcagcatcaggaaagagctgtctagcaaatatattcgtattggagtggcctgacttatgtggtaaggattactatgtgt

SEQ ID NO: 66144 - DNA, 1618 bp, Homo sapiens
attggagagaagactagcgatgacttcaaatttctgtcttagagttagaattgttttatgcctttaaaaaacttcagctaacaagtctgagggaaggctctgaaggagggagagtaaaacaggcactctttaaaacagaaatgtgcctctctctgagggagtcctactctagttttactttcctcttacttatcggaatttattgaggacatatcatatgccaacagttttctagtttagaggaagtgggaatatggcccagtcactacccacaaggagcttacatacaggtagagaatgaattcaagcccagccgcatactctagataagcactataataatgttagaaaagaaaatgcgtttggagcactagaaagcactttctgcctggaaaggagactagacggaaggcttcgtgtgtcttggatgtgatattgtcaggcagaaaggcaggcaggtgggaaggacaacctgatggggacaacctgacttaaaggcctggggagtggtagatggccctcgaaatagtaggtcggggccataccatgggggatttgacagcctagctaagaatgttggatcctctctactaaaaacacaaaaattagccacacgtggtggcacgcgcctgtaatcccagctacttgggaggctgaggcaagagaatcgcttaaacctgggaggcagaggctacagtgagccaggatcacaccgttacactccaacctgggcaacagagcaagactccatctcaaaaaaaaaaaaaaaaaaaggaatgttggatcctatcctttgactgtttaagggttttaagcagagaaatgacatggtgaagatttcgtgttcgagataccattctggcactcctcaaaaggatggacactgaatgcagggagactaagaaagagctcattgcagtcagccagccaagtggtagcaagagctcaaatggaaaggaaagaatatatccaagagatagttgagtgagggatgaaagggaggaggagtcaaatatggtcctaagtctctgacttggatcactagtggagttaactttatccaaagttgtaaatacaggagaggatcaagctaaaatagaaaacaagctgcatttgggactgtggacagagctgcagagggagctggccagagctgaagtgcttgtgtttgtgtttcagatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggtgagagtttaagtagtgggaagagcccaggttttccgaagctaatgggttggaatgcatgggaggagcataggtttagactgaaaaaattcctggttttgtctgccaaaattatttggcatggggcctctctaaaacaagctgattggtagaacccctcccctatttatcgattaaaaacctcaaatatttctgtatagcttactttatggtttcaaggtatttttatattaaaggcaaacaaaaataagcaaattgtggtgatcattgtggtctcattttaa

SEQ ID NO: 66145 - DNA, 1060 bp, Homo sapiens
ggcagatcatgaggtcaggagatcgagacatcctggctaacacggggaaaccctgtctctactaaaaaagtacaaaaaattagccaggtgtggtggcgggtgcctgtagtcccagctacttgggaggctgaggcaggaaaatggtgtgaacccaggaggcggagcttgcacgagtgagccgagatcgtgccactgcactccagcctgggcgacagagcgagactccatctcaaaaaaaaagctagtagttactattataaaaatcctctgtattacagacatattttcaattattttagccagaagttggcactgtttgtggtgtccttggtgactcttacattgttctattgcactttttcttcatatcatcttatcaccctatgtgaggtagcaattattgtcccatttttagggatgaagacttcaaggctcagaaaggtaaggtcatacagtgaacaagtggcagggctaggggtcccaatccacattcatctggctccacatcctgtatcttccacagtggcctttaaagtaaactaccaaagccagagaggaacttatggatcacctattttaccttatacaatgaaactccagaaggccagagaaaggcttgcaggaaagtagaacataagaagaataggaagaagagcaatctacaatttgaaagactttggatcaggtggtcacagctttgaggctggccagtcaagctctcttggacctacacaaacctctgtcatagcacttaccaactgcactgcaacaggagctttcttgtccatctcctccattaaacagagtactccttgagggcagggaccatgtcttatccagctctgtatccccagcactcagcacagggcctggcacacagtaggtgcttatttgaatgaatgagaaaatctctttttctgttgagtgcagatattaaattacctcacaagctggtggggaggatcaaatgagaaacgaatttgaataaaataaaaagaattatacaggcagtggctgctttgtgactcaagaaggaagtattgtttattggaaaattata

SEQ ID NO: 66146 - DNA, 1023 bp, Homo sapiens
attcgagaccagcctggccaatatggtgaaaccccgtctctactaaaaaaaatataaaaattagccgggtgtggtggtgggcacctgtggtcccagctactcaggaggctgaggcagaagaatcgcttgaactcaggaggtggaggttgcagtgagctgagattgtgccactgcactccagcttgggtgacagagcgagactctcatctcaaaaaaaaaaaaaaaaaaaagaaaaaaaatacaaagccctagttcttgagtatatggaggcatttctgcagttaagggagtgagcagctttggatagtaactgaagttgctcagtaagtcctgagcaaagaccctggtgtccccattgatgtgagaataaaggattctggtgatcaggaccattaaggccagaatctctgtgtcagctgcactaaccttctctcctttccccaggttggtttataagtggttcctgctaatctataaaatcagctatgccactggcattgttggctacatggctgtcatgtttaccctctttggtcttaacttattattcaagtgagtaccctttgtttttgtttttgctggagtttggggaggagtgactgttgagatgtacctcttgttgcaagtcgtggttattaacaggagggacgtaatatccaggataggagacttgggtgctgtggggggatgggagaagacaggctctccatgatttgttctggcagaaagcaaggaatgtctgaatatatacaaagtcagagtcctaaatcatattttccaaggctttatattttagtggaaaagtctagtaaccaaagtaagcataataattatcataacctgctatccataattctatcaccttaacagagctgtttttctcgtcagtgtgtactgttcatttgcagcatccactctgcatgaatggccttacgttcaactaggccaggggttggcaaactgtgccctctgtgccaaatcagcccacaacctgttattataaaatgaagttttactggaaca

SEQ ID NO: 66147 - DNA, 1020 bp, Homo sapiens
gtctggggtgcgaatgatcctgttgcccatgtaatgagcacagttacctaacagatagtttttcaaccgttgtccccactccctcctcctcttgtagtccccagtgcctactgttgccatctttatgtccatgaatatccaatgtttagttcccacttataagtaagaacatgcagtatttggttttctgttcctgcattaactggcttatgataaaggcctccagctggcatgttgctgcaacgcacatggttttatctttttttatggctgtgttgctttccaaactttaaggaaggaatgtccatgcatatgcacatcttgaaggattttatgtggcttatctcaccctagtgcctttctcttccattaaacaagtgacatcaacttgagcaatttggaggtgtcaagaagcagtatttaagaacccggatgaacttacccctatggtagatgccatgtagtctgcacacatttctgcaaagtcccgttccagaactccatagtagaggccatagaagagaagggagatgccaaagtccatggcatcttctggtttgatcctgcaagggaagcattagagctagaaagacccaccctgagacatatcttctatggattactactctgggacacacaaggcagggcccaaagcgagaaggcccaaaggctagagcaagtgcgggcaaactatgaccaaatccagtctgctgtctatttttatatggcccatgaacacctcttgaggaggctagctagcactgtaggctgtgaagaccaagctacagtatcccctcctaccccttttcctcactctgctcttagtccttgcctcccctaactggtgacaatgacttgcagctacccaggacctatgctcatcgggacctacatagtggggactccactgttggtaacttctggacactaagtgagctgccttgctgagctgtctctcttccagctagccactcaagttgaaacagctgagccatccataaggaggaaagggcatgccag

SEQ ID NO: 66148 - DNA, 2017 bp, Homo sapiens
catgccctttcctccttatggatggctcagctgtttcaacttgagtggctagctggaagagagacagctcagcaaggcagctcacttagtgtccagaagttaccaacagtggagtccccactatgtaggtcccgatgagcataggtcctgggtagctgcaagtcattgtcaccagttaggggaggcaaggactaagagcagagtgaggaaaaggggtaggaggggatactgtagcttggtcttcacagcctacagtgctagctagcctcctcaagaggtgttcatgggccatataaaaatagacagcagactggatttggtcatagtttgcccgcacttgctctagcctttgggccttctcgctttgggccctgccttgtgtgtcccagagtagtaatccatagaagatatgtctcagggtgggtctttctagctctaatgcttcccttgcaggatcaaaccagaagatgccatggactttggcatctcccttctcttctatggcctctactatggagttctggaacgggactttgcagaaatgtgtgcagactacatggcatctaccataggggtaagttcatccgggttcttaaatactgcttcttgacacctccaaattgctcaagttgatgtcacttgtttaatggaagagaaaggcactagggtgagataagccacataaaatccttcaagatgtgcatatgcatggacattccttccttaaagtttggaaagcaacacagccataaaaaaagataaaaccatgtgcgttgcagcaacatgccagctggaggcctttatcataagccagttaatgcaggaacagaaaaccaaatactgcatgttcttacttataagtgggaactaaacattggatattcatggacataaagatggcaacagtaggcactggggactacaagaggaggagggagtggggacaacggttgaaaaactatctgttaggtaactgtgctcattacatgggcaacaggatcattcgcaccccagacctcagtatcacgcagtatgcccatgtaacaaacctgcacatgtaccctctgaatctaaaataaaagttgaaattattaaaaaaaaaattagccagatctcagatgtaccctataatttttctctttagggccattataggaaagagccactttatccagcaggaagttaacattcattcagtagatactttttaatgcctgctatgtgtctagacacatagctatatgccagaattacaaaagtgtacaaaaataaacatggtttttgcccagataaactttactcttaggtgggagagatggctattacagtaacaaacacagataaaaataaaattacaactttaataagcattatgtaggaaaggttcatgatgctgtaaacacatgtagtagtgtcatttgacctagtcttggggctcaaagatggcttccttgaagaagtgactatggagctgacttgaacaatgaatagcagttaagtggatgaagtgagaaccaggcagaggaaagagcattcataagagtcctgtcacgggagaaagtgtgggtgtttttgaggaactaagaccattgcggttgtatggccaagaagtgcctggagaagtagtgactagactagaaaaaagcctgtgggccaaattaaagattttgatttttatgctaaaaatcctgggaggggccgggcacagtggctcactttgggaggctgaggcaggcagattgcttgagcccaggagttcaagaccagcctgagcaccatagtgagaccccatctctacaaaaaaatgagacaaaaaaaaaaaaaacctagccgggcgtggtggcacatgcctgtagtcccagctactttggagaccaaggtgggaagtcacttgagccttgcagtgagcttgttcatgccaccaaactccagcctgggcaacagagcaagacgttgtctctaaataagtaaaaattcacaaaatgtataataatcatgcaaaggcacaacaataaat

SEQ ID NO: 66149 - DNA, 1022 bp, Homo sapiens
ttataggttctgttacatctaacttcccaactgtctctagtctggtcacttctccccatctgcccagcaaagatgaggtcgatttgacttgtaaaagattaccttttctaaacagtttaaaaaaaaaaagatgtcctctaactctgggcctcccgctgccactgtgcctcttctctagaaggcctgaggtctctgtggagcttcctactttggctgcttctcacatcttttcctatctttccttcctgctattctccttcagttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtgtatcctgcctcgagctcctgggccacatctctcctgcaatctgcacactgtagtgagagagagaaagagggtggtcatgaccctaggcatgctgtccagacccttgagtgtaggagagccacaagagggccaccttccctaccctttcccacagatcagagccactcttaggtaaacagtggttacaacctggctgggtctgagaggaacctgaggctgcagctagtgaggctgtgctagcagacctgagatctgaccagtcacaggggaagaggaccctctaatgggatccctcagtttagcatcatcctctgttctgaataacacttgtaatatttatcatgtatttacccagctcccattctctgcctatgttgggaaagccatgtattgtctccattttgccccataacagtcttgtgagatagggatcattatccttacttcacatgtgaggaaacaggttcagacacagggacttgcccaacattacagagctgataaagagcgaaggcaggatttgaacctttcaaagactgtctggggctggagtgccgccctggctctcaccatttcccttgaccagcggtgctcagcttccacgagttctgcatccgtggctggt

SEQ ID NO: 66150 - DNA, 2194 bp, Homo sapiens
gcctccttgcagccattgtcacggatagatagacttgtgtcagcctcaggctgtgttatcttacactggcagttccttcttagagaaggtgttacaggaggccctccctgcatgttagtcatggggaactaggatttatctctatacctctctcagggctgccctgcctccagtaccagtcccctctatctgcctcccaccttctctgcattcagctctttaccccaacagacaggctgtgaggaggaagaggagggggagggcaaagttgggagggctgcctgagtaggaagtgaggctgggcccttccagaaagcagcctccattcctctaggctgtggagcagctggaaagtggggcagacccagggagccccaccacccatgctagatcactcctggcagctcttgcacagagtctcttttctttaacacactgacagctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgcca

SEQ ID NO: 66151 - DNA, 1123 bp, Homo sapiens
cctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagag

SEQ ID NO: 66152 - DNA, 1053 bp, Homo sapiens
agttgtctccgagaggccctagccctaaacacggggaatgtgaggaatggtccttggttcacgtgatgaatcctcttctgaacctgtctcctcaggatgaccttttctagtgcccagcctcggtgacttgggagcccaggtgacaaaggcagtgctggatggctgctgctcctctgagatggccagaggccagcaggctctgggtggaggggctggccttggggtccactgcaaccaaggctctgggaggtcctgtgaccattacttatgtcttgagttctctgtcctatttgatagggagcatcttgggagctgcgccaagcctgcacccatgacactgggttggggagggagaatggtgcgtgctcagcccagctggctcagctggtggtacatgggcagaaggggactggcgctcaggagtcaacccgaccctgggaacctctgtgcccatagcccaccctccaccactgtgcttcttactcagtggcacttccacctctggccaggtcacttccaatgctggacactgcttagctgctgggaacactgggggctgggaggggcaggggtcctttgtgcttctaactgaggcagtggcagctgtggtggtctgcgagacaggtgtggctctgaccaggagagtgacgacgtgggcacacaggagcaggacccacaaagggctgaggtctgaggaaaggacagttacaggtcagcggctctggagacagagtgggctgcccgggtaaggatgtaactccagcccagagatgtctgggttctagccagggaatcagagcgggaagagggacccctcagcacccaccccttagccctttattgaacagagtacagagaagctttagactggagccagagctacaatatctgcccaggttcttaaagcaacagcaccaggtgcgctgggtggtttgccttggagtgaaggctccgggttagcccattgctccattctgttcatagacctcaccctaccccgcctgcccatgcgtagccccaaggcctacctggtgtccagttgtgtctcatggt

SEQ ID NO: 66153 - DNA, 1038 bp, Homo sapiens
cacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacatagggcccatccgtcctgggaaagagcatcctctggcaggtgctcccaccaggtcagacccagtcctggacttcaagagtgagggcccctgctgggcccagccaccaggacagcaggaaccagggcct

SEQ ID NO: 66154 - DNA, 1028 bp, Homo sapiens
tctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaaggggg

SEQ ID NO: 66155 - DNA, 1019 bp, Homo sapiens
tttagtccttggtgagctgggcctgacctgagcacagtgctggagtaacacccaggagccaccgcgcctacctcaggagttccagggccctggtggggctctagggagacccgtttgcgctgctgccgggtggtgatgccagtgccctcggctatctggattggctgcatgctggctcggcgcagggtctcttgggggtctccagttttcatctcctcatctgtgatggtgcccaggctcagggaaggctgcatgggtggaagaggtggtcagtggaccatagctgtatggagatggaggaggacctggggctgtcccagaactctacactcgcccgacacttatggtcgggacccttcctgcctcacgaggtagaaagacacaaggcctcctttcctgttctgctttctacctaagccctgggcaaatggccacaagcagtgcagtcctgaccagattcctctctgagctcctgcctaccccaagggacttcacccctgagtgccctcccagctgtctgttccacctggaaacatgagaaggtcaccctccccctcctcggccagtcagtgatccagggccctagtgctcaggctagatcagcaggtgggattccaagggagggcagggatgggaggccctgcacagtgaccccaggcctcaccctggactccaggggatagcaggtcttcagatgtggggggcacactcgattgcgctgctgcagctctgcaatgcggttccagtcatccagctgctcaggctcatcctggcaagtgcccatgtagaagctgttccttcctgtggaaggcagggaagtgggaacaaatgagcctggagtcggcaggtcacctcctggccctggcatcttgccagcctttgctgccacctaccccataaacttgaagcccagcacaccagtctgattcagtgccgcaggtgcaggagtacggcacacagactatttctatcctaggggcttgctcaccaccttctccctggagagggcagaagaggtc

SEQ ID NO: 66156 - DNA, 2174 bp, Homo sapiens
gctattctctaagctctggggccgtggggggtgtcggggcagaagaggggcaccctgcattccaggtagccctcctaggaagcctgtggcttagaagcccctgcatgtgtcttctgggagctctcgagagacaaccagggtggttcccatctctcaactgtcactgtccacttcagcagctactagtcacgtgtggttattgaaatttattaaagtaaatccagttcttcaatcacactagctacactgtgcccctgttcagtagctacatgtggttagtggctgctgtattggacagcgcagatacagaacattccaccattgcataaagttcttttggacaatgtaagtctagatagtctgggcagggaaagaacgagagtgtcaccagtgttgaatattacagtgcagtttaataacattcttaatgctttcaactgtgtcaccttctttggtttaatacttgctttttgcagttctaggcttcacagccttcagtcaggggcaaaggaattgggcaccagtggcattgggactcactaaagccctggtggctcctaggagttgttgggagctcagagcttcatttctcctgctcaccttcataccatggtgccacagcatgtcttgattgcaataaacaaatgtttattctactccttgtggggcctgtcctatgttaggagaggcaaaggggggatgcttctatctacagcaaagcacttgttggccttgcagatggacagagaatcaggccctgctcttaaggagttatggtctggacaggaggcagtgtgggcatcataaataagcccccatgggcttttggagttaggtggaccaaatcttactctgccatttagtcactgttactctggtcaatttgcttaaatctctgaactcagtttcctcctctgaaaagagggtgaagtgacttctcagagtggctttgaggagaaacaagttcccctgtcctaagagagctcacatgccaagtgccttagagtaaggctctgcacctgggtgttccctgaggattggttcccttcctcctacgggagattgtgcatgcaaagagggtgtgacactttgtgtctggtctcaaagaaggcaaagatagggcaggagctggtcagggaaaggccactacggatgtggactgaagggcatgtgggcttcaggtttagtagactgtagtcgggcagagagtatttggggtggtgtggttttcttccgcttcctaagaaagtgcaggagtctgaagcacctgtggagccccagtggctggtgcagataagcggacttgggtagagcggccagaccagctttcctgagtggcctttcttctcaggctgtccaggctcagggaggcgagagccagcaggaggcccagcgcctccaggcccagctgaatgaactgcaagcccagttgagccagaaggagcaggcagctgagcactataagctgcaggtaaggagcccagccccagcccatgccaccttcctcctgcccttcaacctctaccccacccacccaccctctctgcccacagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggtaagaatttggctggcagactcacctcactcctattccactggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataacgaaaaacg

SEQ ID NO: 66157 - DNA, 1063 bp, Homo sapiens
gctgtagctcatggcccagccgttcagcttcagctcgcagctctttgttttccttctgcagctgctccaggctccgcagctgctcctgcagctcttggttctgctgcttcttggcatcataatgtgttttggctttctccatctgtgggcagagagggtgggtgggtggggtagaggttgaagggcaggaggaaggtggcatgggctggggctgggctccttacctgcagcttatagtgctcagctgcctgctccttctggctcaactgggcttgcagttcattcagctgggcctggaggcgctgggcctcctgctggctctcgcctccctgagcctggacagcctgagaagaaaggccactcaggaaagctggtctggccgctctacccaagtccgcttatctgcaccagccactggggctccacaggtgcttcagactcctgcactttcttaggaagcggaagaaaaccacaccaccccaaatactctctgcccgactacagtctactaaacctgaagcccacatgcccttcagtccacatccgtagtggcctttccctgaccagctcctgccctatctttgccttctttgagaccagacacaaagtgtcacaccctctttgcatgcacaatctcccgtaggaggaagggaaccaatcctcagggaacacccaggtgcagagccttactctaaggcacttggcatgtgagctctcttaggacaggggaacttgtttctcctcaaagccactctgagaagtcacttcaccctcttttcagaggaggaaactgagttcagagatttaagcaaattgaccagagtaacagtgactaaatggcagagtaagatttggtccacctaactccaaaagcccatgggggcttatttatgatgcccacactgcctcctgtccagaccataactccttaagagcagggcctgattctctgtccatctgcaaggccaacaagtgctttgctgtagatagaagcatcccccctttgcctctcctaacataggacaggccccacaaggagtagaataaacatttgtttattgca

SEQ ID NO: 66158 - DNA, 1040 bp, Homo sapiens
gtcggccttgtttaacatggtgtccctttttcccagagtacagctttatggaagccttgaaggtgatatgcgaggcagcccccacaggttagggaggattgtgggcttaggacacttgcccatcactttctggggctctaaccccgagcacagcatagagatgtctgtagcaggaagaccgagggtgaaggagcaggaggggtctataccagatgggggcgggggagtgggggtcacatggtctggctgcctctttctcatgggaatcatctctgtgttgcctgagacatcgaggctatagagctggtgtttctgagacatcgaggctatagagcaccctttctccatcactctcctacccagccaccccagggctgctgaaaaattgggccctcctctaaggagcctgtgatagtgggggacaatcaaagtgaatagcaaacagttagcaatggagcccttgcctctcccctgtgctgcctggtcatgcttgaactcccagaatgcttggagcagccaagggtgcatggggctgttatgttctctcttttcccctactccctgtgctcttcctctttgtaggagtggggtgggctttggagtacatgtgctgcccctgctcttgtcttccagcaatctgttccccaatgctaaccacagcagccatgctgctagcaccagccctaacggcctgtggatgttgggaagaggtctgagcatctgtgggcttgggctttggcagtttctgggagggaggcatgggaattcattgagtatgtctactagaattacagactaggtcctgggaaggttgcggctgcagagtgtggcggcagcaaggtggtggtgaggtgtcggctccccagagtcaattctcctgattttggaggtgacgggggttgggcaggcctctgtctctgcaggctcagggtagacgcaagaacagttggccctggcaacatctatgtgttaggttgcctcattcaggccctgccaagcagcctgggcagcaggctgttccgtaattggaggccagagaa

SEQ ID NO: 66159 - DNA, 2502 bp, Homo sapiens
agcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtaaggtactcagcccaaccaccctcccaaagatcaggagctgagagcgcggggacatcgatcctctgtgtccagggcctctagctcctacactggagtgtcttgcctttcctcattcactgggtggcagaaaaggagaggtggctggtggagttcaagtctgttgcccctgtcatcctaaagaaaatgtcagtggcctcccctcccctgaaggctctgtcactagagagtcaagttgtgatgaccaccagcctgttcagaggcacacctgcactggatg

SEQ ID NO: 66160 - DNA, 1085 bp, Homo sapiens
cccagttccatggtttctgcttttttctaggccagggcaaaaggagatcttggtaacaagatgatgggccccatgtttgctgatgtttatgagggcttgtgtggtaatctggtgcctgttccccctctctgttcacatgggtctcatttactcccagaaatgccttgaagagaagaacgaaatccttcagggaaaactttcacagctggaagaacacttgtcccagctgcaggataacccaccccaggagaagggcgaggtgctgggtgatgtcttgcaggtaggaatgcacagaaagacctgtgtgctgctggttggtgtggactcacattcagtacatttgggttcctggtgttcctccatttccagaggagtcttgatgactgaggagtcatgctgatcccagtttgtctctttataccaccagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtg

SEQ ID NO: 66161 - DNA, 2156 bp, Homo sapiens
gatctgggatctcctcacctcacccagtattaactgggggaagtggttgggatttgtcatgtgcagaaggcctccctcaaaagctgttccctgtttatggaatacccttcttcctcggagactacaatgaagtctcttctcttagcacatctctgcagagccaaggagaatatatcactttttttttttctgacaaagaaattaaggcagtgagaagaaaagttttcccaagatcatgtcatgaggcttgaggtagcactgcaaacaacccaggtgcacaggcctcccagctgctagtgcgcacttccatagaccccgctcccttactgctgcctgttgctgattgcttcagatcttaggcgcttaccaatgcatatgggccttctccctcctcagctttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaagggtaggtggctggcacactggcagatgtgtgaatagacttgccggaaggatgtcccctggcctcccatgttgtcccctctgctggcccctggagctgagagctcagccctgggcctgtggtcaggctgacctcctggaagctaggttctgtctttgtccccatcttctctttcccttagattggataccatattcctcctcttccctatgccgtctcctcccttccccttgtgcacatagttctgtgcacatagttccgctcatgcacatagttctgattctcctctcctcctccctccactctgggcagatgcacagatagccatgatgcagcagcgcattgaccgcctagccctgctgaatgagaagcaggcggccagcccactggagcccaaggagcttgaggagctgcgtgacaagaatgagaggtacagctctccctgcattccttcccaggccccagcccctcccctcacccagccaggaacccatactctcttctcactgcttccctccctcgcagccttaccatgcggctgcatgaaaccctgaagcagtgccaggacctgaagacagagaagagccagatggatcgcaaaatcaaccagctttcggaggagaatggagacctttcctttaaggtgggtgttaaggtggtgtgtgcatggaggcccctcagggctgaggtggtctggaaggctccccaagagagggttgagaagaatgtcccagcacctgtcttatgcttcagtctctccagagacctgcatattttgcccctttccttatcccataattggcggcttcccgggtactgggctgtgaccctaaatgttgatttgtagttctgaattagaggtgtgatggctgtgattggtttgtagagggttggcaggataattggaggcatccagcccctggggttctgggagcagacagcagtggtggggtcagcgttgactctgggtgatggggattctcacttgcccgtctcagctgcgggagtttgccagtcatctgcagcagctacaggatgccctcaatgagctgacggaggagcacagcaaggccactcaggagtggctagagaagcaggcccagctggagaaggagctcagcgcagccctgcaggacaaggtaaccctctgctggggtcacagccacagtcttgaccacatgtgcaaagctgagtccagtttaccactgtgctcttctgggcctttgggtattaagttgctttctcttcaaggttcaatagtgtgctgtaattgaaagattgtgggcttcagtctagtacaccttttttttttaacttattttttttttccccagtcaatgccctcactttatagtacacctttcaatcctatctctgctgttcacaagatgtggatcttggacaagttaatcagtctgtttttctaagcatcctttccctaaaatgggagtagtaacgagtagctgcctcatcacctattatgagaaaacgtatgtaaagcacttcacacatcgtgtagtgtaaagtaagctctcagtgaaccagttgtgattgttactattggtaagaacccaatttggccacttactaataaccatgtagccc

SEQ ID NO: 66162 - DNA, 1111 bp, Homo sapiens
agttggaggttatagtgagctatgattgtgccactgtactccagcctgggtgacagagcaagatcttgtttcttaacaacaataacaataaaagcaactttctgattgtgttactttccttaacagtcacttcacttgtggtcaggagttaagtcagtcaggaactctgacttcggtacatcttgaggggaggtgggagggaaggggacaagtggggtgaacatatctctagttgaatgttgttggctgggtcataggacctcagctctgagagggagaatgggatccagcaggctcctagggcatgagggagccggggactggcactgccagggtggagctcctggcagccatcccttcagaggcctaacacctaagtgatgctctttttctccctgtggcccaggctgagttggctgtcattcttaaatttgtgctggaccatgaggacgggctaaaccttaatgaggacctagagaacttcctacagaaaggtaagtaggtacacactcctgagaatcccctcatctctgaaatggggaatactaggatcctgagttgtcaagtatggtgggggtttgtttctgtccccaacacaaggcagagttgatgctcaggaaaagtgtgtgtaatggagtaggtcgatttctgggccatgttgtatcatctcagttcctatggagctcctccttgctgcctggcagcagttatgtaggatatttacaagtgatcatacctacttttgttttttattttttaaacaatcattactctaggcttagaagctgagaatacagtctttttatttttatttttatttttttttgagacagagtctctctctgtcgcccaggctggagtgtagtggtgcgatctcagctcactgcaatctccacttcccgtgttcaagcaattctcctgcttagcctcccgagtagctgggattacaggcgcatgccaccacacctggctaatttttgtattttttgtagagacggggtttcaccatgttgattaggctggtctcgaactcctgacatcaggtgatccacctgcctcggcctcccaaagtgttaggaatacaggcatgagccactgcgcccggcccaca

SEQ ID NO: 66163 - DNA, 1176 bp, Homo sapiens
ccttcagcctagtgggggaacttcaccctgtcacttcagagccttgtttcctcctgttctttcagttcttggatgtttttccctccccatggtcttctctcactcttaacctaggtgtgttctccaggcttcctgacagtttagagttgagccattccagatggtgtaatatagcttcccgttcatctgtgctgcctccgtctcctctcggcccctttccacagagcttttttatgtttgcaaatagggtggcagagtgccatcttttccagaagaaccccatgcctcaagtcccctcttcccacccaccacacagttccatctggataaatggtgtcctggtatctgtcacctgcctccaggatctgatctggatctcttccagatccagcagagatcaagactggaaggaatggggaggtactatgaaatgcagcagcaaggaggcaaagattgctgaatactctggtcctaatacttgctctttttctagccatggcactgaagagggacagcaaatcttgaagcagccggtgtcagagagactggactttgtgtgcagttttctgcagagtaagcacctttcttatccagctatgaagaagctgcttcctcagctcgtgggattggagagtccagaggaactagttcatgggtgtctggaggagaaaaatttcaaggctccccactctttaacacaaagatgaaaacagctggttcagatcccctgggtcttgtgatgccttcatcagttggtgtaagaagagtgtcccttcagtcccagagcccttctcggagatctaggtggagccagaaggttactttttgggacctgtcacttttaactctttgagcaccttaagtttctgtttccccgaacttcaaggagacagaagagagaatgagtctctttcccttgcaagaaaaactgtttttcccagataactttgaattaattgcttaggcgataggtgtaggggcagaggcacattaaggttgatcttgacccccctcactgcttgtgtgacctttctggacataggttccctatctataatatggagataactgctcttcaagtggatgggtggattaaataagaacacatgcaaagcttctagtacagtgcttttcagttcccctccccttgtccagccttagaccacagagtcctcg

SEQ ID NO: 66164 - DNA, 1415 bp, Homo sapiens
attccatccatttggcaagggaggaaactagtgcagagagaaataaagtttgtaacaaaggttgctggcaagtttgtggaggagctgggcccaaagtgtgtatgtactggctcccagcccaaatatagagaacacatttgtaagcaatagaatctagttgtctgcacataaccactatgctgaagttctttaaaataccttgtttcttaaagcaggctcagtctctctcccctcttagtgttgaatatgtgaataattaacttagcaaaccctttcttcctatagtaataaaaacgtaaacttcagcccaggctacttctgaactgtagtgcctgtggaattcatgaggttttcctgtagaggttgaccatgtatacttattgaataacctgtgtacctgatgtgtgtgacccctggtgaatattctagtggtaaaaactgatttaaatgtatgcctatctgaagccaaagaatgggaacaggcaactaaattagaattaagaagtttttctttgaaattcccagctcctattctttcatcccccaccgccccctttttttttcttttcttttctttttttttttcctttggagacagggtcttgctctgtcactcaggctagagtacagtgatgcaatcccagctcactgcagcctcgacctccctgggctaaggtgatcctcccacctcagccttctaagtagctgggactacaggtatgtgccaccactcctggctaattttttgtattttttgtaggacagggtttcaccatgttgcccaggttggtcttgaactcctgagctcaagtgatcttcccgcctcagcctcccaaagtgctaggattacaggtgtgagccaccgcgcttggctccctccaccccctttttaaaaaatcatcttgttcccctattgtttttcccttctcccctcagccaaagctttatgtgtggaaagaataaaaatgtattaataagattttatatctttgtgggagtgtatagcatatatgtaatatttaagttttgaatagatatttcaaaactcaagagccacaaagggctataatataaaatgtattaataagattttatatgtttgtgggagtgtatagcatatatgtaatatttaagttttgaatagatatttcaaaactcaagagccacaaaggactataatataaaaatccaagggatacagaaacttataatgtaaacgttcaagaaatacaaagagctataatacattcaagagctacagagagttataatgtaagagcctttcttttcccacctcagactccctgctgtcaagttcctctctttagaagcagtggtagtaccaatttattggtgtatccttccaaaatactcccagtgctggaacatcttaggaaagtttaagcttttattta

SEQ ID NO: 66165 - DNA, 1395 bp, Homo sapiens
atcgtgaaagatttattctataacttgagggtattaatagtatttgcttgataggggtgatactatgttcaaatgaatggaaattgttattgttactcttacattttttttttttttgagatggagttttgctcttgtttcccagggtggattgcaattgtgtgatcttggctaactgcaacctccacctcctgggtttgagcaattctcctgcctcagcctccctcgtagctgggattacaggtgcctgccaccgtgcccggctaatttttttgtatttttagtggagacagggtttcaccatgttggccaggctggtctcgaactcctggcctcaagcgatccacctgccttgacctgccaaagtgctgggattacaaacgtgagccaccgtgcccagccactcttacattcttatcttgctttttggcacacatgttcatttatttgttcactcaagctaggaaatttagaggtgcttcaagaattttccttttctcattcttcatttatacagttgtccctcagcatctgtggggattggttccaggacttcacacagataccaaaatccttggatgctcaagtctctatataaaatggtataatattagcatataaccttcacacgtccttcgtatagtttaaatcatccttggattacttatataatgcaatgtaaatactatgtaaatagttgttacattgtattgtttagaataatgacaagaaaaaaaagtttatacatcttcagtacagatgcttttttttccctaaaatgtttttcatctcaggttggttgaatccacacatgtggaacccatggatacagagggcctactgtaattggttgtcagggcctgtcataaatagttctcaaagctattgttgcatctttattgtcattgccttacttcagacatacattacttcttgcttgtaacagacaatggtttttgcactgcattctgtaaagctttacagaactatagaactgacttaagaaccagggggaagcagagggaacaagtctccaaatatcccttacttcaaactgtcttcttctgtgtgtcctggggttctatataaaggttacatttaaatagagttcatttaaaatatatagtttggaacctttcattcattcaagaagtatttatcaagcactcatgctgtgccagccattgtgctgatttctaagaattcagcggtgagcacacagtttgtgatttcatggaacttaaggcagtaagagaaagataaattaataaaatacaaaaaggcgtaattaggaactatgggctgggcacagtggctcatacctgttatcccagtgctctgggaggacaaggtgggagcttcactttagttgaggagttcgagaccagcttggac

SEQ ID NO: 66166 - DNA, 1003 bp, Homo sapiens
caaattaagctgattatattgtagtgccctgtaacctgttcctggaaacagtggtcttgaaaactcatcagttaaatgaggtgttagacagcctggtcaaaagattctgtgactaagttactgtataatcatttgcaattctctttcttactctaaacattgttttcctcatttttatattgaaagagttaagagatgctaaaaattctagatctgaaaattggataagcctaagaaggtttgaggtagggaaatgtctattctaagctgtttgactactggacttggggtaggagtggaatttcttttttacttcctaaattatagttactttactctctacttatagtcacagctgggtgatcagacattaagtagctatttaatgagaagcaggcactggaagcttgctccagaaaaacaatcacaggacatgttggtcctgagagaagtcattccttggtaggacctattgtttgaaggaggtgggggtgaatttcatcaaaatggacagtgtggatattgtgattcagaggattgagagactttgtttcctgctgttattaatttcaagccttttttaaagggattctcctagtgattggtacagtgggattcatttagagaaaaagccttgtgtaccagttggaagttaatgcccaagagcagggccagttgctggaggacaaagtggcctaattagttgcttttcaatacttagatcctacaggctaccccaaagataaaataggctactttgtagctcagatcttccagcctagtgcctagcaagctcactaagaagaggaggtgacctgtagaatccacacctcttaatctccctatttctcttctttccctcattgccctttagttttaattaggattgtgtaaacatagtcatcttgccagtcctcttaaagtggcaggcccttggcattttctgctggtcactcatgctatatgtataacttgcaattagagggactagctttgacaattt

SEQ ID NO: 66167 - DNA, 1051 bp, Homo sapiens
tatcatgttatttaatccctatttcagcaagtatttcctaagaaaaaggtatcttcctatataactacagtactattaacactcaggaaacttaacattgattcaatacatccagtatataatacttgttcagatttctcatcttttcccagtgatgtcttttattgagttttttaaaattcaggattcattgaaggatcatgcatgtatttatgcacttagttgtcatgactatcatgtctttagtctgctttaactttgaacagttcttttttaatctgaatgcctttttgtctttcatagcatttgtctgattcttcttgattagattcaggttaggcatttttggtagaagaactatatagattaatacaatagtttgattgatgaggctgacactaaaatacatagaagcagtatctgattttgcaagacagtatataatttagcacttatttgtgttgtctaatctataaaccctataggaatttacagaagaaggaattcagtaggacttggataactaggaatgaaatactttggcagaaagatggggtttggaaaatgaacagaattggaggcagttgggatatggttagataagctgtgatttgggcttcccatcctactattaaggttgtgtatcatgaaaagtgactttgagggttctgtatcttccatggtgtttgcactgctagaagcctaatggtgtagagctcttgctttggcatcagacaggtctagagactgtgcccagcattttgccagttacctaaccttggggaagttttctcatttgcaagatagagtattaataactatttaaaaggttatcgtgatgctcacagtgagacactacataaatatttgaattaaaatatttgaatgcctttaggggggtgcagcgtttcctagatctgccatgtgccccactggatcattcattttgttttgtttggatacgtggtttcgctctgttgcccaggctggagtccagtggcacggtctcagctcactgcagcctcccaagtgggtgggacccaggcacact

SEQ ID NO: 66168 - DNA, 2058 bp, Homo sapiens
tcctctttactggaatggcactccctcttgaaaacgtgatgatattttcttgctttaatacataattccctctctctagtatctgttgcctggttctatgtttccaaacttctgggttgtctggtcgttaaagctttaatggtaagggagttgggcctctctgctttgtggagatctttactgctgtgaatatatgggaacctggggcgaacatgaggatcatgtaaggtagctttctgtcagcacagatgggtttatgtttcctcagtccctctttctgtgtggtattttcttctttagaggaagaaccacatacttttttgtgaaagcttccaaagtattcttttcgtagcctaagttctagcaagggatgactaattgtaatgtctaagctcttagttcacagcgaaaagcggtacattccaaaagcttaaagatcttacctgaaagctcgttaagaaacgtagaattcttttttacatgtggaacatggaagtgggaagaatgccttgaaataagacttgaattctagaacttttaggatgagggcaaagccctgctcaggtggctgaacagagctgatcaggggctgtttggacagctgtgtctaattgataaaactatgatcagaagatattaggtttgtgcaaaagtaattgcagttattgccattgaaagtaatggcaaaaaccacagttacttttgcattaacctaatatatggtgtggtcatttaatttagcctcttacccagtgtacactaaacataccaaaaggtgttgtccagactcaaaatgagtactttctagaatgagatcattcccaaagtcaatccatctctaagctgaacaattctaattgataattattattttgtagctgggcatggtggcttgccctgtcatcccaactactctggaggctgaggcaggaggagcaggcgggagaatggcttgagcccaggagttcttagctagcctgggcaacagagtgagaccccaacacaattaaaatatgtttattgttttgtattgttagtgattatttcattttacccatgtatgtctactgtttgctttttcactatttttccttgcattttattccttccttttttattgcatagatacatacatccttcagatgtttgtccagtgggaatctgttagtggtaaacactgtcttcatttaaaaaatctttatttcactttcagttttttgttttttttttttttttgagatggagtctcactctgttgcccaggctggagtgcagtggcacagtctcggctcactgcaagctccgcctcccaggttcacaccattctcctgcctcagcctcccgagtagctgggactacaggcgcccgcaaccacgcctggctaattttttgtatttttagtagagacagggtttcattgtgttagccatgatggtctcgatcccctgaccttgtgatcctcccgcctcggcctctcagagtgctgggattataggcatgagccactgtgcccagctcactttcagtcttgattggtagtttagctgggtactaggcttccaattattgtctcttagcactttgaaagtgttttttcattgaaattctggctttttgttgttactcttgagaactatgcttgcaaattaacttattttattgtgggtaacctgtctttctttctgtttgtttttaagatcttctttgctgtcatttgtgttctgtacttccattacatggtgtgaatttaattttcttaaatcactatatactgggggcatatagtaattccttaatctgaaatttcatatcttttcactaattgtgtaaaaattcccaatcattacctctttacctctctcagatctcatgcgtaacttatgttgaacttcctcattctgtcgtctacatcttattctttctttcataatttccatttctatctttctgtgttaacttctggataatttccttatatctatcttctagtatactagtttactcttcagctaggtctaatttgttttttgaattcttatttttattagctaacttttt

SEQ ID NO: 66169 - DNA, 1140 bp, Homo sapiens
cgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtaaggtttgtgaggagaggcgcctgagagggaggagccggggggggggggggtgccttaaaggggagggtctgtttgggggcgtgtctgtggaattaaatctgaaggtgactggggtcgggggtatagggcaagttcccgaaaggcttgtaagcgaggggtcgggtcctggaaagtctttgccttttatcgttaacaatagcagtagttatggtagtgcagtagtcagcattttctgagctacaccgtccacaatgacctgccaaatgtttatctttttaatcttctaaccacctgttatactttaaagatggggagcctgaggtttataatgtttagcttggcccgggttacgtagccagtgcgaggttggctctactttgggtttatgggttgggcataaatggggacggggaaggtgctttgtgggggcgcgcgttgtcttggactggtcagtgtattttgagcctcacttttcatatatgtaaacaatgaccttacctgccttacctacttcctggggtggttgtcctggtcaaaacaggttaagtcttttttttttttttttttaatttttgtttgtttttgtttttcatccatggactctcacagataacatgtttcatacacgcacctcggagagtacaaatttatgactataagtggtgtgactgtgtgaagattgtgggtgggcgggagcccactgggttgatgctgccgcctctgggtactctcttttgcttacctctgagttagcacttgtcatttttttttttttttgagacggagtctcgccctatcgcccaggccggagtgcagtggcgcgatctcggctcactgcaacctctgccacccgggttcaaacagttccctgcctcagcctcccgagtagctgggattacaggcgcccgctaccacacccggctaacttttgtatttttagtagacacagggtttcaccatcttggccaggccggtcttgaactcttgacctcgtgatccgcccgcct

SEQ ID NO: 66170 - DNA, 1043 bp, Homo sapiens
tgagtagatgatagcacaaaatcctgaattaactactggtaaagcctatagaattcacttcagtggaatacactttgatatcctgtctctctttccatgaatgttgagtacctacagtatgccaggtactggatatacagtgataaacaaaatgagagacagtctgttccagactttgtatgaataatagggcagagagcagacatttgtgccttggaggagcttatatgggcaagatgggagcaagctggcaacatggtgtgataagtgctatataatagttgtagcagcacagaagagaggctattgacccagtatgggagctcagggaagtttcccagggaaggtgaagcctgagctgaatctccatggattaggggatgtttatcaggcaaagaagggtaaacaggcagggaacagcatgaagaaaggtatagaggtacagaacagccagggagtctggggcgggtttgtgtgcctgcacaagtgcttgcacgcactgcacaagggggacagagaggaaaaggaggcaggaatccagtcaaaagtctcaaatgtcaggctaaggatcttgggctttaccctgtgtgtaatgggaaggcactggagtgtttaaagcaaatgattcaaatcttttatttcagaaagatcactcttaagtgtcagtgtggaatatggattttagggagtgagttggaccaaatgaccaatttggctgtttgagtcatccaagcaagacatgagagggccctacaatcaacataatttggttgactggatgtaaaggtagaagaatattaaagggtggttgccagttgtattaactggtaaggaattacagaagaagaaatagcattgggaatgtgatgagttcaggcttagctttggtgtatttgaggttcctgtacaaaaaggtggagaagtcaagtaggcagttggagatgaaggtcggaagctcaggagacacagacttgagaatcattagcatagaaggcatacaagttagggaaagagatgagattcctcagggagagtgagggtag

SEQ ID NO: 66171 - DNA, 1037 bp, Homo sapiens
gttgccaggctggagtacagtggcgcaatctcggctcactgcaacctctgcctcctgggttcaagtgattctcctgcctcagcctcccgagtagctgggactacaggcgcccgccaccacgcccagctaattttttgtatttttagtagaggcggggtttcaccatgttggccaggatggtcttgatctctcttgaccttgtgatccacccacctcggcctcccaaagtgctgggattacaggcgtgagccgctgtgcccggtggttttcatgtattttcattcaatcctcacaaaacctttatgatactggcatattatccccatttttccgacagggaggctgcagttttgagaggttaggtagcttgctcaaagtcacagtcagtaagaggcaaacccaggatttgaacctacatctatctgtctggccccctagccttgtgctttggactgtaccatgctgcctcattacttccttgataacatgtaggagtggagaggttgggggctgaacaaagtggcttcaggctcccctgactggattcctactgttaggaactcacagggtcaatggaagtcaggtcattaaaggacaggtcgatccaggccaggttctctgggtgctccaacagctgtgaagccacctggttgaagtctctcagatcattgagaacattgttattcagccacagggactgggtcagtgatttccccgactttgaacgcttcagtggtcgtagtcctgtccttggctcctcatttaccagatctgtggggacaaagtgagacttgggtatcatctttgcttttttggctttagggggtgggaagggacagagctggaaagattagccatccaggctgtagctggagggtctggaagggccatagccctgtgcctgagtctagtgcaaccctgtcccacagcttccagcaatcagtaagtttagactaagggccagagacttctatctcaagctcttggctttccaggtcacatggacttctcatgtccactgtaccactgggtctttt

SEQ ID NO: 66172 - DNA, 1029 bp, Homo sapiens
cgtctcaaaaaaaaaaaaaagaaaagaaaaggctagagctacttgcagttgcctgagttagagaacatctctacaaggtgtaagtgacttctcatctgctcaacagctcaaattatttattgtcaaaccatgctgtctatgcttaggcctttaggactactagggtcgtgggagcctcaaagtgtattctgcttggtccaggccttcttgggcttgatgttcatgcgtttccagacttcagctgtggtgcggtctgctttggtgaccccactgaagtcgaacgtggtgatacgggacagggtgcacagcacatattgcctgtggggaagacttaggctgggggccagcacccccaccagaatccccttccccctccactagttgctgttgtcttccctgactgcaaggaatggagggacttgagcatagtttgggaaagattaggtttatcctgactgagagcaaggaatgcttagaggtctgttactcccttcccaggtccaagcatggcagaagaatggtcgtagatttcttgtttctcctcctcctttcctttaggggagcccagctagacgctacctccaggggcagggcacttacctataccctttctcttcctccatggggttcccatggagtgtcaggctacggagccgaggaaggacagccagcttattcacctcccccaggcgctggatgctgttgccgtgaagatagaggacactcaggttgaagaaagttgttaggacctgttggggagggaaaccaaaagccaggctagacaggacaggaccctgaatctctgctcagggctgactcgtgggcagagaaggaagaatgtggggaacaacctgccctccactccaaccctccacagccatactgtatgactgtaacctacttttatttatgttttaagacatacagggcatcacactgaaaaggagctgtgatctgagggtcaggagtgtgggcctgggtaccagcactgccactgacttgcctctctcagccttagttgccccttca

SEQ ID NO: 66173 - DNA, 1400 bp, Homo sapiens
ggaagaagctgccaccgctgccgtctcttaccagccagccccaccaagtgctggccagtgagcccatcccgttctctgatttgcagcaggtgagacacccctcacctgcccctgcccacccttctcacactgcccagggtatggcagagggttcacccactctgcctcagaggaggtagggaaggtggagttagggagcctggtagccttgtaggccccagctccctcccacctcgttctcttaactttttatgtctttcctatctccttcctgcaacctttattgtttcactcccctttgttcttttccttctgtctctcccatccctgtctttctctttgccttcctgttccccttcattccctccttctccatcaccatctaatctcccctccccatttttcctgattgccctcctcacctgtctctgttcctctcctccccggcccctctctgtctcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatccatgtgctggttctggcccctctgttctacccattctacttttgattacttaggtctatgagagtaagatggggggaaggggacatcttccagggatattgaagatgaacccaagagacaagggtttagggtgtcagctcttagctgagacctggcttgggctaacctcagactggatgagactgttcttgtcccttgtccagtgatgatgggaacactgtcaaagctgaacagacctgaatctgaggcagctttgattcttgggggccctgcctcagactcaatggaattaccaacagcccctgggggtgaaggg

SEQ ID NO: 66174 - DNA, 4971 bp, Homo sapiens
tgtgcacccagaccgtacgatctggagcatcaggcctggatcccagtcgcccctcgcatggcatttagaagagtatatcacaagggcatacgagggcatttggtacgagttcgctcaatggcccagaaaagtggcctagtggccacgagaacgcataacacaattcacgatggccactactgccagtttagagactggaaagatgaagtcatgtgatccgccccgccctttccccgcatcacgtgcttgcgtgtacggttacgccttcccattggttgacaacgatcacgcgctagcgggcgggaccggaagccggggtattgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggtgcggccgcggcaggcggggctcgggaatgagggctaagacactggggcatggggcccagaaagaaacctgcggaggacgggcagccggactgcagggctcactgaatacggaggcctggaggggacagattacagaggagacgccaagccgggctcctacccctgttaaagccccagatttctacacagtccccgcctcggggtgtgcaggcagccgcctgtccggctcgctcccaccacttccgtttgctcctaccttcaaaacttttcagattcaaggatcctcagtctaggtccccgggaaacactcccttccccagcttcctgtgtcttctgtgtattagtgggctttgcgaatccattttaggggtgggtaagctgaggccctgagttagtctgtcctgagatgaatcaggaattcgtgtatcgtcttagtccctggggttgcagaaggaaggtcgctgctagtctagggccaggggacgactctggaagttggtggcctttgaattggccaatgaaggatttaatcgatacagtgaggacatcgggacatgtgggaaattgtctgggaagcaacaaagaggatttagctttggctagattgtgggaaaagagaaatggagcgggaagttcatttggttctgagtttggcttgcctcagtgcagtctgcctggggcctgagggttcctttagctggagacatgcctattctgagaatttggctgtagatctgatacctttggagaaagggttaggctggggagacctgtacagttttaaattctccctcttcctcttagtgcattctcacttctccccacactctaatccctgccctgcctggcctgacattcaaggatgaagtctcaagttgctgtctactctccttttttgatcgtctctaagcccggattctacatttgaacatatagtagacctgagagagtagaaaggtttcaggtagctcacggtctaatggggaagatggtcacaaaaatagattatatcactggtacttgggaagtagttcgttcttcagtgaacgtattttggattaagggcttaagcctaggaaaatgtcgtttgtatgggaagcaagggtggcttctggttctcaattctccatacacccaatgaacacatatttcctttgccctgtgttaggcatgtgttgtgcctaatacctctcacttcacttccacctttttgagaaagagacaacaataaccctgcctactgggagagctgtagcctagtgggaaattgtcccttaaagcataatatggactcttgcagggaatgagtcaagaaggattaatgccgtatgagaaaggatacaagcttctacttggaagggagagctgggcctgctgctctcctgaatctctaccttctccttggggggctctcatttctgttcctaacacccagagaaggtgcttaatcactgctgggtgatttgaggcctcatgtagcaagggccataaccatccaccatcccacagtccctctttgagttcttgggcaggcccctctccgactctcatctctgtctctttatcataataaaaaatatacaacacgttacagtttacaaagggccttcacagttatctaatttgactcttgccagacatccgtcatattagtgtgggttatgtctattgaaaggtgaggaagaagttcagagaagctaagtgatttggccaagctgagaagtgctagtgcccaggtgttctgacgctaggccatgtactttatccatggggccaagctgtctcagccatgcccctagaccaggtggccagtcacgggcaggctgctatgtctgtgctaaggtagacagtgaaaccctgcctcttgggttacactaatgcagagacaaaccttgatgtgacaaacctaacccatgctccactcgcactttgggagtggggtgatgtttgtctgctctgaagtaggtagcatggcctcttctttaagtctgggtttcaagaaaataaccttgttgttcacttgatcttagctgaaggctgagaagtgatcagccaaccttcttcttgaagaacccctgatagggaagagactaccctgtcctgcaggaagatctgtctgaagtggagctgggaggacagacacataggaagctaacttgggcctcattatggagccagctttccttagaaatacatagttttatctttggcaaacattttgtctttttagctctttaatactgagcctatgtatttagggaggaagggtgtctgggagtttatagaggtgatggggcaaagcccacagcttctgtctcttgctgttgggaactggatcaaattgcctgaggacacttgggcaacctagccttgagaaagaagagtaaggtgaaaaggctgggcctccctaagcagggcaggaggaagtagccctctacaaggagagttgtggagttgtgggcaggggagctgcggcctgcagcaggaaagactgaggaactgagataggcctggaggggagcattgaggagtctggcactgaaggttggtgagtcagcattagccaggatgtccccctgggcccatccttggctttgttcagggcactcttgctctttatgggttggatagatacccagcaggtctgtttttctcatttactgctgatacagcaagcaaggatttgcagctgatggtctcaaggcagggtcaaatccagaaatattacagtagatagaacaggggactgaaagaggacaaggaggaagaccaaaccaatgaggaagcttggtttggtcttacattagttcaggggttgtgattatcagcacaggccagcaggaacagggctgctgaaaatttacatgggctactcaggtggtttagcaagggagggaacagcgccattgttgtttgttttgagatggggtcttgctctcttgcccagactggagtacagtggcacagtcctagctcactgcagcctcaaaccctgggttcatacagtcgttgcacttcagcctcccaagtaggtgggactgcagggctcacactaccaagtccagctaattttttttttttgcaaagacgaggtcttgctttgttgcccaggctggtctcaaactcctggactcaagcaatccttctgccttgggctcccaaagtgttgggattactggtgtgaatcaccatacatggctacagctgtactgctcagatcaggatacaccatgtacactcagtttggttctgggagtcacgtacaaaaagagcaccagagcacaggagggtgaacaccttcgaagggacctgccttcaagaagggaacacacttgtactgtgtgacccagagctgggctgggattcctgccctgacataatttgagaaatggccatggagaggttgggcttgctttctcttggggcctagggctttgtctggactcgccagggcttccatcttggaagcgaacagctttgctggggaaggcctggtcctaggggatgaggaaggctgttcttgggctcttgacttgcactgatttcccctttagatcccagtgcttgctatgtctcagctccactgtcttccagcctctagtatcctttctttgccaggtcctagaatgtttttcaagctccagggctgttgctgactacctgctttgtgcctctgtccattttttcagggcctctaggactgcctggttccactctcatttatcctagaacaccaactcagttgagctcccaaggataggcaggaactgagtcttatctggcattccataaagctgggcactttagatattccttatagaaacatttttggtgtttaaggtcagagctgggctaagggtagcacccgtgaaaggcaggatctacgggtcctggggctgacttctctcccatgaccacttctaggaccgagaggagcggaagctgctgctggaccctagcagcccccctaccaaagctctcaatggagccgagcccaactaccacagcctgccttccgctcgcactgatgagcaggccctgctctcttccatccttgccaagacagccaggtaagtgtcagaggaccaggcctgggtcagagctcctctatccatattaaaggctaggatagaaggagccaggctcaggacatgggggatgggacaaggtcactggggagaggtgcctccatgtccagccctgctccagtaggcaggagggaaactggtgtcagatagccctggagttggtacctggcactgagtcctgtttgtccttctcggaagcacctgtcatgtcatctctgtctcctctccccatagcaacatcattgatgtgtctgctgcagactcacagggcatggagcagcatgagtacatggaccgtgccaggcagtacaggtgagcacctggccagcgtgggtccctcaggctacttgggctcccaccct

SEQ ID NO: 66175 - DNA, 1001 bp, Homo sapiens
gcttacctgggctggaggaccagagcacaggacaggtcggggagtccagggcctgctgcgggggataaccctgaggtaggaggctggaatggctttcaattattcatgctgaggctgctgctgtcacctgagacctgcagttcaagttaccagccccagggacgagcttgagctgcctcctacccttcaggaacctcaaaagatttacagaacctcagggtcttgatttgaggggttataagaggtatgagatctggtgacttctccaatactttggatcagaagatggggcatggggtgagccaaggtgatggggtgactgtaacatgctcattgatatgcaagttttctgtaagcaaggccatgccttgggctacagggaagagtcagaacctgtcactgtgctccaggaactcccaagtttggtaggtgagactgacccaggaacagagaatacaatatagtgtgatcactattggatgttccatgactacagggactttggctgttttgtgaactgctgcatatccagatataacaatgtgtggcacatagtagacgctcagcaaatatttgttgattcaataaatgcatgaattaacactggatgaggattaagcatagggagctgggcatgtccagagaatggagtcagagaaggtaatcaggaggacattgtactgagtctcgaagacagtaaagacagtaggcagaccaggctgcatgtacaaagtccagtagatcaatcaggaaactacattatttctctatgtccagtgaaacacattgctgacccctccacccctcaccccagaacatgcagtgggagaggtgtcaggctcttgttatgtcagacgggtaatgtgccaaaacaagatttgagggtggcacatttgatacatgctggtgaacacccaatcacacgctcatgaacaacaaatggatcactatacaatcttggacggacttggacctgtgttcagggcccaagggaagacatg

SEQ ID NO: 66176 - DNA, 4226 bp, Homo sapiens
cgtcacatccggtttagtgggcgggagcggggaaaacaaaaggagacgaaggacgcatgcgtttggtgagtcccggattctggtgggttcttccgctcaggctgggtgaagcgcttccgggtcgccgccggcagcagcctcccggcgcggtaagtacagacgcaaggctgcaaccgtctccttgccccttcattcctttttcccccagagaaacccatttcctttgacccgactccccaggagctccatattgagagtccttaacccttaaagagctccagctcattggccgcttcctcgagactaagccccaccccgtcacacaaggtccgtcattcattggtgtcacttcctgtcacccagcatttctttcagttaattggtcctacccaggccccgcttttttcgcgtttagcaaccctataaggccaaatttctgtctgagacccgccctgctttctttctgttggtcaactgcatggtcattatcgtaatgagcaaagaaagggcggtggctttgcgacggtgggttgggctttcggagccgagatcgctggtctgtcagtacttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatgttagttcatccattcaatcttccatctacttatttatccacttattcatgcctcctagaatgtcttactgaaccctgcttgcatatgctacaatccctccaccccgacatttggctgtgattcatgagaggtcgttagtgtcctaaatttctgacactgggtgggtgtggtatgggccatcataaagggtcaaaaagcaggttttagtgtgtggaggaggtagggatagtttcagtagaaccctgctacctctaattttgtataatttcataatgccagtctgcattctggattcctatccctacacttgactcccattctcatccctccttgaacagcctgcaaacagctttgttgatccattatttacttaattatcagaataactttgacagtggtataattgttattatccccattttacagatgaagacactgaggctcagagaggttaagtgactcagccaaggtcaaacagctagtaagtggtggagccaggactcaaagccaggtctgtctgattcctagggggaggggctgctttcctgctgtcttccaccctatccctaaatcaaattacaaccaaattaaaaacaaaaacaaagcaaaacacattcacttgaccctttccctcagtctaggagccatgtccactttgttcccctcactcttccctcgtgtgactgagactctgtggtttaatctggatcgaccctgtgtggaagagacagagctgcagcagcaggaacagcagcatcaggcctgggtgagtgagcagctagcacagcacagagacctcagcacagacagagacctccttcagtgggccatgacccagccttactccagaaatctacccaggaagagctttttgccctgagctgggaataatcgggctgggagccagggagccaaggttctcatcttgtggtaccctattttacaggggtaccatgtgacttctgggccagattagagcccaggctgctgacactcagcccaagctcttttccctaaagcacaggaaataattttgactattaattgaggatctagcagatgatgctttctaggctgataagtctctcacttcatcctcaccataattatacaaaaaaaagaaggctcagagagtttaagtatttggatcaagttcataaatggcagatgacaagaaagggattgtatctccctgagaactgggaggaagcttctccccaacacgtgtgggttgtcttctgggcagaatgggccagtcccatgcccctgacctgccctacttgggctctggccttgttcctctgtgcctttgcccacagctccaaagcatcgcggagaaagacaacaacctggttcctattggcaagccagcctcagaggtgagtggctctagcaggtggggcctgtgtgggggccgcagtggaccgaggctctgctctaattctgaatgtcctgtctctgacccagagcagttgtggttctcagatctgggtaaaagcctaaaaggggagatagaaggggtgggcattgggcctagcattaaggtcctgcagaacatgcaccagcctgctagactcaaggagggagtgtcggggtagggggtcattcattggccctagagagaggctcaagtgggtcagttcttgaactggtccatgcaggcctgtagggcttacaggctctgtcctgcccaccagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtaggcaaggggtatgggggagggcctctgttcctggacccttgctcctgacccagttgatggccaaggggtacagaaaccctggatccagccaggggcaggatctggggctgaggctggctgaggcccctccccacccacacccagcctcctctccaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttccacccatgtctattccctatttgttggtggggcccagaggagtccagcatcttcttttgggctttaggaagagggcactcaagggacatcagccacacctaattggctaggtgggccagagttagggaaggccagggcatccctggccctgggtccagggttctgtgccattttctctggcccagcttgcatccagctattcctgcagggcgtctaactcattgccacttcctctgatcccacccagaatggcatgggctgaggatgggaggctttctgaggccgagaactgggaggcccctggagctctcccatccagcttccttcgtgttaagagagaagattaaatctcagagcaaggtggggattcccttggagtcactcagcaaatcagtgacagagctgggtcgggagctcaggcttcttgctgtcagtccatggttctctctggaaagagggggcctagtgagaccaagcagcctgatagaacttgacacttgaggtcagtgtagaggctgaaagaggtcagaggtgggaagagagactccctagccctgagcccagcgtgtgtcaaggccccaaacaggaaagggaggggattttgaggtccctgcttgggtgggggtgggggtgggcatcagtaagtacccctgggcctggacctcagcctggtccagcataggtgagctgagctattccatccttgatggcagggaagtctggaaggccagtgtggtggaggcggcagcggtagcggccacagctcttagcatactgcaagaagcggggtgcaccagggaagagcacatggtcagccagcacggtggcacctgctggcagtagggcatgggcctccagcagctgcaggtccctcaggtaacatcgtggccggtgtgccaggagcaccaggtctgcccgactcagctgatactgggtgcgtaggcacgggatcacgtcctctgagctgcccacgatgagctccacctgtggggatagggggagctggaggtgagggt

SEQ ID NO: 66177 - DNA, 1052 bp, Homo sapiens
acctgaaggtgagactaggcaggtgggaaaggagcttgcagagtgatgctgctcaaaaggacaggaagagagcctggcttcagaagcagccacagcaagagagactactgactgaacaggtgggctccactgggggctggggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaaggttagtgagtgagcaggtccacaggggcatgattggatcctggaatgaatgaatcaaccatgagagagtgaatgaacactggaatcaatagagtagcagagtaatggattgtggagcaggaaagagagctgctgggtgggaattcaattccaggcttatatgagccctgctgtgcagtcggcctggagacagcccagctcaggccctgcctagacccctgtcaaggaggccctgtcaagaggagaggaggggcagcacgggggcaaggcaagcttgtgagcgggaaaggcatgtccactttagcgactggtatgtggaagatgagttagaggagacagatggagagaagtcataggaaataaattctgagcattttaggagggcccagacacctggtgtccagtggagtgaaggaaacagtcgcctcccaaaattcagtgtctgaggtcaaaggattgaagttctgtgatgaccaaggagaagc

SEQ ID NO: 66178 - DNA, 1041 bp, Homo sapiens
gtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcaggtgggccagggggtgatctggggtggtgagggactggctcaggaagaggaaacgaggacatggaaatgccaaaccccattcactggtgaactgaagtggaggagcccttcagtttgcattaatatgggtgactatttcacagacactgtgccaaatgtcggtacaatgccaacagttcaccttcttggttgttgagtttccgcattacagaaataaggaagcaggcccaaaggagagcctgggaaatgaagttggagtgacccatcctggggttgcttgatttagggatttagactgggaatgactcctccaaagatctgagggaagaaactgcacactgtgcatagtggcctcttttctgccagccctaaacagctcaagaagggagagtctctcacattatgaggctgtgtgcaaagcattcttttttttttttcctgagacaaagtctccatatgttgcccaggctggtctcaaattcctggactcaagtgatcctcccacctcagcctcccaaagtgtgggattacagaaatgagccgtacgccctcctgaagcatcttggttcatgcatctcgcaaaactttgggctgtgtctctcgaccacattggacctgaggtctccctataacatttattttgctaccacccctttaatatcctgaacatgatgatataactaaagaaaaagcagaggaaaagtaatttgtaggccaggtgttacggctcacgcctgtaatcccaacactgtgggatgtcgagatgggcagatcacttgagctcaggagttcgagaccagcctgggcaagatggcaaaaccccatctctactaaaaaa

SEQ ID NO: 66179 - DNA, 1872 bp, Homo sapiens
ctcagtgaggcttaatctgaccgcactattacactacaagtccccatccgtctctgcttaatttttgtccaaagcaaaaatcaggtgatgtgttcattgttgtaaccccagtttctacaaaagtacctgggtgagagtaagtaggatctcaataaaggttgaattaacaaattttgtaatgactgcaactccagcaggagctcccttttgggctcccactgtctctgacggccctctcccctaaagaggtcccaatagcaagtattttcctgggtgacttccagtgggctggggaatcaaggactaagaggggagacactgcatgtggaatattctggctgtgctggctgtgctggctgtggactgagtcctctgtcttcccccatccagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtatgcatggcttcctgcaggtacaagacctagcggagcagctgagctttccaggcatctctgcaggctgcaaccccagctccagttctattcggggctgagttgctgggattcttgaacctgagcccttcttttgtatcaaaatcacccaggtggatcagagctggcgcaaagagcgggtactgaacgtgcccctgtgcaaagaggactgtgagcaatggtgggaagattgtcgcacctcctacacctgcaagagcaactggcacaagggctggaactggacttcaggtgagggctggggtgggcaggaatggagggatttggaagtggaggtgtgtgggtgtggaacaggtatgtgacaatttggagttgtagggctggcagacctcaagatagttccgggcccagtggctaaaggtcttccctcctctctacagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttggatatgaatgggaacgtgactgttttgttttccaattcccattgattgaaaccagtgagactgggccaattcctagctctgacagttgctataaactagcctgatacttaactatttttctaacttaggagacattcgtagctctcaatttcattttttactattgctccaatctagagccaagcccaggaatttttcatttgtttgttttgagacagggtctcacccaggaatattttgtttgttttgagacaggatctcactctgtcaccaggctggagtgcagtggcatgaccttgattcactgtaacatctgcctcctgggctcaagtgatcctcccacctcagcctctcaacttgagactgcaaccatgtgccaccacacctggctaattttttttttttttttgagatggagtttcgctcttgtt

SEQ ID NO: 66180 - DNA, 1081 bp, Homo sapiens
gggcggcgcggggcggggcgggcggcgcggagggcgggggcgcgcgcggatggccatcttaagtggccgcctggagcccagggccgctgtccggggaagggggcgccggagcagcccgggaggtgggggtctgcgtgcggcggccgggatcccgggagggaactttctactagacgggccagggatcctcctggcttcggactgctgaaccccctcaaggcccggcctgcgggtgtggggggtggtgctggggaacttggccgagagggggaagggctctgcggggctgggaggggctgcgtgagaggctcgagaacgtcgcacctcgtctgggccccccgccagagtaagaatcttcagaagcctggttagccagggaatctccccgcaggctttgccgggggacggttcccgtggagttgggggttcagatctaagagggggctgcatttcgcaggagttgggggccccgcccgcttgggtggagggaagaggatgggtagggggtggtcctggatccttcgcaggtttggggaactcgatgcagccaagctgtaagggggacgagaggaagagccatggagtggaatcagacctttatggggcttaggggtcatatcattgggagaactgagaagcgctgaattctccagggggtgcctggatcccgaagtgtcggggccaggatggggggactcggatttcgatggggatttggggactggatctcctcgggtgaatgatgggggcaggatcattgtggggtctgggaggtcccgggcccttcgggaaggtgggggcaccgtccccgcaggaggagctgggggcaggggcggcccgggctgcgggccgagcggagggggagggggcggcagccggccctgcgctccgctcctgcccctcccccgccgcctctgaacaaacttttctttctcttcaagttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagcc

SEQ ID NO: 66181 - DNA, 1009 bp, Homo sapiens
gcctgggggtgacagattctggccctgccttggcatcaggtatcagaagcatgtgcacacgtatcgcattctgcctgatggagaagatttcttggctgtgcaggtaggagcttgggcccctgacccctgaccttgatccagcctagggcttggggacctgctggctgacccttcctcccacccttgctggcccacagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcaggtacttcccagtgtgcaggtcccctccctgcccctgtcccttggctctacctgcctcttcccatccccccttctcaaccccacctctcctgtaaccccctttcccttggccatgatgccggggccctttaaccctctttccatggaagtcactttacagctgcatcgtgcctcctactccactgagtgtgggaggcccaaacggctgcccactgacccctgcccacagatggggaggatgagaagcccccgctgcccccgcgctctggctccaccagcatttctgcccccactgggcccagcagtcccctgccagctcctgagactcccacagctccagctgctgagaggtgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctccactgacttcttaacccctccccaaagtgctcccaatgggctgagcaccgtctcgcacgactacctgaaaggcagctatgggctggacctggaagct

SEQ ID NO: 66182 - DNA, 1047 bp, Homo sapiens
gccacctgccccacctcacccgtaccctcgctacctcatgccggaggctgcacaggtatctgggacatccagccccatgtattacacccttacctctgacctgtcctcacctgcttcccggctgcacaggtgccctgatctctgatcctgaacagtgaactagccattgcctcttgactttcctcactggtagcctttatccttgtggtgaggttgaggctacacccagcgcccccttccctatacttaggtcggggtgggagttcttttgatctgatgtcttccctagtgaggtggacaaggtcctgtcaggcctggagatcctgtccaaggtgtttgaccagcagagctcgcccatggtgacccgccttttgcagcagcaggtagattgtagggagacctctgggaggtgcgttcgtgttctggagctgggtgggaggctctgcttaggtgactcatgtacaagcctggttcttcctccccccagaacctgccacagacaggggagcaggaactagagagcctggtgctgaagctgtcagtgctaaaggacttcctgtcaggcatccagaagaaggtggcatgatctctgacccttgacccccgattcactggccactgtcattggcctagcactgatctcaaccctcagtctacaacttaacattggccccaaggtcaattgtgtccctccctgccccagccttcagtgtgtcccctgaccccgccctgcccttgttccctccaggccctgaaggccctacaggacatgagctccacagcacccccagctccgcagccatccacacgtaaggccaagaccatccccgtgcaggcctttgaggtacatggcagtggggcctcacagggccaagggtggttggaggtgaccagggtgctgcctactccaaggtcttgtcagcagcctccccacctggcctacaggtgaagctagatgtgaccctgggtgacctgaccaagattgggaagtcacagaagttcacgctgagcgtggatgtggagggtgggcggctggtgctgctgcgg

SEQ ID NO: 66183 - DNA, 1067 bp, Homo sapiens
atgtcacagcgtctggtgggctcagcgggaggatcctctcactgcagctttgagaggcagaagggagagttgggagccctctgaggatgacccaggccttcctctcttgcttgccttaacagggaacaagggggctgtgggcgtctccttcatgtttaatggcacctcatttggctttgtgaattgtcacctcacctcgggaaatgagaagacggctcggtgagggggcgcctttcccatggtctctttacacccatcccattcacctgaggcctgttcccgctcccataccctagcccatgaccctcccgcaggcctgtctccagagaccccctgctctcttatcccaattcaagacccttctgttcctgaccctaaccttgtccccaggggcccggatctttaccccatccctgactcctgagacttcttccctttatgcctatccctgacttctggccctgaccctggggatctacccctccccaccacgcacccctcaccctaggaggaaccaaaactacttggacatcctgcggctgctctcgctgggcgaccggcagctcaatgcctttgacatctctctgcgtttcacacacctcttctggtttggggacctcaactaccgcctggacatggatatccaggtgcgagcagggccctgccatggctgtagggaggctaagggccacatgggctatcacccctggctctggctccggaggaatgtttctagcctttgtgtcctccaccccaggagatcctgaactacatcagcaggaaagagtttgagcccctcctcagggtggaccagctcaacctggagcgggagaagcacaaggtcttccttcgattcagtgagtgtgggcctggtaggtggtgatctgagggctaggagacttgcagtatccctgggtgtcagggccctgaaccccacctgtctcctgctttccttaggtgaggaggagatctccttcccacccacctaccgctatgagcggggttcccgggacacatatgcctggcacaagcagaagccaactggggtgagccaagaaaacggcatg

SEQ ID NO: 66184 - DNA, 1086 bp, Homo sapiens
tgggaggcaagagggtgcagtcagccccctacttagggggaaaggaagctgagaggtggtgctcagttgggtgtctcccacccccaccccagaatacaagaagagctttgagaatgatgcccagagcagtgacaacatcaacttcctcaaagtgcagtggtcttcacgccagctgcccacggtgaggctgtgggcagggcccctgcttatgggtgagggcacagagaggggtacataagagtttattggagagcctgcctgggagggagtgtggggccagcagagagagagagagagagtgtgtgtgtgtgtgtgtgtgtgtgtgtgtgtatgggcatgggcatgagtgaggataaaggcgtttgctttattttgggagtgtggaaccttgttgcagtttgttcattcattcaggagatgcttcttgagcttttgctagatgtcaggtcctgtgttagctattgagaaaattaattagttacagtgatgctaggtgctgtaaaaggcctgtatagggctgtgtcttctgcattaaggatttggctcttctctgaagagttgagtgtgagtgagcacagatgacctgagggtggggattgagtggtgtcagggggcagcgcgtaggaggggcaggaggaagtggcggggctttgttcctcactgggcctccctgcttcccagctcaaaccaattctggctgatatcgagtacctgcaggaccagcacctcctgctcacagtcaagtccatggatggctatgaatcctatggtgaggggtgaggggtgctgaggggaacaggaagccagacagggccctagattagcttggtaatttgctggtttgtcccatctgctcctcaggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacggtggggactccactgggacatgagatagggtggtgtgaacagatcaaggagggcagggtgcggggggca

SEQ ID NO: 66185 - DNA, 1058 bp, Homo sapiens
agtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggtgtgtggagcagggtggctgtctgtgtgtgcctgagtgtgcttgcccacagactggtaccctttcactccaccattcagcactcatggtgtccctgctaccctgaactgatcactgggaagttgggagacacatgtatcagcccagcccttcccttccttttccccagagcatgcagcagaatgtgactgcaggtgtttctatggggggcactcagctccccctgacatgccctgtttccttaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgcctccttctggacaccctgcagctcagcaa

SEQ ID NO: 66186 - DNA, 1058 bp, Homo sapiens
tgtgcctggatccttacccctgcattattctttgccagagatatattttaaaattttttaattgtcatgaaagtcagcttgggtttaaaaataaataaaaaaatttttaaaaagagggagaaggggttgtcgtggtggtggtggttaaatagctgatttatttaatgtgccaggcactgttccaacacttcatatattttaattcatctaatcataaaatgaactaatttaagctgggcatggtggcctgtgcctgaagtcctagctactggagaggctgaggcaggaggatcatttgagtccaggagttcgaggatgcagtgatcgtgccactgcactccagcctgggcaacagagagacatcctgtctctaaaaaacaaacaaaaactagtttgcagatgagaaaactgaggcacagagaggttgaataacttaccctaagtcacacagctcatcaatggtggaaccagagttgaaacccagcaaccaggctccagaatttgtcatcattcttggaagtgaagctgtcctgctctgcaaggaggcttcacagcaagattgcagtgacagtgtttcatgctagagcatttttagctcccccaggagtacacacattttgggggtggaggccttagtcaggatgagctccccatatcagactctcaaccaccagccgttctggtatgaagcccttgcagagtccttcccactctgcctgtctccttcttctttgatggtgagttctcaggaagcctctttgcctacccctatcacacatgcacacacacacgtgcacacatgtgcaggctggcttccaaagttccctcacctctgccatctgagagacctgtctatataggtctgaacccagtagtggacatggtttaaaacacttccttggaatgcttctcagctcctatgctgatcagcagatgcaaatggatgcctgcagagcagaaaccccaactccacatcctgcggcctggaaaggccagttcctgcccagctaaccctgtagcatcttacaataaagcttctaatcaccactaccatttgt

SEQ ID NO: 66187 - DNA, 1004 bp, Homo sapiens
taaaaatacaaaaattagccaggcgtggtggcgggcgcctgtagtctcagctactcgggaggctgaggcaggagaatcgcttgaacccgggaggtggaggttgcagtgagccgaaattgtgccactgcactccagcctggtgacagagccagcctccgtctccaacaaaaacaaacaaaaaaagaattacttcttccagagattctctgccagaactcctaggtggtgttggacccatatcttttacttccatagcatcccaggctcagctcacttgtcctacttgttctgtgtcttcatcactagaatgtaagttctaagagggcagatgccaagctgttcagccattcacagaacctggcacagtgcaggcatatgacagatgttcctttattattatacttgggtgagtggatgggacctgcagcaagtgcagatcttctcagtgggctctggaacagaaaagtattgtttgtttgctcagcatatttttatttgtcccatgttgctgtggccaggatttgagctctgagacaatgcagcaaggtgagacccagatttcttttgttttgttttgttttttgagacagagtcttgctctgtcgcccaggctggagtgcggtggtgcaatcttggctcactgcaacctccacctccagttcaagcaggtctcatgcctcagcctcctcagtagctgggactacaggcatatgccaccatacccagctaattttttttgtatttttagtaaagacggggtttcaccatgtttgccaggctagtctcaaactcctggtctcaagtgatccacccaccttggcctcccagagtgctgagattacaagcgtcaacgactgtacccggccccaaattccttattgaggatcctagaatacatgagaccagacttggaaatgaaagtgtaacatgtttattgttcaaaaagaaaaactcaaaggtgtgtagtgattttaaaatttagggaaattcctcaatatagtgaa

SEQ ID NO: 66188 - DNA, 1847 bp, Homo sapiens
cctcctgaaggaggtgagaactgagagtgctaaggcctgcccaggcacatagctccctgactgtacactcccttccttcccttcccagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggtatggcggctgacctgagcagtctggtccagtgaccaagccaccagcctatctcctggggaaggatgggattggggccctgggcccaggtgaaggttctagtgggcagctctgtccctagctgacactgagcagatatcagacaccataccaagtagtgggggttgagacaaaagagacagagaccccacttcaagaaagcctcaagtctgttgggtgataagagggctccaggcaggaatggacagagctacaccagggtggggggccagaagctgctcagtgtcttaggggactgaggagatgcacatgcaagagacacagatgctttggtgcaagaaggggacagcagatcgaaaactctatggcagtggacacagccttgttcacccagggcagcttcctgcgtaggtgggccatggagagtgctgaaaaaaaggagcacatccggcaggaagctgtgtctgtcaccttttccattcaagatcgagccctgcagcccccttcctccaagtcaggactcaagtcttaatcctgacgtttcctctcctctccctccctcacacaactcccaccctgaggaatcgcagacttcatacacttgagagctggaaaggcctccgaaagtgcctggtcagaggaggagaccaggctgaagcccagagagccttagaccttgaccaggaccacacagatggacaggaccagggctctttccatgggcaggccaaggggcaggcacagcccccaaagttccctgaatgtggggaataagcagtttatgattcttctccacaggggatgtccagataagtgacaagatcaccatctcaaagaacttcaaggagaatgtgattcgccctatcctgaaagtaagaggtctttcttggcacttcctgctggagcctaaggttgggggagggtgatcttagccatcctaaagatctggaagccccataatttccccagtcttcccctggtgtctggtaatttccctaacccgctctgggtcactgagctcatcccacccctaacctggcccttcaggctcacttccggagggatgagtttctgggacggatcaatgagatcgtctacttcctccccttctgccactcggagctcatccaactcgtcaacaaggaactaaacttctgggccaagagagtaagagggaactgcccatgggtgggggcgggatagccagccactggaaatctggaacactggactgggggcacccccacacacataaaaggtggagcacagtggtgtggggccagtggccctggcctcaggccagagtggcaagagatggaaagcagtgggccacatgcaggcatgcttctatctgacccatctcaggccaagcaaaggcacaacatcacgctgctctgggaccgcgaggtggcagatgtgctggtcgacggctacaatgtgcactatggcgcccgctccatcaaacatgaggtgagcacaggagcctgagaaatgaggcgcctccacacctccctccccagggccccccagacccagtccctgagctctcagcctgcctccctatagcttggttgctggatattcacacccagagtggatgcc

SEQ ID NO: 66189 - DNA, 1052 bp, Homo sapiens
tccattgaccaaagctgccatccaggtttactcgatttaggctctttgaggatgggcccttgtcatgttcacttgaaccattcccagagcccacaaagtcaggggaaatgttgtattgactaatttaattcaacagtagttttaattcaacagtagttagcaaaccttcaaagggttagtaagtgctaggtgaacagagtggcggggctggcagtagaaacctaatgtataaaagtacagggcatgaaacaggctggcatgctcagggaactgcagctggtcagtactgctcgattgcagagggaaaacaaggacagagtgctagagacaaggtaggtaaggtaaacagggcccagttaaaatgccaggcacagaagtttgcatttctctggtagagagtaaggagccttttaaagactttaagcaagaaagaaacagtcaaattttcactttacaaagatgccgtgggcagctgtgtaaagaatggatgagaagggagagggtcattaacaaggagactgctggggagcccaagctacagctggggaggccatgggctggagaaactactagaaggttgactgaggagaggaggaggagccaagggtggccagttggctgctgccagttggccatcagctaaggcggcgaacacagtgggaagccgcagattgaagaggaaggtgaggcactgaggtgtggaaatgttgaaggtgagatacctgagggacatccagatggagatggccaaggggccgttcatcagttttatgggtcaggagtttaggaaaggtctgactgaaaatagcagttcaggaatccttcagcccagagaggttaacggaagccacaggaatggatgaggtctgtaacccagggagtgtataatgtgcagagaaaagagggctatacacagagccttgggacctatcagggaagtcaagacagactcgccagagaagtaggaggcaaaaccaggccaggcatgatgggtcacacctgtaatcccagcactttggaaggccgaggtgggcagatcacttgaattcagg

SEQ ID NO: 66190 - DNA, 1829 bp, Homo sapiens
tctgtgggttccccttatagccagcctttccagagatcctgggccagttagtttagacaaaatctggattcttgcccaggagagaggttatactgagctttttctcaggcctctttcaggattctcagggagcattttctgggcaggcagaagtggctagtctgatgtccatgaatttgcacagcttccatctgtttctactgaggccagaagtagagagaaagtcgtattttaggcaggaacattagagatcgagatgagaaagaccactggcttgaggctgaactcctaaaacagtattccagaccttcacagtctggtcccaccccaccactcctcatgatcattcctgtctctccacctctgacatgctggccacctttgcctcttcaaatcctgcccatcctccatgatccatcaccagtcctgcctcttccagagaaccttcccagacctctgcagtcgtttctttgaaatccaaccacacagtatagtagttaggatcttggcaactcaagatgggcagacacatcccaaacactgtcaaatctttccccattgactagtgttccaggccttgttctctgacatctatcccttagctaattttcccctgacaccctggggaccagatcagacatgctgttccatttgcagactgaccttgacattacacagtactctctttcctgctcctgactgccgtgtttccattagtgcaaccaaaattcatacttttttgagcagccatatgttacttttttaaaaaaagacgacaggtttagagagagaagcaactctgccatctactagttgtgtgacttgggcaagtctctatctgttgcctcagtttcgtgttcagtataatggagttgagaatactactttcctctccgggtatttgtgtgggtcttgaatagatacgttgttggtgaattttcccattgtgcttagcatacagcatgttcagtgcatgattcttcttgcagttctgcctcactccacccccactcgtatacttgagaatgtttctgagcctgattctcctactccataattaagcacttagttttctcagattgaatgcatagcccttaattacatacgtcctcttgaagaggaggtcaggtcttgctctagcagagttgagcctccaaggaacctggtacctatctgtcccactccccgtgctccccactccctccaccactggaggctatggtcagcatctctggtaaccatgtggcttaccccttccatgccctgagctccacattgcctttgattgacttccagaaaatgcatttggctgtgtttccactttctgacccagacagtggaccagaccttagcttccccagacaggaaagagtccagggctcacaccccacatccccaagggcctgccatgggcttctgcctcttgtatttgcataggaggcggcccgtagtcccactagcgatgagtagatgagtaaccagtgagagcagaagttcctctcgaattctccttcaccagtcccccacccccttcacctccattcaccatccacccgcctttcagtttccctagcaacgctgagtgctcatcctggaaaactttatccgaaatctgctctgggcagctttccaaatccatgctaacctgattacgtgtctctaggggccttgccagctaatcagattaggcagcactaatggtagtgaggactttgagtgggcgcagagcagtaaaacatattgtatacttagtgataattatcctgccttttgtgtcattgatttatctgcctccctccctgtcccctgatcttgtgtgtttggccgta

SEQ ID NO: 66191 - DNA, 1027 bp, Homo sapiens
agggcacccaggacacccagcacctgctcccatggaatatggtcagattgggggcacaccctccctgccagacacaagggcacaggtagatgaaacaccttacactgcccgtctctgagcctcggtatcctgtgtaaaatggagataacacctacttatcaggattattaggaggatgaaagagttactgtaaaataccaaagctaatggtaactaccattgctgctgctatgactaccattatttttactcttattgttatcccactcctcgccacttacaaattgctttcatcaccattaacttgtttaatctgcatgtggggctgacacagtatatgtgactgttcccattttatagaggaagaaacggaggctctaaaggaataagtgttttatttaaagtcagtcagctggtaagtgacagaggcgggactccatgctagatcctgtaactcctgccctctccactataccacccggtagatgaatgcatgccagagaatacagacctgcaagttaatggctagatgtggtgtggtggagtgaatcaaaaagagctgttgcaggtgagttttcagatggtccagtagtgacaagcatggccaggagaaagcagaacacaagccaggtgggcacccggcactacctgctgggaggcagagcagcctgcctggagcttgtggcgatgggactggccagagaagggagccaggctgcctgtgcagagggccctgacaccatctctagcccaagagcagtgaccaagacagggttaggggacaggggctcctgaggccatgtgctgaatggctgagcaggccagattggaagactacagagaacgttttccaaggagtcagggtgtgaggaggtgctgtggcagcggagagtcagaggaggagagctgaccttcctctaagctcccatagtacagcgcaggctcaggctaagccagaactgagggtaaagcccagggtctttgtttcttccccctgtaaccttaagcaggtcacctaacttctgcg

SEQ ID NO: 66192 - DNA, 1062 bp, Homo sapiens
gacagagtgagactctgtctcaaaaaatatatatatataaaataaaagaagtcagtcattcatttcatatgttttttagcacaaactctgtgctaagcattgtgaaaagagcatgaagcagtaatcttctgcctgcctggcttaatctcagtgtcctttacatttttatcaagaagtctgatccattttctgaggttttagtgaattggcatagatatctgggactccaggctggggagaatcagaatgtactgaaatttaggccatggtttgaatctttcccaagaccatctagaaagctcctggaaaactaaccagttcacggtataactctccccaccccacctgtcacctccatagaagtcaaggagtcctttcctttgcccaagaaataaacaggaataccaaacaacctaaaaccatgacactgaagaagagttacaggaagtagaagtgtttccccagagaagactcagggaggccacactggtcatacccaaatcaacaaagtggaaagaaaagttatgttagactttgcctgtggcaaagggaaaagatacgttatgtgaggccccacagaccaatggatggaaggtacccagaggtggaattctctatcacgtaaggaaaactgacagcaaagatgagccacctcaggcagtggaggcacctctagagccgggtgagtgttgagactgcaccctgcagacctagggttcctagagatggagcctcgagagccgcctctggggcagtggtagcaaccaagtggactcggctcatggcttcggcttgagccagggtaactcttcttattatctgtggaattccacccacaattaaattagttaaaggattccagtaccaaaaacaaaaaggcactagattagacagtctgttatcaaaatgcagtgaaggagaagaggagtcacatttatcaaaggtttaataagggttaggtagaaggtagccattttggtcactcagactacctcttaatgctatgtgccagagactctgctaagaacttatatattaatgcattatctcatttaatcctca

SEQ ID NO: 66193 - DNA, 1016 bp, Homo sapiens
tcatgaatgaatgtttatctgtatgctgatatgttggaaaatatggacattttaatgaatacatgtatgaaattgtatgtttacatgtatttgtgctgcggtatattaacctgtgtatttgtttggcatactttcttagcatgttcaactgtgtgtgtttgtgtatgtataacacatctacgtgtgtgtagtatgttatcgaacatgtgtgcatgcacatgtaggagccccagtaccatgtttttccaccatttgtaggtgtccatggacattcccaacatagaaatcagagccttaagccacctccaagggaaggctgaggtcccactgatcgttcatagagcctctgtttatccttcttctcttgccaggagccaaccccctgcagaggaatgaaatgggacacacacccttggattatgcccgagaaggggaagtgatgaagcttctgaggacttctgaagccaaggtaagtctcagggaagggaggaggcctgtgggtactccatgcatcatttaatccttcactcattaaattatgtcaggctttacaccaaaggccacttctccttaggtgattattatctgtttaaatacagatattatctgtattattatctgttgattattatctgtttaaatacaaatccagcccccagtctcatcaagaataggaagctgcccctatcatgaccagggagcggccttggccacttctggcttctgagcattacctttaaatttggtttatgaagtgatggatctcccaggtccttttcagaggagggggttctagccagacaaaatccttagcccaagcaaagattttggtcatatttttcctaggcctcatgtattctacagtctcatcaaacaatcttttcttatcatcattctttctagaactattccttcacccctcccctccacacacactccagaaagcctagtatagaatctgagccaaaaaaccctccattctaattctgttttcccaaccaaacttttgaactcct

SEQ ID NO: 66194 - DNA, 1032 bp, Homo sapiens
agacatgctgccctgaggctccagaaccttggggagccttctccgtgaatggtcaggtggagcctgacctgagagcctcctgggctggagacaggcgccgtactgctttaaaaggagcccctgtgctggctggcccaggtgcagagatgtcctacctgtccccatcccatcctttatgagaagtgacacgactcctactagaaattactcagtggccaatgtttatggcacacatttttcattctgtaagcaaatatagatcactgacagcacttgtttgaagaggctaatctcactctgttcgttcttccactgtcttcctctgtcaccttctctcctcttgcccctcctcttctctctcccatttctttcttcctatccaaagcagaagctcttctctttgccattcttccccttccagaggtctctccctaaccctcccttccactgcagctcatatctagtgacagagctccccttgaggctaagaaaggacagacctttccactgcttctttgcagctccctttctgcctccgttgtggtttagctctgcggggaggggaggatgctgtctgccactggctcctcagcccttgcagagccgctcagtgctgagcgccagagaaagcaactcagtggggctgggccaggaaggctaggctaggcgaacaagtccctgagcactttgttccttcctgagccccccagtgccgcctgtccctccttcagcacactgatgacactcagtctgtgacctcctgtctccatgagctcctggagaggtggaattgtgctggactcgaactctaggtagcacctaataatcttaaagacaggaagaggagtctgcaaaagaaacagaagaaatggtcacaagagtgggaagaaaacctgaaaagtggttttatagaactcaaaggagagagtggccaaggtatcagttgctacagaacagtcgtgaaatataaagagggaaactattcattggctctgccaatccttcatcatcctgcacacagaggcttgcaga

SEQ ID NO: 66195 - DNA, 1121 bp, Homo sapiens
ataagagcaaaatgtcatgcacaaaaatgcacaaattctgtttcactgtacacttacattctcacagccagtagtaagtttaagcaagtgatttggccttgattaaactgttactggcctttagtaaccaaacgcatttttgaatttccacaggaactctgacttaatctaaactaaagccagccttccatgtgctgaggtctgtaatcaaagcacaagatactactgaaataaacttgtccatctcccctcaactggatcaggaactcctgaaaagcaagaacagtatcttcttactcacttttgtatccctagcacttaccatggtgccaaacacatagaagactcaaaaaaatatctttgaatggataacaattaatcttgaaaaaaaatctgtaaaccagtatataagtaggaaacctcctaagcggttgtccatttaatgcttgaacactttcagtgctggagaactcagttgctcttgaggctgctcatattctattttcggatgttcccatggttagaaatttagccaaaatctgcttctcagggttttaatattacccttggattcatgtagaatgaatctaatcccaatttaacatgatggcccttgaaatatctgaaaatgtccagcctaaaccctctacttccttaaactatttttctcaggtgccctctaaaccctttcctttctcaatcacatttcccagaacaatcctcactttctcttccaaacctatgacttcctatttatttccactaacttgcatcatatttgctttagctcttaatgtcaatcttccatctggtgtatttggtacccttcccaccttaattacatctgcagatttgatgaggaagatgtccctgtgatatccatgtcatagataaacatgctgaacaaggaccaagtgtttgctgccagtggaaactccttccagacctctgatccatcagtgacccacctccttgggtctggttagtccatcagtcatttactagcattccatgtggtactggcatccagcccacatttctccattgtgaccacaggattatcctgagacatcccatcagatgtctcatgaagtccacatttggcctaattgtacctgatt

SEQ ID NO: 66196 - DNA, 1046 bp, Homo sapiens
tgctggtactcccaggcagaaaggggagacaaatgagcaaaatagagcctctgccctcaactagcttaaagtccagtggtatagacattctgggacaaatatagtcacactgtgtggcaaagaggtcacagcactgccattatgatgtagacatcagggactgtgatccaccccagttctgccacatctcacccttctctaacatggcccttctctaacatcacttttttcctctataaaatcatggcccttctctaacatcacttttttcctctataaaatgaagaacttgtgtcaggtgattgaatactaaaggtttcttcttcttgtttggattcaaatgttaaagtccctccatgttagcagttatctgggggagggatggggagagattgctaatgggtacaaggtttcttctggagatgatgaaaatattctaaaattagattatggtgatggttgcacaactctctaagtatacgagaaacctcctctaaattgtgtactttaaatgggtgaactttatggtatgtaaattacatctcagtaaagctattaaaaaagaaaagaaaaaaatcctccatgcctctcaaaaccagaaaatcttgtcttggatgtctgactgattgcctgaaagcaggctggaaagccaggaggaccagatcaaccccacagctagtgtggtagaggagatgagcccctctgttgtataaaacagtttccttttaaagaatatcattaaaaaatttgtaaacctctctcttcccttcctttttattgatttcctgttattattttaacaaatatgtattgcatccttgtaaagcttaaagtctggtagaatatagatgttaggcaaataattacaaaattaccagctaattattagctaaattgctagctaataataaaagtattattaaggaagaatagagggtactataagagcataatgggacctaatctagtccgaaggggaatggaggaagtcttccctgagcatatggcatttacactgagactcaaaatgtggatgttagcctgtc

SEQ ID NO: 66197 - DNA, 1061 bp, Homo sapiens
ctaggtttgaatcccagtttacccacctattagctgtgttgccttgggcatgtttccttaattctctaagcctcagttttcgtacatctaaaataacacctgtttcacaaggatagcatgaggattggtggtattttttatgaaagcccctggcaggcacatggtaggttccctgttataagtacttatcattgtgacatgtataaagaaatcaaactctcattctggcagctgtaattccattcctccccaatatagaacctttactcctaccttaaggcctcttaattctgtctttacctacgatattcccatcctgcctaaagtgccatcatgttccctgttttcttatctgaatcctcagactcttcaaggcctctctctcttaagaagcctttcttcgtcgtctggtctactccgatacttcctcctccaaacttgtacagcattgtacagcttagcacagactgcttaacgtcgtctcattttcgggagaccctgtagcatagtgaaaaagaaacaagctttgaagtcagacctgggtttaaatctcagccttgtcaagtgaccctgggcaagccacttgccatctctgagaccatgggcctcagggaatcctaagacagatcaggcaaactgtcactgaccctgagaggctctcacactgtcagaggagatagatgtggaaacagaccatgataatggggtaggtgctctggcaggcgcctggacaaggggctctggggacgaacagggggaaatgatgtcttctgcctggtgatcagagaggtagaatcagttacagaaggcttcccagaggagggggtgcttaggccttatcaggaaggatgatgggagtttgccagagttctccagaagggttttgaattaactagtgccagtcttctactcccaaccgccacagaaaagtacagagaccctcatgttttttaccttggaagatgctgcttttgcctgtgttgatggcttatcagcaggaaggctctgcttcagcacttgaatgcaggtgtggtgggagggagggaggaaggtggggaaga

SEQ ID NO: 66198 - DNA, 1964 bp, Homo sapiens
aagcagagctaatgaaacaaaggacacaggctctttaaatccctcctaacccaggtcacaaagacatcctctttggtcccacccccgtctcaggcccctttcattactctgggtcatggcaccctattcttttccgtcattacacttgtcacaacctgaaattgtttttatttgttcaatagccttctccctaacttgtctctgagcttctaaaaggcaagaaccatggctgactggttcaagtgtccccagcatctactatagtacttggcacttagtaagcactcaataaatcaatgaataatgaataccctccctttggagaacatcagttaattggagagacaaaacatgccatccccagactcaggctgggcaagtcctgtccaagtctggtagtgctacctgccagacacatcccagtcactttctttcccacttccccatatcccactcctgcctctccttgggagagtgtgggaagcatctggccaggatgtgtggagcacagacccctgagtgagtacatggcacatgactgcctgttcatgcctcctctggtgctttttgagggccagggatcctctcttggggctagaccccagggtcttccttgttgggatcattcttcatagaacctgagcactggaaaggtcctcaaaggtctctgggccactctgatgattgcctgcctctcttccagcagaaccctctccaacagctggctagctgacatttttcagagacagaaggaacctccttcttccccagggagactggttgaaacctttttttttttttttttttttttttctgggacacggagttttgcttttgttgcccaggctggagtgcaatggcacaatcttggcttaccgtgacctctgcctcccgggttcaagcaattctcctacctcagcctcccgagtagctgggattacaggcatgttccaccacatctggctaatattgtatttttagtagagacagggtttctccatgttggtcaggctggtctcgaactctcaacctcaggtgatccacccgcctcagcctccctaagtgctgggccactgcgcccggcatggttgaaacatctttttaatgagctgtggtcttctctataacttatgccaactgtcttttgctacctagtcacttttccaaataccagtcttcaaagaaagttctttcagtcccagagcctttgcctccacaggcccagcatccccagatcatcttctcattggcctctgggaacttcccaggaacacgcacgtaatcttgccactttctgtcagccacagccatgctagcttaaaacccaggcctggcctgtatccccaagcctacaagggacctgccccagagcagccagaatatgctttgttctagggcacagccactgaagggcaggactacttgtggatgtggcagcagttcttgggatgactgatgcttctggagcgagaacttgctgttctcagaagcagagacttagaaaacatccccaagcagaaagcttcttcctttgtccgttggaaaactctgtggcaagacatttgtagctaagaattggagtgttcaccaaggacattatctctgccgtgccttaaaatcaatcaatactcccagctattgtccagtagtttacattctctgcttcccccaacccccagacaagagaattcactttataaggagcccctcttcctagccttctagatcgaacacctttgaaatgaaaagacgagggccttttatgaaactccctctatcctcacccccaggccaaggctggccctttgagccgttccaggggcatggttcctgcctgttgacttggaacagatgcccttagcccccacctttacatttctcccacctgcctttttagccagcatacatttacaccccttgccctagcctcccagcctcaagggccaaaaccattaacccactat

SEQ ID NO: 66199 - DNA, 1029 bp, Homo sapiens
agcagtgggcctcctctggacattccttattagttgggctatgacaccagcactctcctgacgtttgtgccaaaatagccccagctgtgttccttgagttcatctgctgtttatggtaagtaccctgtgtatagctctgtcattgcacatgtgaaattgtattatcatttgtctgctcagtggtctgattcttgcattaggatgttagcttctgaaagtcaggaactgtgtcttatttattattatatctccaggaactaccaccatgcattggtgctcattaaatgttgaatgaatgatgtgttttctttgtaaaatggattacacctttcctgctttcttgagccaactatcacttttcgtcaggttcatcattatatccagcagttaatgtcctatgtggcagttcagtgatgcccttaggggcttttgaggtgctgtactctgaattcctttttcagcttttcattgtcctgttcttttccctgcctgcctggccagtgcttgattgtaatcaatctgcttggttctgtagcatcctccctggccttcttatttccttctcctaatctgcagtgggctggaaataagatcacctagcatgatttgataagactgtaactaagggctagtaatctctgattgaggtcctaaacggctctcttatgggaaaagtgtagatgccattgcacatgggacttgtatgttagaggccttttaacttcctgttcttcctgctccaggaaaggtcagataacactcctggggcaggagcagggggttcatcagtctggagaggccatgtcaggagtagaaggctcattgaccattgattctataaaccacaagaaactaagaaactgttgtctgttctccagctgcacactccaccaactttattttggccaaacatttgaaatgcttccatccacattaggttatctgagtgctagctacaaacctcaggccattttctgttaagggcaaattctgcagagagtgagtttgcaccttcacccaaacaggaaa

SEQ ID NO: 66200 - DNA, 1223 bp, Homo sapiens
gcaagatctctctacctttttttttttttttttaaataattctagactacctttgtctgccacagttttctggcagctggctttattttcctgggtgtatcagtttggatgtgctctgctgtccaacttggtgcactgaacgttccgacttggacctggatagtgatagtcttttagaatcttctcagggctcttctctctcatcagcctaagcctttagcttcgtcttaaccatgtctttcctttttccgtttaaggaaacctcattttttaagccattcaaccaatatatattgactgccaattgtatgcaaggcaccatacccagctctgactcattctcatggatgaaatagaaacaaaagaatcctgtagttctcttatttttgtattgcattgacttttgcatgaaaaattacctgacttgtagggatgggtaaggaaggtagagtaaaacaagagatgtaattccctttccttcgagtgtgtctaggcaaattcacaggaagttcacaagctcaggaaagttgggcagtcctttgctgttatattagactatggagtcactgccaagtccatgaagtccactaaatttctaatagatatttctgtggcccttggaaggaaggtgtagtttgtggctttggcaagacctctctaacctccaatgatacattccttttcttccgtatcagtattgttgtgaatatcaagagataaaatatgtgatatgtggattgtaaagtgctctacagttgtaattgcttattagtttcatttatgcataattcagcgtgttcttaccgagtatcaggcactctgccagttgctgggattatataaatgattatacatagtctagcccctcatcagtgctcccagtcatttacagagacaagcctgtaaacaaggaatcacaacgcagagtgataaatgcaatggtagctgcacaaagtatgtaggcagcactgctgtaagtattggtgagctctacctgagaagtgagcaggctggtgtctgggaagtgtcacagggtaagtgaccttgaattgggtcttaaggatgagttggagattgccaggaaggctaaaagggatggaccttccaggcagagggaacagtctatgcagaggcgttgggtgggggttagggagtgacagcaggtggaaccatctgctgcaggattgaggagaataacaagaaataaggccggagagtgaaga

SEQ ID NO: 66201 - DNA, 1208 bp, Homo sapiens
cagagtgacagcctgcatgttctttacctctgtggactcatggagaccccaaagggcttggaacagctgcctttcacagtcccctggctctaactttatgtcacttcaaaagaagtcttggggaaagaaatagaggcctgatttcatgacctaattgcgggtaggaagtacatttcaactggtgttttcctgaaagtgcttcagcctggagagccgcagatgagtggacaacggagcagatttcagtaaaataattaaggcaactgcatggaatgtggatttgttcgtctcctgtttcctgcagacttaccttgccccattcctgccccagaactagacaacagcctcactggattcctcagcctcagaagtccctaaatactattactctgaatactgcttttccccctcctaaatgtaaattgcagtcctgtctctgggactgtcccctcaacttactctatgatccaggacaaacagtggaccttctctgtgttttgatgtctatcctcataaaatgaggtcatcatcaatgcctcctctgggatgtctgggatgttgtgttggtggtggtttgaacttcagaatgaagaggctctgggatgagtcttggggattgaatgtccaaggcaggtgtttgggtttgcactagggctcgatcatgtgtctgttggggggtgcctcagcaagtcagtctatgttgtgtctggtgagtacttcttccaaagtgggattgaaaaaaacagctggttgctttggctgcagtcagaaatgagtattttacatttgagctttcgtttatccagactgtcgccactgctttccccttgtcctggatcattcacagaggctgcgatccctctgacattgccagcaatagggtggctgagcagtggctgctttagtgttagcagtgatgccaggaggacagacagcctctctgactgcctgagagccagaatattgacgctgggggaaattcagccaaggggagcaatgtgctcagccttcagagctgtaaggctgccagactgacgtggtatgtggtaactcagagtagcggtgttgttgctgccccggggagaaggtttctcaaatcagtggcatgagaggagtgtccaagagcattaaggcattgctgcccaggtaaagtttgaagttaccctctcccttcccttccacctctctaaacctgctccttctcttaa

SEQ ID NO: 66202 - DNA, 1011 bp, Homo sapiens
atccaaaggaaataatcagaaatatgttactaaaatatttaaaacaatctattgttttatagtagggattggttaaatcaagcatggaatagtcttatagtggaatactgtgtagccatttaaaacaatgtgggtttttttattgttgtttgtttgagacggcgtcttgctgtgtcgcccaggcttgatgcagtggcgcgatctcggctcactgcatcctccgcctcccggattcaagcgattctcctgcctcagcctcccaagtagctgggattacagacatacaccaccacgcccagataatttttgtatttttagtagagacagggtttcaccatgttggccaggctggtctcgaactcctgacctcaggtgatccagctatcttggcctcccaaagtgctgagattataggcatgagccactgtgcccagccagtaaaacaatgtaatagacatataatacatggaaagatgtatgtgcattcagagagaaagtttatatatgatgccatttttataaataaaagtatgtatatatccattgaagaaactggaaagatgttatatgttctaagacgttttcttcttttggttatctatattttctggttttttatagtgaacatgagcccttttttattagaaggaaaaaatgtattagtgggaatattacataaatagcaggaagaagggaagctaacatggagtccctgcctctggtcatactccctcttcttatacagccactggagtgatttttgtaattgcaaaggtttggaaggaaacttgccaatctataaacagtagttactcttggaatttggactaaggagatgcatgtaaggggagacctttaatgttcccatgtgcttgagaagaatgtgtgttgtactgctgttggatggaatgttctgtataggtctgttatatccatttagtctaaagtgtagcttaagtcagacatttccttattggttttctttctggatgacctgtccattgctgaaag

SEQ ID NO: 66203 - DNA, 1030 bp, Homo sapiens
aaaatcatccatctatgttgttgcatgtatatccagcctgttgcttctaactactgcatcgtgtttcatagtgtgtgactaccacatttaccttatctgtccccccagtggtggacacttgatggcccgcaactccccactgccacagaatgctgtgatgaaccatttcttgtgttgccctttatggacctgcataagaatttttctaagaattgtatactcaggagcagaagtgcttggtcatagggtaaggtgctttaatgaagtcctgcaagattggcttccagaatggctgcaccagtctataccctaacagtgcatgaagtgtcccagatcctcacatcttcaccaacacttgccatttttcagctttctaacatttgtgaatatgttgaatttacagtgatatctcattttaatttgcatttctgtaataacaaatgaacttgaagattttctttatatacctagtaataatccttttttggtttcctcctctaggaattggctgttgatatctttgcctcatttttgttgggccttctttttcttttttcttttctttttttttttttctatttcgttttttttttgagacagtctcactctgttgcccaggctggagtgcagtggtgtgatcttggctcactgcaacctctgcctcctgggttgaagtgattcttctgcctcagcctcccgattagttgggattacaggtacctgccatcacacctggctaatttttgtatttttagtagagatggggttttaccatgttggccagggtggtctccaactcctggcctcaagtgatctgctcgcctcagcctcccggagtgctgggattataggcatgagccactgcgcctggcatgttgggccttctgatcctagcatttctatcaaagcctgatctggggcaaagtgctcctacagactattaactacctgaaagtcagtattgggaagtgaaaggcaatataacatacttgtgccatagacattctctgcttccccaaattagtaaggg

SEQ ID NO: 66204 - DNA, 1093 bp, Homo sapiens
cctagagagagcctagtctgggtccatactgtaataagtcctaacatctagggcctgactacactggccttaggtttggtgaccatatattatgaaccacaaattgaaagacatggaagtgtatttagaactacgctgaggatgtgaaattgggattatcttggaaaccctgttgtgggtgatcttgattccttggccatcagcttaacgtgccatgccttcctcgagccttgcccctaattatatcacctctgtctgggttcaccactgatttttacccttgtctatctcaaacagactccttcttatcccagctagctgctatgacctgctttgctttaactgccatctgaaaatatcactgttcctggtactatgcagtaagagcttagtaactatgggataagaagacagactaatggatggtcagttgggtgagagccaacgtggtttaggggaatgtacaccaaatttagactcagacagacctggttttgaatcttggttcttgtgcttatttaatgtgtacatttgggtaactcatattatcttgccgagccttagtttacttatttataaaataggactggtacctcattgcaagttgttataaggatctgaaatagtgaatataaagtgtctaacacactgcggctgctttattatgattattgatctttactttttgaagtaaataaataaacattatcctcatttgaggaaactggggcacattttctatacaggtaccttatttcctacccaatctttaattcatttccttaggaatctggctttaaaaagaaaactgttctctgtgccctctctactctcagctcatgtccccatgccacaggacttgtagatttaacaaatgctagtgcctttggttgggccacccggctttcctgaccagccagagaccaggttactgaatgagccacaactcatttgactttccagcagacctcctgaactgtgaccttttcacttcctcccctcatcgaggtgtgcactgggttgagaagaggtcactctttgtcttctccttgggacccgtgacactcatcacagtgatcctatgcttcagatg

SEQ ID NO: 66205 - DNA, 1069 bp, Homo sapiens
ccaggaaagtgttgggcttgacgtttctcccacccctactgctatggccgattatctctgagtaagaaagagtcatttctaatcccatttggaatcgttgctcaagataatcctgttttgtggtaatgatattccaattccagcatgcactcgtagtttggcagacacatgcctcaacctcaggcaactcaagacgctgctccctggaaatcagtgccagctcatttgcctaacgtgacagtctcagggtatacttcctgggcccaatgctctgttctgtcctggggttctgtgttcagtgctgtcttcatggagagtggcagttggggataggagagcatccagtgttcattatggagagtggcagttggggataggagagcatccagtgttcattatggagagtggcagttggggataggaaagcatccagtgttcattcagttcagctgcttggggcagggtgttccatctctaggaactgtgagatggtctagttctatacctcttctttaagagacttctttaaaaacagctgtaccataagctgcttattttaacagagctgccaggctggtgggccaggggtcggcagtagatatcatgggtgtttcaggcttttagtaagatatttggatgtctctaatgacatctatatgagtaaaattatgatgtaaaaatagtatagtcagactagtaaatgtaaatgacctggttcattgtttatgtatgaatggacatcagactagagagcaggcttgagtggtgagcaatggggctctgtcctgttcagtattttatatcactgatttcattgaggtcattgataaatgccaacagagttaatgaagcttgaggaggtactaatatattgggtgaaaaaataggggacattaaataaaacctcagtgggctagagcaatggttaaatctgtgttgataaaaactaacaaggataagtatatgggtcaacaattaaaaaccaactgtaaaacccaacgtgcaaaacttagcaatactaaaagtaaagtctagaagctgactaaaaacccaatatgttgtctgctgt

SEQ ID NO: 66206 - DNA, 1117 bp, Homo sapiens
catgaaaacatactcagtgcaaattcaagtcacaatgagataccactacatacctgctacagtagctaaaatttaggaaaactgacaatactaagggctgacaaggatacagaacaatattgatacatcactgataggaatgcataatggtatagccacattggaaaacactttggcagtttcttataaaggtaaagtatacatttaccataccacagagcaatagcaactcctaggtatttgtctaagagaaataaaaatgtacgtctgcaaaaatacctgtatgtaaatatttatagcagctttattcatgaccaccaaaaactggatataatgcaatgtccatcaactggtgaatggaccaacaaattgtggtatatccatacggtaaaaacagccaaacaaacaatgacaacaacaaaagcaccatgctaagctaaaaccaacacaaaaagctacctgctctgtaattccatgtatatgacattctggagaagacagaactttaggggcagaaatcagattggtggttgccagtgtttgggaatgggaagagaatataaaggaactttttgggatgatggagaaatattctgtatcctgattatcatgctggttacatgaatgtatataattatcaaaattcattaaattatatatcttaaaaaggatgaattttactctgtgtaaatgtgatacttcagtaaactgactttaaacactttttaaaaagctgtcatccctctctaattttcattattaattgtgaccagtggcatactgagaatttgtattagtagtatcaaaattaattcatattgttaatggtcacctggaatgttttgaattcttattgttgatgatatctcacattagagtgatatgcattctgatttttagtagggaatgaagatttgtcaattcatactatcagtgatgtaatgaagtataattactgatgaatagtgataaattcactttatgagtagtgtacagtggacttgtataaattcataaagtatatgattcttcattccagcaaggagaaagttgaggttacagactgggagcttgcctctcccacactattcttgggttccttatctctggactctca

SEQ ID NO: 66207 - DNA, 1131 bp, Homo sapiens
gctttcatatgcatgataaggtgtattgtacagataaggaaactaaggctcaggaggttagataggtgggctaggttatacagcaaataagcgacagagctgggctagaccccaggtctgactgtctccagatcctgctctttcactctactccagtgcatttgctcatgagtgagtcttttggctggactgagagttccctgagtcagggctggctatgaatccgcccactgcccagcagtgtagctcagaaccaggctgggcacagagggctccatgtacctggtattgagctatttgaaaagattgtgcctctcctgttgacttttgagtttttctgagtcagtccaattttctttatggccacaaggtggtggcaacagcctgcaggctgcccagaccaggccagacgcacttagctagcgttgcttttctcctaggcttagtgtctcctctgctttgggtctcccttccctgggctcagcactggggagtttgcagacgtctcaactgtcatttcatctccttgacatccttgtgaagctggcagggcaaggagttttgtctatgttttacagtcaggaaagctgtggttgagagagagaggagctgtcatggtcacgtggtgagtagtgggagtggaatggagctagatctcaaagactcctagttgagacctctccatcctcagagaggcctacaccctgcttgctcctctccattctacctttccttttgggtttatgacttgacatcaagattcagaactgggttgaagaactggagttgagggagaaagtggacaagatcagggaatctttagtaataactcttataggaacataaagcatatgcagagcttcatagattatgaagagcacattatttaccataggcaagacgtggtgctagcagttgacctgcattccctctatgatgagaggagtgaagagtttgggctctgtagtagaaaggtgtggaagtcaggttgttaacagtggacaccatgtggggagggaatgattcgtttctcattatatattgtgacatcagtttgcttgtcaaagtccacgtttctaaagtactgccactgtcttagtgggccctccacgcagtcctgagatgggtatg

SEQ ID NO: 66208 - DNA, 1044 bp, Homo sapiens
tgcttcgctgaaatatgttaaagcaaatcccagacatgatgtcatttcaccaaaggtagactttttttttggtggggggagctttccggtgaagactgaaaaacctgctagacaaattctaaaatagatgtgactttggatttttgttttttaaggctaggaggtcctggatgatgctgaaatgtaacagtgacacagagccagtgtggaactgtgtctgatgctgtgtgagggtgacatggtggctttgggaacatgggtgcaacactgaagatatgggagactccaagtgagggtgacagtgagagatcactgtgtgtgtggccctgtgacacccagtgacatgggacagtgggacgctgtggaccctgaaatgactgtgtgtcaccgagcaggtgggacctgctgtgtgaaggccacaggtgtcatgtcttcttgtgtcatcctggttgatgagtgtgacacagtgcaggactctgcatgggagtaagagggactgaagctgtgctataggtgaccgggctgcatgtgattcaagtgggctcagccccagcttcagctgctgagtatgggagggagcatggacattgtagggtagatgaggagaaacactgaatgggaacagaaatggtgtctgtgcccagatgcgagctcctcccttctctgaatacccaggaaggcttcctggaggcaggatgtgggcacttcagcaggatgttgtaggtgctgattaagagcagggcctgtggtgtcagacagccctgtctaggctctgacattcagcaggtcattttatctcttgagcctcaatttcctcaagtataaaatgggagctcttaggaggattgcatgaagcagtgctccaatgcatgcagtctctggcacttggtaaatactctatggtctcttggggagcagcaacctcaacacctgcaccccaggtccccaaataacaggagcaccagtaggagcacagtgaaggtgcgctgagtgaggtgtcctcttacacccacagccctcctctctccctctcccccaacttct

SEQ ID NO: 66209 - DNA, 1103 bp, Homo sapiens
ctgttctgggaagcacaggtctgggcaccctggggctggggcgaggcccggagctgatctcctctgtccatcccagtagagccagcaccagtgcagacacatgggggatccaggttggtggaccaggggaggatggaaagtcccatggatccagccggaatgttggagtggggaggcagagggcccagggttcctgctggccagcctctgggcttaggggtgtgtatcccagacaggccaggcctgccaggggccctgacaacaggaaatccttgaaggaacaagcagaggctgaggactctgagcacaacaacaggaaacagccgtgacatggggcaacagccctggcgactgtgcccagttggggtggggacgaggggccaagcttgtgggacccagggtgatgccaagagggacactgagacactgtgggacagggggcgttctgcacatgtgacacggagcttatgacgtgtaatatcaagtacgtgaccatgatcatagggtactgtgtggagtgtgggtgagtcactgagtatgtgacactggctgtgaggcactccatgatagcagatgtgtacagtggctgtgccaccaagtgtgtaacactgtgtgatattgattgtgtgatgctgacaccgagtgtgtgacattgcacattgcatgctaccacgtgtgtgacactgaaagtgacagtgagcacatggagggtgtgtctccatgagaatcaaatacagaaacgtgagcaaatgacgctgcagtagcaggtatggtcctgagtctgtggctcgagtgtctgacactgaattgtgacattgagtgtgtcccaagcatatgatctagtgaggctgagtgtgtaaacaaaggcatgacatggagtgatagcaagtgtgtggaagtgggcgtgtgatgctgtgtgatcttgggcctgacattacatgtgtgatgctctgtaatggttgtaacagtatgcaatgtgcacatacagtgctgtgtaggacactgtcatgggaaggcaccgatgggttcaggcgggaaagtaacaccgtccaaaggatggttttaaaagattgctctggccagatgcagtggctcacacctat

SEQ ID NO: 66210 - DNA, 1051 bp, Homo sapiens
tgtgtgagtgtgtgagtgtgtgtgtgtgcgtgcatgtacacgtgcatatgggaatggggtggggtgggaggaggcagtgggccagcagcgctgtctatgctgaggggctgtgtgtgcccacaaacgtgtgacattaggtgtgcacattatctatgcaggttgtgtctgcatgtgtctctgtgtctaggtggcgtgcgtattgaatttaattggatgcatacacctgtggctggggaggtgagaggtgtgtgaggtgcgtggtgggagacggtgtgagtgtggtgtgaagtgagggtgtgtgagctgggtgactttttggtgtgacgtgtgaattatgtgatcttttctccccatgagctgtgtgtgcctgtggtgaggagtgagtggaggatggccagtgagctggcggtgtgtgtgttgggggtgttgaggactgtagaatgtgctgcggtggcagtgtgtgcatgaggtgtgtgtgaggaatgaggtctgtaacatttggggcgtgtggaatatagtgggtgtccccataaatgtctgtggagtgacgcatgtgtgcaaaagggcttggctgccatcctgttcttgctcccctcctgatcaggtccctagagatgccctggaatgttctccatgcccccccaaccccagctgcccctaccctttgcccttcatcctccttgccttgaccaagccctttgttttgggtttccggcggagcaggcgctggacaggcgggcggcaggcaatgtcgtggtctgagaacctttgttctcttagtttgactggtgtttggggccttggtttggaggagggtgtggagaggatgcacgtggcagcaaggtcactgtgtttactacaccacttcgtgctccgcagaggggaggcatacggcgcaggcagtgaggcctgggtggtgtctttggtggcgcctgttggtgtaagaacagcttaggctgggcttggagtttgccagccatgcagtcttagtccatagtggcccagcgcccttcctggctcatgtcagcggggctgagcagccgagcagcca

SEQ ID NO: 66211 - DNA, 1022 bp, Homo sapiens
ctggtggaaatggctatatattgtccagactgtagcaggggctggccaagatggtccactcctctccccatcctcctccaaccagaggccataaaccccactctatagattaacaattccctgaaaagaagggggtcacttttgttccccagttctagaactaaatattaaagcaattatgtaactagcaataaattacttaaagtagtgactcactcagcttaattagagcgcaagcagggagggattaaggtatttttagagcacacacctcactctctcctgtgggggaggcctctgtgcaaggtgggggtggaaaaaaggctgggaactcatgggagcaccccaggtgtctgcaaggagatgaaagctgatcctccgccccactgaggtcctaaggaagaaaggccgagtcagagctgcagcaggagggattcggatcagactcaagaacacttcccagtggtgcttatttgagaactgggacggcaacactagattgtaaactctgtgagggcagggattaggtctgtgactgcctcctcacccagcgggagaccaagaatgagacttgggagtcagacacaactgggtgtgactcctgcctttgcgggttgccagcacgtgggcttgggcaggttcctttatcaccagaagctttgccgtctcctccactataaagtgggcacaataacatccacctgcatgcatattataaggattgagtgggttaaaatgtgcaaagcaagactttgtgctcagctgggcacagcggctcacacctgtaatcccagtactttgggaggctgagacagagtgcttcagcccagtagttttgagaccagcctgggaaacatagggagaccctgtctcttaaaagaaaaaaaaaattagaagactcggtgctgactctgctagaccaaaagcccacaaaggcagggattaggtttggtttgtgttgttcattgttgtatctcaagcttcattcataggactgcacaaagtaggtgttcagtaaatgc

SEQ ID NO: 66212 - DNA, 1008 bp, Homo sapiens
gcattttttatctgttccatgtgcatttatgtgtgtgtatttgttagtgtgtgaataatagcattgctgtgtgtggaggtggatgtggctgtgtgcgtataagtattctggtgtgggtgtgtgatcatggtgctagtgtgtatatcggtgcttctgtggctggtgtgtgtgtgtatctatatgtgtgtattcatctgagtgtgtgtgggtggctgtttccttcccctggcaattgaggatacagctgggacaccatggcccactgatgcagggcagggaggggctgaatgtatgaccgcctctttgaactcaggacaattcattctacaccctgtgggaaagatgcagaaaagaaataggcaataatgactctgccctctggggcttcctaagcttcttagacataaaatagcttgagaataattaagcagtagagatcaacgtcatgctaacaggtgggggtggggtgggaactgcataagcaaaggccctgggctgggcatgtcctggagcagtgaagacactgtatagagtggggggcaggcaggacccacattcaatagaactttaagatccaggactcttaggctttatccagagagccctggggagcccagaaaggttttatataggggagagacatgatcagatttgggttctagaaacctgccctgggccaggcatggtggctcatgcctgtaatcccatcactttgggaggcagaagcaggtggatcacttgaggccaggagtttgagacgagactggccaacatggtgaaacccagtgtctattagaaatacaataaaattagctgggtgtggtggcacacgcctgtagtcccagctacttagaaggctgaggcatgagaatatgagaatcgcttgaacttgggaggtggaggttgcagtgagctgagattgccttactgcactttagcctgggggtgacaaagtgagactctgtctcaaaagaagaaaaaaaaaaagaagaagaaaaataaagaaac

SEQ ID NO: 66213 - DNA, 1017 bp, Homo sapiens
tcagagattggaagtttgctgatgcctttgggaggccaaggcaggcagatcacgaggtcaggagttgaagaccagcctggccaatatggtgaaaccccgtctctactaaaaatacaaaaattagccgggcgtggtgcgggtgcctgtagtcccagctacttaggaggctgaggcaggagaattgcttgaacccgggaggcagaggttgcagtgagcccagatcgcaccactgcactccccactccaccccttccccatgcctgggtgacagagcgagactccgtctcaaaaacaaaacaaaaacccaaaaaacaaaaaactaagaagtttgctgatgcctttaatagtaacaaaaggtgtattggatgttcaatatttgagggacctacgggttgttcccagaggagatgtccaagagacagcctggacacctggagctccagggagagggatgggcagcaggggacacccggagttgttggtatgctgggagaaggctgcatgctccgtgggagtagggtggagaatgaggagagacagggccgccgtcctgcaaggagcatccatattgagggggcgaagatagggtgcaccagtgagggagacagaggaggggccgtctggaaggtgggagggaaacagccgcgcaggacggggcgggggcgggcgctgagaagaagccgccttcttcggcaaagaggtagctgaagcctgtggagcctgcagtcctctcaaggctatgggggcagcgcggaggccggattccagaactgaatcttcccatcgctttgggcagccaccctacctcccaggagcatccttcctgccatcccacctccagttccccagctaacaaaaaacggtgtttcttgactcccggcagggcggcggggcgggcaggtcttgtgaacacggctcgcagggttcagcaccctggagagaggcctgtggccggggcggggcctgcggcgggggtaggggcgcgcagtcagagcagtcgggcctttggctccgtct

SEQ ID NO: 66214 - DNA, 1081 bp, Homo sapiens
ttcctgaggtgttgaagaagctgctccaccttggaactactataggggctgtggtggcctttcattcctttatcagcaaaagcttttgtcacttgtgtggtgggggacatgcttagtgtgagaatgcagagacccatgccaggccctacccaaggacatggtgctccttcagccattgtcatcagagccacagaggggagcttcctggcagaggaggagtggggagaagctgtggaatggctccttgagctccccactccaccccttccccatgcctgggctcccattgcaaagacccagatgtgggcttatcctgtcccccagccagagggagtcacccaggggtgttcaggccaaccctttgtgaaatccatgttccaccagttaccagcctttctccggagagctgagggctgtctcacactgggtagtctcagcctgccctggggttgggggggtgctcacagagcagtaagcgtcactgcctgcatccccacacacctgcattatcttgtctgcaagacacgtgtgcccctgagctgagctctgttgtgcaccacccgatttccgtcggcctcctttctgacttttctccatcaacatttcctgcttgggcctgttgcgggctacccaaaggctgtggactggggccgaggtacataggactttggcttgtcttttgagctaacaggatcctgtagaagaaatgagatgagcctgagagggggtcggggggtgagacattagggaagggagaggccaccaagggtctctagcccagaatccaatgccccttcctgcctacctgtccttgtgggtgggaggcagggtgtgtgctgactggcccagcaatggtgggctaggatttgggataggcagagaaaaggaagaggagggggaagtcggcctgggaggagaaacactgtacaaagtcgaggaggagagaaccagagtgtgcttagggaccagacctggccccacctggagcagaggatggtgaggtcagtcagggctggatcgacaagggacctcaaatgccaggctgaggagcttggcctttatcctgagggcactggggagc

SEQ ID NO: 66215 - DNA, 1050 bp, Homo sapiens
caggtgttctcccaacccagactccatttgacaccctccaccttctgcacatacatgccatacacacaccccaaccccacacatcactgcacatgctgtcctggctctagacctgggacttcttccataaccctgatcctctatcaaacagagccagaggccgtggagcggggcccctgagaccgtgagtagctgtgggctgactgccagctgccttacaccacctgggggccaaatgagctgggtgggagcatggggagacagccagggctcctggccatctccaggcatggatccctgcccccttgcccgttggcactggcccctatcctggggcctaagctcctcccctttatccctaatcctgtcccagggtcctttccccaatatagggttccttatcagtgcaatgctctagaattttccaaaggacttagtgtagaagttaaagagccagtaatgatggcacctaggtttgaattagagccctgatcttcatctcctgtcatccctggagccaccttatttccaaccctggacagtgttccaggactgtcagaatgttcttgctactgccctgatcctaacatgccggggtgggacgagagaggcttgtgggatacccccacctggggtagcagtctctctgaggcttcctggctggctatttccactctgcacactcctaggagagagagctcatccctccgcccttggggctgccctgttcctagggggatacttctgtctggaaaaggtccttgctcaggttctgctgagaatctgcatctcatgatgcccccatgggtcccagctatgccttgggggctacagagcatagatgccctgcagcaggggtccccaactgttgggaacagggccgtgcaacaggaggtgaacatcgggcgagtgagcattactgcctgagctctgcctcctgttaggtcagcagcggcgttagattctcgtaagagtgcgaaccctactgtgaactgtgcaagcgagggatctaggttgtgcgcttcttatgagaatctgatgtctgaacat

SEQ ID NO: 66216 - DNA, 1092 bp, Homo sapiens
gggaggagatcactgccattgtgaagatgcgcgtggctggcactgccagtgggacccaggtgaaggctggagcctgggtggggggcttggacctgccacctgcacccatttcctaggcccccagctgagccctgtctccctgcagcatgccggtgacttcatctgcacagtgtatctggaagagaagaaggcagagactgagcagcatatcaaggtaggtgctgggacctagaagccaaggggctagagaatcaggctgggccaggtacaggctcagatggccaggggagcagtgcttctaccccgaggagaggaccagtttgggacctgtatctggctggtgctggggtctgctcctaaggaccactcagaaatacccctctctatcccaggactccagaagggcctgagaaggatgggctcaggctctgagtcacatagcaaggttgtggcagagcaggggctaggcacaggcaggctaatctcctccttggtccttgcaggtcccagcatccatgactgctgaggagctcaccctggagatcctggatcgccggaacgtgggcatcagggagaaggactattggacctgctttgaggtcaacgagagggaggaggcaggtgggtgacgctgggcttgtgcagggtgtggtatggcttgtcttgtctcagctgtagccccagtctgtcctcccctaccctgcacatgaggatgggtggtgaaaagggctttgatgacatgttgctgtcacactgatctctgtgatggtggtgatagggtgctggcagggattgaggttatggctgtcatgtggctgatagaagatgtcagtgacagtggtgatggttgaggtgagaaatgtattttatggtaaaggtggtcttgatggcagtggaggatgaggctgtatctgttcatttgttttactatatttgttgagtgccaggcactgggctagggagccacacacacagtccctatcctcgtgggggttagtctggtgtgggacggaggcattagtctaatgatcataccaataaatgttcaactacagatgcattaactgctgtggaggaaagacccttggcatt

SEQ ID NO: 66217 - DNA, 1031 bp, Homo sapiens
tgaggaccatggaatggttttggttagaggaaggatggggtctgattttagctagatcactctgggattttggaaggggctgctgcagaggcctgggggagcggatgacttgtgggctggctagcgtggtggggatgcagagaggtggatggatttagggaaaacttgagagaatgaagagctcatgggtcagatgggagcaggagccccgggaggatgcagaggtggttttcaggtggtggggggctccctgatggctcccctgcccaaattctccccagagttcagccggcgctggtgtgtccttggtgacggggtcctgagctactttgagaatgagcgggcagtgacccccaatggagagattcgggccagcgagattgtgtgcctggcagtgccccctcctgacacccatgggtgagtactcctgggcaaatcagactgtggttgctataaggtacaatcccccactggggagacagggaaatagacccagagaaggggaggacctccgcagagtcacacagcaaacggaggctgcacaagggccgactccagtctcttgaggccccagcccaagacttttccaccacctcttaggggaccagaataaggacaagcgccaaggcagtgcggagggggcagaggatggcggttgatggtgcgggttgggggtgggcccgtgctggatgaggtgggcctgagtcctggcctgtgtatttgcagctttgagcacacctttgaggtgtacacggagggagaacggctgtacctgtttgggctggagagtgcggagcaggctcatgagtgggtcaagtgtattgctaaggtgagcctggggtagcagggtgggtgtaagggtgtctgactggggaaggtggggcctcctggccaatcccatgtatcccagctcccccgtctagagagcagaagctagatgcagggcagcagacatggagcgggcctgtcccaccaagagcctactgtaatctgcagccctctgcggagttggtcagacctatcctagctct

SEQ ID NO: 66218 - DNA, 1122 bp, Homo sapiens
cctgtcccagtagacactgggggtgggtaagtgctcccgtgaagggggggcccaggtgattctgggtctggccctgtgtctacaggggagcaccgtggcctgggcgctggcgtctccaaggtgcggagcctgaagatggacaggaaggtgtggacagaaacacttatcgaggtggggatgcccctgcttgccaccgatacttggggtctgccccattcaacagctgtctgggtctcccagccccctccctatctcagtgaccacagcaccttggagctggaagagaccctttgtgataatctagtgggtggggatttcggaaaagcaatttttggcaaagtcagcaaactggccagtgagctaagaatgtttttatagttgtaaagtgttatttttttttaaagaaaaaaaaaggaagaaaatgcagcagagactgtatgtgttctgtaaagccgaaaataattactatttcgccctttagagaaagaatttgctaacttctgatctaatttcactgtcatccattgaatagatgtgtaaactgaggtcctgggcagggctgtaatctgcctgagattaccctgtaaatgcatattgaccaccatccctgcctctttccatcccacttctggctgacccagggccttctcccctaccttgcacagcccctcagaggccctcagcctccatttcatgtgaactcacatgtaccagtgggtatatatatgtgtgctgtgtgtgcacacacgtgtacatttatgcccctgtactggaaactcccaggtacccatatgtggtagatataggggagaacctgcaatgggagggtagacccaggctgcagactccagacacttggagtgtcacatccgtttctcacctccccacggtgtgtttggcacataagtgctaaggactttgcatatgttaattaactgactttcagaacaagccaggagttaggattagaataaccagtttacagccttgaagcccagggagagaaaataacttgctggaagacacagagtgaatcagtagtggcaaggacttttctgctttgttctgtgctgtgactccagcaccccatacaggacctgacaaggaggcaaggtggggggc

SEQ ID NO: 66219 - DNA, 1029 bp, Homo sapiens
aaagtgcagctctacaagaatctagaggtgctaaggggtcatggaacctctcccctgcccatgtccacctaccctgccccaggctgacctagggccttagccctgccttttctgttccctcttttcctgcactgggcccagccctttgcctggatatgtcctcgctcccccaagttctgaccacttcccccaggctctgagcactgccctccagtccctgccctggcccttgctcccccgcacctctgttcattgctgtgtgggccctgaacctgcagccccttaccctgcccagcctcccatgtcccctgctgtctccctcctgggcaccccccccagtccctgagttgcaccaccttcccttcctctccctgtcccaagcctcacgccctgcccccaaagccttgccctcatcccgtcccatctgccctccaggagtaccacctgggcattggcatcaccttcatcgacatgagcgtgggcaacgtgaaggaagtggaccggcgcagcttcgacctcaccacgccctaccgcatcttcaggtgaccctccatcttcttggctcaccggcatcctcactccttcctaatgttttccttttgcgcgacgtgggaagctgccccttcctatgggatgggttccctcaccctgccccgccctgccccacctgtggagcccctctcccgtcacttgctaaccctctctgatctccttccctcctgagaggtcttactctcccctgtgctgcttggcaactgctgtcctcccctgcccgccatgctgctcaggggttgcccatctggcctcctgctcccactgcccctgccccactatccctgcgcctacgccacccctggagagtgctcttgtctctcatgaggctgctcctcagtccttgtctctgggccaccaagcctctgccatcttggtttcctctgacctcagctgttcattggtgtctttctctgtcctctgccctctccctgggcagccttgcccactcccaggccttcagccgctacctctgag

SEQ ID NO: 66220 - DNA, 1086 bp, Homo sapiens
cccaacccccaagctcaccactggctcggacctccttgtggtgtcccagcttctcctctgccaccctttagtactgtcctatgaggcctgggggtataaatcgcacttcctgtcccctgtgcctttttttgaaagccagggggaggtggggatgggggtcttggcatgggggaggctttgtgaagcccagtgtggtgccccaggagaggaggccaggccccttgccctgaggccccccaacccctctctcaccagatgactctgactacgatgaggtcccagaggaggggccgggggccccagccagagtgatgaccaagaaggtggggccaggcatgggactgtctgcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaagtgagtgtccggccaccctccttcc

SEQ ID NO: 66221 - DNA, 1047 bp, Homo sapiens
acgggcaggtacacgacattcttgggcatacgcagcccgcctggccggagctgtgggagtcctcagccccaagacccagcaggcgtctgagggtaagcgaggtgccgccgttgctgttgttgctgttgggcacgtaggagggaggccctgggagggctgaagtccctgtctgtcacctctggcctggttttctgtgctgctctcctcccccttctctttttttctcttagagttttgtcttatttcactttccccacttcttctctttttcccctgccttttccttttctccccttgtctcatccctccctcttccctgggctttctaggtctccacctccccatacgcctctcctgggtccaccaggagcccacggtgcctgttttctgggcctttctcagactctgccccacagaatactcctctttggggttcttgccccttgggggcctggtgctgatcaccttacttctctgctcccacctccctacacccctctggggattcgttggggaggcttagtttggcttatttcactgtcaagttcaagggtgctgtgattctgaacctctcacccccagaccagggtgatggggagatggtgtgctgcttacccctcctccccaggactggtgctgtggtgggtgcttatggagtgtgggggctggtctcccctttcctgagttaccgtggatccctaatgaattcaacaatcctgtgcttggcttattggggacatagacctctaaccaagtcctgtccacccacccggcactcttcagccctgccctgtgcccttggctcatcttttccatagggcccagcggataactgcacctgctctttctgccaggccaggccaggcctgggctggacccaggaagagctcagtacttctgtgagctccctgaggatgaacttcctcctgctgctgccctcaggagccagcacagggccaggcctgggaagcgcttagagctgccatgggaaaggggcctctgccacctcctgcccagacagcagggctggcctgtgggaaagctgag

SEQ ID NO: 66222 - DNA, 1120 bp, Homo sapiens
actgctagggctgaaggtcctgtagaactgcacagatgcccctcaggcacagggcagaggccagcctgccagaagcttccccatccctagcatctctgggctccttcagcccttttagccggagataaattgcatgccagggggctgctgggtatctgtctctgccccaggctcactctcttgcactctccagataaccatctcttagagaaggctgagctgctggacaagttctcaaagaagctgcagccggagccaaacagtgtcactcccaccacccaccagggcccctggtaagtgtatgtgggtccgtggtcacaaagggctgcctgtgctggggccctgcccctgctgcctgtgctgggttcattctctccctagtgcctcatcagcccttggctgctgcccaggggtggtgggggtggtggaggtggtgggggtggtgggggaggcaggcccttggccttcccacaggacagctgtttagaatctctttcccctccacctttctttgtccatctctctgcatttgtcccatctccttcccgtcccacccctatacttatgtcttttccctttctcagtctttttccatttccctgttccttgcctgatgcctaaagaaagggtcttgctacctgttgcaaagagggagtaaagatgagaaccaggaataggttggggctcagagttgggaggtgctttgcttttttttttttgagacggagtctggctctgtcacccaggctggagtgcagtggcgtgatctcagctcactgcaacctctgcctcctgggttcaagcaattctcctgcctcagcctcctggaacgtgcaccaccacccccggctaatatttgtatttttagtagagacggggtttcaccatgttggccaggatggtctcgatctcttgatcttgtgatccttccacctcggcctcccaaagtgctgggatcacaggtgtgagccaccacgcctgactgggaggtgcttcttgagaagggtccttggccaaggcctaggggaatcttagagcagaggagtcatggacagctcatttctagagacttgccttttcctttactggcttgctggcttccatcttcccaggacgaagt

SEQ ID NO: 66223 - DNA, 1083 bp, Homo sapiens
cgccggtgtctggaagggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagtaagagtggggatgggccggtccgacccttgcgttctgcctcccgccccgcctgcctgcggcgacccaggctgccgactgtacttgtgcacagccccgtcctgaggcccccatgtggtcggagcccacgagacacctgcagaggaccgtgtggtcgtaggagcctgcatgcgtgaccgctgcacgtgtacacccacacagaaccctcatcactgggaattcctgtcttcagcgtatcctgtgctggggtcgggaggggctggcttggtcccttggcctttctgaacttcattacctctcctaggggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagacc

SEQ ID NO: 66224 - DNA, 1059 bp, Homo sapiens
accttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggagtaagtgtgtgtgtgcctgtgtgtgcacccacgtgtgtgtcgggctccccagcccaggcttggtctgtgtctgtgcctcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctg

SEQ ID NO: 66225 - DNA, 1034 bp, Homo sapiens
tcccagcactttaggaggccaaggagggcagatcacctgaggtcaagagttcaagaccaacctgagcaacatagtgaaaccttgtctctactaaaaatacaaaattagttgggcatggtggcacatgcctgtaatcccagctacttgggaggctgaggcaggagaatcacggaacccaggaggaggaggttgcagtgagctgagaatgcgccattgcactctagcctgggcaacgagagtgaaactccatctcaacaacaacaaaattctcttattcaaggactcagccagtctaacggtctaagagccttgggctccaacattcttcgatactcagccttctactctgccccagccctcatgccctggctcccagcagccaccaggggtcaccagctgcctagtctactgaggccattcccgtttccagggacacatggctggggagaccgacactcctgtagccaccgtgactgagcccttaggaggtgccaggccctgccctgcaccctttctgcagcattatttgttcctcccaactacattgccatgtagctaccatgtttcccaggtgagaaaactgagctcagagaagccctgcagctggactgtggctgcattacacatactctttttaaagcaacgtgttcagactcgcagttaggcagggctgcggggcatgccccctcccccagggtgtgtgtgccccctgcctgctaccacgggggtagaggtgtgatgctagccttgtgtctaacctgactccctccctacatcttcacccttttctattctgggtcctgagcctggacggttagtatcccttgaagtgagggacatgcagggacacaggagtgagggaacttgaatcttgggaggccagctgcgccattgcgtttctccctcatttcacagggttgtagtggagactgcttagagagcccagaggaggtgctcaggaaatggtctgactgatctctgggacagtgagcccttctctcccccaaaaccttcccttctactttatgggcgtc

SEQ ID NO: 66226 - DNA, 1230 bp, Homo sapiens
aatcatggagaagattcattaatgggtattgtcactgaagtgatcaaagaactaaaaatttcttcagttatcaccttacttttggtcaaaaatcccatggggacatttggcgagcatttcaagttttttaagattcttaggagggatggagttttcaaagcataatacaacttgtagattaaattctgcaaatttgatttcttaaccaaggaaaaaaaaaaaaaacaaaccacaaccggcgaacatcccttagtccctaggtattgtgctccctaccttctacaggagcggacagcagacagtcagcacctgacgtgggggcacctgctgctgcaggcttgctggcctgcagagaaggccactcctggctttccctgtgacacacagaagacacttgtcttttcctggtcaatctgtacttgtgcagggtgcgcaatccttcagtcctttctcatagaaagctggtttcctccacgagccaccaggttcttccttccacggaaatgtcagggtagtgggacctggaagctgcattttccaccatagcagttggtctggaccagccacagcctggctgtctgggccggtctgctggcttgggaataaaataatgccggggcgtccccagtagagaagctcaacaatgcaggtatgtgtcctcaacttatctagacatttggattctaaggatactggtaagaagagtatatgctgtaaaaattaagatgaaaaatacccaaatacaaaagaacattatattggctaatttcagatccggaagttccatttctgctttagccacagcctcctttctattagtctatgtgatgaacaagatgtggctactagttcagcccctccatattagctctgctaattctaaatgaatggcacagatattaatacgaaggacactgttattttaagtctgttagttgtggaagagatgtgcgttaatgcaattggtgctaaattcagggcagtccaatttttcccaataaggtttcactttctcagtctggggactaaccttggggaggagccagcctctcctgaaatccctccttctgtttccttatgtagccaacatgatctgattaattctcaatcagatgagcaaaagccacttgaagaaagatgagaatctttgccacatccttgtggtcacagtaatatactgtacgagtgcacatgatcagtaatttagggactgtgccctggaatgaggcc

SEQ ID NO: 66227 - DNA, 1069 bp, Homo sapiens
ggccggtctcaaactgctggcctcaagtgatccacccaccttggcctcccaaagtgctgggattacagacgtgagccacctcactcagcctctccatagctttttataagggcagcagtttatttaaaagtgtactacctccctggtttgctgtcacatacattaacgtctggtcgtgttgatactttttaggtcttgccatgaaaaacatttttattacaaaaatgccttttgctggcatattcaaggcatagtgtggtttcagagtagtgaaggaattccattggaaaagctatcaagggtaaatgagtggggttttttcctcaatattatttttctgtctcagggagctatggcaacatccagaatctggattttgatgaaatgttttaatgttcataaaatgggaaattgatcttgaaaatgaccccttttttgccttatttttgtttgtgtaacttggagttaattttacattttgagattgtgagattttaaaaactttatggttttaggtgatggttttaacccatcttgggacttggggaaagcttttaagactgttttctagagagccagaagccagcaggcccctgtctattacacatgacaggcaagactgttaggaagcaaagccacacggactttccagcccctctgtggagcctcagagcgtttacagatttggcagtctcaagggcaacatgtgggtggctgatgctggtggattgctgctgtcagggataataaaaccattatggttagcagcttgtacggtagcacgcaaatggatcagctcagtctccacacagttaagttggagcataagaaatccaaaccatgactgatctcaatcatttcctttcctacaatttttttcttttggccactgctttacagtgattccagatcaatcctaggcactgcacccactatcatcaaattcacgtacatagttctttgcattttcactgcatgcttgtccatgggagccctctggtagcagttccaattcagtgccttctcgtttgcctttgcttcccaaatcatcacagttctgtgcttatcc

SEQ ID NO: 66228 - DNA, 1053 bp, Homo sapiens
tgtctgttgatcccctctatgtgtccatgttctaatcatttagcttccacttacaaatgagaatttgcggtatttggtcttctgttcctgtgttagtttgctaaggataatggcctccagctctatccatgtccctccaaaggacatgatctcattcttctttatggctgcatagtattccatggtgtatatgtaccacattttctttatccagtctaccattgatgggcatttaggtttatttcatttctttgctattgtgaatagtgctgcaatgaacatgcatgtgcatgtgtctttataatagaatgatttatattcctttggttaacatcatctttgataacttactcatgttgtatttggagtgatgtccactgtgattacttctctgtccagtggagttgagagattctattagtaaatattgaggagctgtcttcctctgtattaggtattaccagattctttatctggattctcccttcctcgtaaaaacaaaagctaatgctttattaagtacctcctatgcaccaaacatgtgttaggggttttaaatattttacttcatttaatctttatgctaaccctgtgaagaagtaactgtcttcattagagagacgaggtcattgaaattgaggagttaatttgcccaaggtcacacaacaagtaagtgacatagtcaacattcaaacccaagttggccagaccccaagaccctgctttctacctcatgattgtgccatgaagctgagcccctcagaggtgtttttaatgagtacaagaagatggctcccaaaaccaactcaaaaagatcatctttcctgcctctgcaataagagtaagcattttggccgggcgcggtggctcatgcctgtaatccaagcactttggaaggccgaggcaggtggatcatctgaggtcacgagttcaagaccagcctggccaacatagtgaaacccccgtctctactaaaaaaaaaaaaaaatacaaaaattagctgggcatggtggcacacacctgtagtcccagctactccggaggctgaggcag

SEQ ID NO: 66229 - DNA, 1116 bp, Homo sapiens
cagattaccaaaaaattggaaaatacaatacagaagaaaatgattaatagctccatccttataatagcacagctagcaatttggtgtatttccttactcttatttatttattttttaattgacaaacaattgtatatatttatggtgtacaacataatgtgtatttttgtttgtttggagatggtctccctctatcgcccaggctggagtgcagtggtgctgttgatggctcactgcagtctcaacctttggggctcaatggatcctcctgcctcagcctcctgagtagctgggactacaggctcatgcccccatgcccagctaatttttgtatttttcaccatgttgcccaggctagtctcaaactcctaggatcaagcagtccgcccacgttggcctcccaaagtgctgggattacaggcatgagccaccacacccagtccatatttttattttttctaatcttttatttatgagccactatgcccaccctgttcttttattgcttacattttcaaactatagcccacaatgttaacatcacttccccgttttcagccactttccccaactaatgtgcaagggcaaactgccagtctactctgttgtacagcctcacttagagtatgaacatctgcagagttgcatataaataaattctgactttggttgttgtgagaaccatgcttaataatgatgttggagataagggtaagataaggagtttctaaaactgctaagatcatatgctttggctgggtcatataataggtatatatttaacattttaagaaactgacaaactgttttccaaagtggttataccattttacaattacatcaacggggtactagtgtttcagttgttccacaaccttatcagtacttactatagtcagtctttttaactttagacattctaataggtgtgatgttgtaaatcattgtcattttaatttccatttctctgataatgttgatcatcttttcatatgtttatttgcatctgtatattttctttggtgaagtgtctgttcaaatctttgtttaatttttattgggtttgttttatttttattgcattttaagagtttatactctgaatacaaatccttt

SEQ ID NO: 66230 - DNA, 1033 bp, Homo sapiens
gggacccaatacaaggaatccctgcactggtttaggtttaaactaaactaatggttttctaacacccccttagaactccagaggttttgaggaagtgcttcactggttgtggggtgaagggagaggcagcgtaggcaagcatagagaatatgagcatgtttttggtacagccccatggaagtgatctgaatcagaacaggcttgccatctgcctgggctggagaaaccccagtaaccccacctccacttcattcctgttcacagtctaattgacagccaccatagtgaggagggcagggtgtacaatgaatagtcatttttctctttgaattcagggtcatgtctaaaccactatcttagggtgctggccaagtagtgttggcaagccctcatctactctaagaaacactggcctgtggtagaagagttattcctgttgtttgtttctccgcactctagatgaagccagtttttcagagccttggtggaacaggagtaattattttaagacaagtctcagaggttttctgaggggtatttcatgtattttccatttccagaccccatgcatggtatcaccgactggtaccctaactccacgaaacctcccgccatccccagtagtagcagtagtaggtatcaggcacacagagtcttcatttaggccagatgacctattatttccatagtatgccaaactagactgtgtttgttagtttcaaactaaaaatatgaagtgaaattctcataccacgatgtctcacctcttctaatgcaagtatttaagtctacattctcaaaaatagttttcttatcaaaaatgttgaatatagtatgctaaaaccattgtagcagatccgttttctcagttttgaatatctgtagcatttaattaattttactgttagcataaaataatctcacttggtttccacttaacagatacaaaaaatagcctaagtaaaattagccagcaaatatgagggcatatttattggggtagtacttacaggattatcataataaaattttt

SEQ ID NO: 66231 - DNA, 1039 bp, Homo sapiens
aatgttgggggaaaagtctatgaaaaaatcttatctttgttccttctatgaagtggttgatttttgagtgaacaattttgttgttgttgttgttatttttagtagagacaaggtttcaacatgttgatcaggctggtcttgaagtcctggcctcaagtggtccacccgccttgcctctcaaagtgctgggattacaggcatgagccaccatgcccagccgtgatcaaattttttatgtttatttgtccatttagattttctgtctctttttcagtatatttgggtaacttacattttcctggacaattgtccatttcattaaaatgtccaattttcctaggcagttgtccatttcatttatcagatttgatgtcataaacttgtttgcttctagaattgtctctgtttttgtttttaatattgtgtgtgccctctgtcttattttgaccagacttgccagtctattttattaatctttgccaagaaccagataaaatgacctttattctgcttctcagtgttgtgtctatttccttaatttttgcctttatattcattatttctactgtcttacagtttatgttattgttctttctcaagcttctttttctatttagatcctatattttcagtctttcttgtttttaagtaaatttgtttaaagcttttaaaaaagtgtctttctgcttgaactgcattctgtgatatgtagggcttttgttttatatctatttttttctccttattaacccatgattatttagaaatgagtttttcagtttccattcagttggaatatgtggtagggtgacatttttatttctaattttattataaattgtatttttaatccaacgacatttattctaattttattataaattgtatttttaatccaacgacatttattctaattttatcagagaggttatcttctagcaaaattctttgaaatgtttttttccaagaataagttggactggagacactacccttagtttataaaacaggaaacattatagtcgtaacagatagctaa

SEQ ID NO: 66232 - DNA, 1978 bp, Homo sapiens
ttaaagattttttgaaaaagaaattgtgaaaaaggaattttgaaaaaggaattgatgggaagtatactcatcaccagcagtaggtttctggagatctaagatctggagtttacctcactaccttagtttctaatgcttgtcatgctttctcaagaccatttctcaaagaatgttcctcttctctaactataccttttctttctgatccagcactgttaggcatctcatgttttctggtgtgttttacttttcttaatatctaatactatgtttattttattttctattggagcacaataacttcataaatatctcttattctttgcactttcagtaacaaaattttttcaagtcaaagtctgccagcaccatagaggagtagttgtgtttgcttcaggattgtctgaggctttaaagcgggtgaactgctgaccttgaggaaaagcagataattctatcaagaaagcctccctccaggagtaggcttttattgctttattatatatcttaaactgtaagatcctgtttcttcacctgtggaaataaggtgaacaatatccttttcatgaattgtaaatatgtgtaagtgcctggcacatagtaggtgttctgtaagtattcatttatctttcttccttcccttatcttccactaatccatataacttaatgtctcatctctaccaataagctcttatgtatcttaaccaaattttcttaccaaaattaactataggccaggcatggtggctcatatctgtaaccccagcactttgagaggccgaggccggtagatcacttgaggtcaggagtttgagaccagcctggccaacatggtgaaaccttgtctctactaaaaatataaaaattagctgggcgtggtgacacatgcctgtaatcccagctactcaggaggctgaggcaggagaatcacttgaacccgggaggcggaagttgcagtgagccgaaatagtgccactgcactccacactaggtcacagagtgagaccctgtctcaaaaaaaaaaaaagatagtcaaacttggtgaacacaagcaaacaaaaaagtgtatggaattgtttttgctctaaaaatactagagactaatactagattagtgttttccttcataggccatatatatctttctggtattaagatagagaagagagagttgcttcatctgagtgaccaagcaagaccaatataagttaaagtacacagggagtttccaagcattaaactcatgggtgctcttcctgtctaatcttgtcttcatttggtaagacatatgcagacctaccatgaagcttcagggaatttttgattcttgccaaaaataaaaatgccctgaagtgtgcctgttgaaaatgccaacaatatgtagattctgaaagttatcttgtaagtgaaagaaagagtatagctgttacagtattcttgtcaaataggattttccctaagttttatgggagtaaggactttctctgctatactgaacgctagcctcatttcctcagcaagcatgattgatctcagttagatattaagaatttataaagagattgtgaaagggtaaacctcaaatcaatgggaaaataacagattttaaaagtcatgacattgagactcttaggaagaaaaattttgtttcttccatcaaaccaggccaaagtaagttataggtttgttaaagataaatgtaatagagaaaaacatgggagaatatttatctgatcttagtgtaggggtgagatttttaaggattctagcaaaggcaagcactatatgggaaaatggtgataaattttacaatcccacagttcagaaatgtgtaataataacaccagagcaaacatttattgagctaaatgccaagccttgtagtaagtgctttacgtataagtcagtgccaaggttgagaaactctgccctagagctgcgtaatctgtcgctctcgtttgctgtgttatcatatg

SEQ ID NO: 66233 - DNA, 1050 bp, Homo sapiens
tctcaaaaaacaaacaaaaagtactaaatacagagaaatacaattcaaaatgacctagaaacacctggatttgatatacttgtagagcagctaagaattgggagggcagataccacattttaaaactgaatattaaagaataaaaacagggtgaaaagtcacaatgttggcgatggaaagcattaggtttgagcagtgctaaggcagcctcacatgtgtgttacctccccattcctaggtcaccattttctatttaccctactctgcaaccactaaaaagtgctttagatcaaaagtaggaaaacatagtaagtgagaggtatgtgtgcctctttccctaagcataatttactttctctgtcttcacccccaaatttctggctcagtcttcttatctacaacttgggaattctttttattaaagcctttctttacctgtattcttattatcagagtgtatttcacaccctggggttctttattatgccctgtcccttgccccataccctttctccacatcaactcccaacattatcaaagcagagagaactttctggtggctaacagaatggatactattttactagaaatctttgtaactttaaaggaatgggaatggcaaataggtttcagtttatgtgtcagttgtaagaaattaatagcagctgcatggaacactggaccaagaagtattatgaaactgctaggctcaagtgccataatccattatcagtcactgtcataggtgtgagaagagtgaatgacagcacatggactccacatttgaagccccctgacctagcagatctctgcctttgaatccatttaaatccaaaggagcagcagactagagcatatattccatatgatatagtttggatatttgtttcttccaaattgcatgttgaaatgtgatccccagagttggaggtgagatctaatgggaggtgtttgggtcatgagggtggatccctcatgaatcgcttagtgcccgcctcacagtaatgagtgagttcacatgagactggccatggcatctcccctcccacc

SEQ ID NO: 66234 - DNA, 1022 bp, Homo sapiens
ctcttttaccaaagaggtaaccaaggcatagagaggtaacttgccagctcacacaggtaagcagttaagtggtagaactggagtttgaactcaaccagtctggctccagtgtgccttctcttaaccactgtgtaatactgtcactcatccagagtcacttccactgatgcctgctgaaatcaagatatttaacttttgtggcagttctgtaatctattgactctaattgcttaaaaaaaataggagggacctttgtgatatcattttggtgtgatttttttttttattttaacctgtgctggctcctgatgattattggtattttttaaattacaaagctatttgtttaaccatcttttccagaatttgataggaaatcacattaagcttacctctctgtcatttgttttacataaagaacattcttagtttaaaaaaaaaagggggaatttagttcatatccttagttgacaatggttgaagaaaaacatctcaaaaatcacttagtttatataaagtatattttgtaaactcctgttctttttacagtgaatatcaatcgcttataccagaggttctcaaacgtttttgtctcaggacctctttacactcttaaaaattattgaggaatcaaagagcttttgttgatgtaggttatacttattggtatttaatgtatttgaaatttaaactgagaaaatttagagacacaagaatgcccaagtacagatttcattagctgtcagagcgattgcatcatcacgttattcagcctctagaaaactataccacatacttgtgaaagagtgggagttaaaagggcagacaatgtcttagtattataaaaataactttgaccccacaggtcccctaaaagggtctcagagattccccccagtggtcccttgatcttaccttgagaacctctgccatatactaaataaacttattactgtcttcagttagaagaaactctaagactaaaattgaagatctagaattgaatatttcaatggaattct

SEQ ID NO: 66235 - DNA, 1060 bp, Homo sapiens
ttcactgtagatgtatggatttgattctgggttctgtcttctgttccattggtctgtgagtctatttttatgccagtaccatactgttttggttactatagctctgtagtataatttgaagttaggtaatgtgattcctccagttttcttttccccagcctaattattctgaagaataagatcaggcctggcacagtggcttacacctgtcatcccagcactttggaaggcgggggtgggaggatcacttgagtccaagcgtttgagaccagcctgggcagcatagtgagactttgtctctacaaaaaaatttaaaaattagcacgtgcttgtagtcccagctactcaggaggctgaagtgggaagataacttgagcccaggaattgaaggctacagtgagctatgatcctgccacagcactccagcctgggtgacaaagtgagacctcatctcttaaaaaaaggaaataaaaagaataagttcatgttgatatctaaatacaagtatttggacagattccccaagaaatactatttatttcttatgccagtagttactagagcagatactgaatatatctttctctgtctgtatattattaggcagatttctttaaactctaaactaaaacaaacaaacaaaaaactattgctagaccctggaaatcagataactgatttcatcaaatctacagaaatcaactcagctggtttgtggtgagataatttgttcctcacatgttcctttttcatagcatgttcttgtgcaatatatgaactaacattttttagaagcttgtgaaatattttctttgtggtttggatgaggaagaatgagatacagtgtgtcatagtagaaaagagaacaaacgtcaatttaatggaagattttttaaaagcttagtaattcttaataggatttatttctagacaaatatttcttcagtggaagccaaacatacattgactagttgataatttggtgaagtaataaaagataaacatctttctgtatggcagaaatctagaaaatataatttgacttatcttttgcagactt

SEQ ID NO: 66236 - DNA, 1047 bp, Homo sapiens
ggatttgatagggtctgattcacagagctgatcacaaggaattgccttctaacatgacccaaattcagaggggatacagcaagctagacatattaatattaacttttcaactatagagtaaggaatgccactttatcttcatttattcgcagtttgttgaatactttatattggatatggtgagtacagagatgagtaaggtaagctttgtgccctcaaggaatttaaggcctagaattagaaactcaaagaaatcaagtgcctaaagtcacttaatattaactaataacttacttgcagtagtaatgtgaaaacacttttaggaaagcctagaaaatatagaggttaattttgcctaatgataaatgaaagctttatagaagaagtgatgtttggatagaatcttgaggaatgagtataaattttctaagtagagataaggaggaagatcaggaaggggaagttaaactgtactacctatagtttttatagatgatttgatagatggtgtggagatgcacacattaggagagaccatagaaggaagagggatacaatttgaaggagatgatgaatttcattttggatatgtttattctgaagagcctgggaaacactggggtgaatatgtttggaaggtagtcaaatatctggcacttaaatgagaatttgggcctcaagatctcgctttgagggtcagttgcctatcagatggtagttacatagtatatagaatagatgagaagttgagtttggaaccccaaggaacattaattttgaagggtaggtggtaaagagtagcacgcggtatagttcattatttgtgtagtgtttgggtgtaaaaatcctgccttattttttctagattgaaatgtttgagaacaggtactattttattctatctatcactaatacctaccttaatactacacaagaagtatattaggattaggaaataaagcagaagccagaaatttaaaaccttatattggaagatctacatgcaactcagcctatttgggtaatgactgtaaaaaaaggagaact

SEQ ID NO: 66237 - DNA, 1058 bp, Homo sapiens
acaacaatattaaatttggttctgatttctgtatcaatggcttaagaataatgacaagaaacaagataggtaaaaggtttaaaacagtttcataggacgttcaagtgtgaactaaataaactacaaatttttatgattggaaagactgggaatgggatgtagactactagaaagagataagaagtataaaaattgtttttatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaaagaaaaagggggaaagagagacacctgaagagttggataattcttttatactatgtaaggcatattttaaagggctaccatttttagagggtacgttcttaccaactttttaaggagaggataaaattttgtgaaatcaatattatggttattaaaagcacaaaaggaccataaaaaaaaaattgttttcaaattcctaaaagtctatcatgtgtacaaggaaggtttcttaaaaaagttttgctcaagataaatagaaactaactataagctgaatgctttgagagagagtgaaatactgtcactgaatgaattcaggtagaagttgccaggcctctctatataagaagtcagtaaacttttctgtaaaaggccagagagtaaatatttttggctctgcaggccataagatctccagggcaactaccctaatatactattgtagtgagaaagcagccatagacaatatgtaaacaaataggtatgtccgtggtctaacaaaactttacttacaaaaacaggtgtcagaccagacagccctagtttgccagcctctatattaaaaagagggctggaccatatgaccttcacaccacttctagctccaagtttccataaaaagtcattaagcaattcaacaatatgtagaaataagtgaaaaagacgtatt

SEQ ID NO: 66238 - DNA, 1034 bp, Homo sapiens
tactgtgtcctaggtactatgccggtcacttaaagacatgatttcatttaatctttaattgtggggtattcatttgtttactacaaaggtccttctgcattttcctaggttgtttccttatgtacttcacgatgcaaatcaattgtcaacctatggattttatttatttattttattttattttttagtttttgagtcggagtcttgctctgtcgcccaggctagagtgcagtggtgtgatctcggctcactgcaagctccgcctcctgggttcacgccattctcctgcctcagtttcccaagtagctgggactacaggcgcctgccaccatgcccggctaatttttttgtatttttagtagagatggggtttcactgtgttagccaggatggtctcaatctcctgaccctgtgatccacccaccttggcctcccaaagtgctgggattacaggcgtgagccaccgcgcccggccttgtcaatctatggattttattccctcatctgttgctgctcagtctgaatttgatggctctcatgtgctctcctgtagtaccttttgtttctgtcatatgacttattgttctgttatgctctcttctctacctattttgcatagtctctggtatgtgttaaatgcatggtgaatgtttatttaatgaatgaatgaatgaggaaatatagtttcaagttctgagaatgataataaatccttaggtgaaatttaccccatttgaaagattaaattgattcattttagcaaagttgaagagacaaatgtacctaaacagtcctttttcattgtgaacatgtatgacttttagaatctagggagacaaaaaataatttttaaaaagattacattttgggggtatgagcagtgttctttactaataccggtattccctagcagtaaaaaataactcctgtacatcaattagcaatttgtttgcatcaaagagattttaaagatggagaccatctctttactttaggcacagttgcacaggacccctaccttggctcgtaagccc

SEQ ID NO: 66239 - DNA, 1043 bp, Homo sapiens
aactcctggtctcaagtgatctgcctgcctcaagctcccaaagtgctgggattacaggcgtgaaccaccatgcccagccctcagtgatgttttagatgtgatgaaaactggaagtagcagatcaggtactggactcaggtatttaaaaattcattcaacaatcatagttgcttctcaattagtattctttcaaattagaacttaaaatgttgtaaatcttgagagggagaatttttgaaaaactgagagctgcaagaaaaaaagatcaagtagggctacacttaaataacatttctttaagagagggaaaaaaagattacctgattttataattaataaaaggtaacatgcaacttcgaatgactaaataaaatttaaatgtaaatatatacttccatattatggtcagttatgttggggagaaaaaggagatgctaactaggcagagaaggaaatatagtttgagagggtctgtttaattaaactttttttgtcacagaccactgtgtacttgaaattgaaagaattagggttttggtaatacctcttcctattggtgactcttggtttattagctcctaagccattattcagaaatctttacctgctcctaaaatttaaagattcttttctgaatgggacagccattgcagcccaaggcaggtgaagatagtttatgattcatagacatgaatagaggatactctcctgaacttgatggtattaaactaaggactaataatgaaagttacttatctctagggttaagaatagaagtgttagtctggcaccatagcacgtgcctgtagtccttgctaaggcaagaggatctgcttgagcccacagtgagctatgatagtacttgtgagtagccactacactccagcctgggcaacttagcaagaccctatctctaagaaaaaagtattgaataatttttatgtatactttaccttcccctggtctttttagccacacccaggtatataaatataagagattatgggccaggcgcggtggctcacacctgtaatcccagcact

SEQ ID NO: 66240 - DNA, 1051 bp, Homo sapiens
gggcacagcctctgaaatcagacagcccagagtggctatgccgtttgctaattcaggattcaacgagaggaggtatatgaagccacctaacacagaacttggcacagggacagcactaaactcttgttgtgatataggtgttagatgataagggaggccgtctctgagcaatgatatgaccatgggactgcttttgttgtgcctgagacaggaagatgagggcagggacagagaggatgggctttctggagggatggtgggtaccagatcagccagggcctgagtgccaggctgaggagctgggacagttgcctgagggcactagggagccacaaacatggctcaacaatgtatggtaggattcgtgtttcaggaaactacatgactgcagtgtgaaaggtggacagacggggcaggggtggaggcacggaggccagtgaggaggctgctgctgtggactgtggaagcacaggcctcgggctgcagtgtggggaccgcgtagtgcatgtccgaggaatttcactggttggactaacagggcttggtgagtggtgggcttccagcagggtggggaagagggaggttgtccaggctgtatcagaggtttgaaacctggaaggatggtgggggcccttctcagaaatgagaaccacttgtggaaagtgatattctccattttagcctgttgagtcaaggcattttctaaggaggaggagacagggtgtgcacctgggtgcagcagggtgaaaaggctgaccatccctcaccttgtcatagtctctagagtagatcagtggggagctaccagcccaccggccttgtcaatctgagaccaccaggcaaggtgcactcagtaagcagtggcccagaggcatttcccgtgtgcacccacgccccccgtacccaagctattcctgcagtgcccccatctcctctcccacatccccccagccttgtactgcacttccagcttgggaacctgggctcagctgtcgcaggcccactcctccatcctaggcaaatgaagatggaaaaagaaaaactcaggagg

SEQ ID NO: 66241 - DNA, 1049 bp, Homo sapiens
gaaggatgaatagaagttcactaggaaggctgaaggaaaaaaaaaaatatatatatatatatatatatataatatataaacaaaatgaatcagattgctcccaagagttagctttattgtatcccaagttttctcaaagtgagggctctgtggggcttcacggggtggttagagtagccgagttgacaaagttagtgccctcactgttcagacagggagatcaaggcccgaggaggggcagggcctgctgggtggtgagtgagcatgtcactgacaggctgtgtattgctttcccagcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgca

SEQ ID NO: 66242 - DNA, 1046 bp, Homo sapiens
ctcagatgaaaaaagcttctagatgggggcttctaggggaggatagaggcagggagggggctgcagaggctgggcagccagggccctttagagaggtcaggagtggttctgggccccatattcagggctgcctctatgggtctggggggtcggttcttgttcccccatcctgtctgcttgcatcttttccccactctacccccttcttggtgactctgagatgcaccccgtttctgccagacccccagccctgggggctcactctccctgagacccctccttctaccttctggcttcagctatccctggagtttaggctgtggattcagatgggatccagatggcatatgccctggcatctgggttgggagctagattccaggctgtggattctgagctgagctcagcgatggccagtggttacttcaactgtggcctgcgctcccactgcgctccctgactgtgtgagaagcctggaaattataaaccctggactgattcagtcactccctttcccagcactctcatggcccctctgaactccctttctctttgtttctctctccttgtctccagttacccctggtcctggctctggggtttctcatggaggctgcagagagagcaggcagggagtggggagcggggcgttttgaacctgtccttccttctgagtcccagtgagggcagctccggtgcccctgaactccagtgccagttctgaaggtgggggaggggaggaagacagcaggtccagttcttgtcaggggtctcctccccagcctcctttcccatatatcttttctgggagccttgaaggctcaaatgggggagaggacaggagtaaaccaagggactcagggagactgaaggtgggttgggggtgcttctaagagaaggctttgagacccagagaggaggtgggagtttacagaacttctcctgccccacctcccttcacattctcctctaccccccacccctttctggagctctgaggcgggacagatctgccataacatgggcttctccctgccacgaacaga

SEQ ID NO: 66243 - DNA, 1206 bp, Homo sapiens
actgaggtctcactctgggtttcttggtatcccccgcctttccctgtctccctgggatggggcctggtgatgagatgtccaacttctgggcaggccagaagggcaggaggaggaagaaaagggccagggcctttaatgccagaactgtctacctggaaagactcttagaaaccagccatgttttctagccttcctcacccctgcatcattcagatggggaagctgaggcccagcaaggggccttgcccaaggccacacagtagtggactagagccagaaatcccccccatgcatctcaccattgctccagcctcacactgtaaggggtcactgagagttcttgagaagtgcagtgacgtggttcacctggcattttagggaacttgtctgagccagggcaggaaagggaagcccctgtatgtgtctgaggccaagaggggcagggaggtctcagtttgaccagagcacctggggagaggctctgtgtgggcaggaaccaggttgaaagcctcaagtgccgagttaaatggcctgagcagaggggctcccctctgccagctcccctctccctttctgggagaggaagggctgggagcactgccagctttgcacatcacagtatcctctggttgtgaggtgatgatctgacatgagggtgcgggaacatgagtagcctgagcttaggtagcagaggatgtggagctggcgaggggagaactgactgggaagacaatttggaggcagaatctgggaattcgaatttaggttcaggggttatatcagaaacagggttgggggagcgggactcacttcttgtctcggcagaaatttcctctgcattctgaaagagtgaggtggctgtgagccctgcctctgtgcccagcaagcctcctgtctgacctcaaaccctctgctccagtggaagtgccctgcctctcaggggggtccctgaagagccccagagctccaggccacacctgcagtctggccctcctgggagaggcctaatggagggagcatggaagggaatgaaagagcaggcttgggctgccttgctggctctaacctaagacaagtccctctgccttggtttccccatctgtgaagtgggagtcctccagagtccagcagagctctagaatatgcaggcttttgggaactgagggagagggactggtaggtccacaggcaggcatccttgccagc

SEQ ID NO: 66244 - DNA, 1021 bp, Homo sapiens
cccaggtaatcctctttggtagggggatgagctgagctccctgagggaggcttggagttccccacgggcagctgtccaaaggaaaagagtggggctatgcaggagggatgggactctgcaggctgggggctctgccggagttttgctagcagaaatccccaccttgctttaaagttgcccatcactgactctggagcagctggtctgtgttccttgccatacagatgggggcccagagaggggcagggttgccagagtcacccagtgacttctgaccccaggaccttcctccaggctggggactcactttgaagctcaaagcccagccctgaggtcgctctacccaaggcaggggttgagcgtttggcttgaaggaggaattggacagttctaccccagtctgaatgtgatttgggcagggagggcttcctggaggaacaccacatgtgagactggaactgtcccagaggagaccaatgtggaaacagaagagggaaagcaaagacaaaggctccaaacttggggctccaaggcagtgccccctgttctctggtgcagtcttcattcagtgggaacctcgtcctctgtatgtaggctgggaacacaggtggtgccccagctatgaggaggcacagactgagacaggaacatcaggcctgtgtcaccagggcagggtccgggctggggcagagatactccgaggccaggggagcccagaaggtctaggagagagagtcatggagggagcctagagaggcaggatggagaaggaagaagaggggtgcaaaggctgttcagagatgagacgtgaggctggagtgggcagcaggggcctgattgcaaggtgaattttttaaattaaatttatatatttaatattttgaatagatgatatattcacatggttaggaaaaatccaaaaggataaaaagtctccttcccacctggctgcctatttcctaccctgcctgaccccaggccacccagctagtagtgtctttgtgaatccttttatctgcaa

SEQ ID NO: 66245 - DNA, 1040 bp, Homo sapiens
gatccctgctttccagtgctctgtgcaggtcaggaatcagaggctgaacggtggtggtcctgggccacagggcctgattccctgagcactggtctggtgctgagccagtgttagacattttgaatgaaataacttttagagctgggagaggagggcccctggaggtcatctcattcataggttttaagccagggctgggaccacaggccaggccagtatgtaggcagaagtgtgcataggggaaggtgggtgcatttcctgggagccctaaagcaggagttgccagatttagcaagtcctacctaccctaaggcctcatgggattaccagtggggtccttctcgactgccaagggcagggcaacctcccctgctcagactcagatgtgggacccagaagatctgggttctggtttctctgcctgtaaaatgggggtgacagtcccagcctcttgggctgagaggatgattgcattcaaagcttctgagctcctaagatgtttttcacatctgttgggggtctgtctatccatctacttctcaagccccacctcctgcttcccgctattatccataatgagaaacttttccttcccagcctggaaggtccagctgtatcttcttgaaattgggagggaggggggcggatctcagagaagaaagaaagggaaaaaacccacattaaaaaaaaaacccaccagttaaattcaaaccacatgcaccacagcccctgccatgtgggcctctgctgccacctgtgggcgtctggtggaagtgcagttcttggggcttcagcttcctcactggagccataggcttaatcctgaagcctgaaatcaggaaggaaggtcaagctgtccatcctccacctctgagcatgacctcacccccaccacctctgctgccaggaagcctggtggggaatttagaatccatctacaccttcccttctcccccatttgtttacagagggggaaactgaatcccagagtggagaggaatttggctaaagttgcaaagcaagacagtcaatagataagt

SEQ ID NO: 66246 - DNA, 2805 bp, Homo sapiens
ctgtctgacagctgggaaggtgggtggcagaagaggaggtcaaggccattgagatccggcaaggatagaggttacaggaagggagtgctggggacagacactcaggaagtggactggtcaggccaggcgtggtaactggttggttgtggggggcaaggtggggaagcccaagatgatgtctgggctcctggcctcggataggtggggcccaggggagaagcacaactggagcaaggtggtgagttcaggctcagacatgaacctgggaaggcccacagcctggatgcacacatggcctggggctggatgagtgtggacctgagctgaagtggggcctggcagtcaccattgaggatgaatttgcccaagctagctgggcagagtgacagcaaagggtaaaggtagaaccttcaccctatggaaacatccagagcattcactcactcaccattcattcattcattcactcactccacaaatccacggtgagccccttctgcgctccaggtagtgttctctgtgcaggggcattagtggtaagggcctgtctcctggagctcacggtctatggcagagactgacagtgaccagccagacatcaacacacagtggcatgtggtgatgcagaagtgcacacacagagaacctacacacaacagggatacgccttaaaaggagggaaattctgacatcctacaacatggatgagcctggaggacatgatgccaagtgaaagaagccagtctcaaaggacaagcactgtctgattccacttgcatgaggttcctggggtagtcagactcagagatggaaggtaggatggtgggtgccagggaaagggtgccaggctgggaaaggagggaatggggagttactatttaatgggtgtacagggttgcagttttacaggataaaaagagttttagagctggatggtcacacattatgaatgtatttaataccattgaactgtacatttaaaatggtaaattttatattatatgtattttaccataaaatacaatgcgtttgtttattgtttttaaaaagtgcatggggagatgagaacacagaagggggcctaccctggtgtcggggtcagggagggcttccctggggttggggtatttagctgagacctgaagggtgagtagatttcagcagaaagagcccggagggatggctcccagcagagggtatgtcagggacaaaggccaggaggctggaaggaacctagagcagcagggaaccagaggtggccaggtggctgcaggaaggaaggctgctgggcatggagctgggctttcctgtgcacgcaaggaagccatgggaggatgcagccagaatgccaggcaggaggagtagacatggcaggggcctgagggggtcctttgccatcccctagatgagagttggaggcattagggtcagacagtccagggttgaagtcacgtgcgtcctcactgggtgatactagcctaatcacctcaccttctctgagcctcaagtttgcctgcaaaatgtagctaatctacctatctcccatcaagaagacttaaaggtgagccaggcgcggaggctcacacctctaatcccagcactttgggaggctgaggtaggcggatcacctgaggtcaggagttcaagaccagcctagccaacgtggtgaaacctcatctctactagaaatacaaaaatcagctgggtgtggtggcaggctacctgtaatcccagctcctccagaggctgaggcaggagaatagcttgaacccgggaggcagaggttgcagcgagccgagatcctgccactgcactccagcctgggtgacagagcgagactctgtctcaaaaaacaaaacaaaacaaaaaaaacaaaaggtgatgacggcacccatgcctgttcacaggcaggagtcaggagcagtggagagctgggagcaggcagggcttgggcatgtctttctacctccgccaaatctcccagacccgtccagggctgcacttgggagagggtgcaggacctgtgggtggaggaagccagaatgttgggtgagcaaggtggaggtggacaggagggtgtcacgtgaacccaaagaccgtccctggaggcagccctggagtgtgggaggaggactgaggtctggctccaggtcaggagtatgactctggagccaagccaccagcattcaaacttggctccatctcctggccagctgcatgacccggagcatgtcacataaccagtctctgcctcagtttcctcatctgtagagaggggataataatagacctgccttgagtgcagttaattagagacacatgtttataatttagcatactgcctgcagctctgcaagcatggtaaaaagttgcatttaatctttgtattaaccttgtgaggtagatattatattctttatacaaagaaacgaagactcacagaggttaagaaacttgcccagggtcatccatctagtgagtggtattagttgacattcactgagtgcccactatgtgccaggcactgttctgaatgctttagaacagtgagtaaattcatataagcctgactataaaccccattttgcagatgatgcagctgagacacagagaagtaaagctgcttgtccaaggtcacagagttaggaagtgccacaccctgggttgaaaccctgtcattgtgactctgggttctccctgtcacccactagtctacactgcctagagcacagtggtattcaaattgagattggactccatagtcccagtgttaacttcgaaccatcactgccctcactaattgat

SEQ ID NO: 66247 - DNA, 1021 bp, Homo sapiens
ccaccccaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggtgggtcagtgcatcataccccaagctagggatcatggacatttggtttaggactccccactatcctgccagaagagctttcaagagggaggaaaagtgtcacatagagctggaggtggcatatgtgacaggaaatacaccacggaagtgtccaaatgaaatctaggatagttgtgtgtgtgtgtgtgtgtgtgcgcacctgcatgtgttgtgtgtatataaagttctatccagagaaatgtcatgagagacagggagggaactataacctaagaggtagaatatgtcacaaatagaatatgtatatagaaaatatgtcctgttgtatatatttcctatatgcaccaggaaatagcacaggactagaaatgatatatagggcaggaagtggaatcaggaagtgatgcacagagcaggaaatagaaatagcaacagaaaacaacatagaatggcactagcacagaaaatggactgataattagaaagtgaaacagccgggtgccaggcgcggtggctcacacctgtaatcccagcagtttgggaggatgaggtgggaggatcgcttgagcccaggagttcaggacccagcctgggcaacatggtgagacaccatctctacaaaaaatacaaaaattagccatgtgtggtggcacacacctgtggttccagctgctcaggaggctgagctgaggtgggagactcacttgagcccagggaagtcgaggctgcagtcagcagagat

SEQ ID NO: 66248 - DNA, 1031 bp, Homo sapiens
ggcaacaagagcaaaattccgtctcaaaaaaaaaagtgaaacagcaggaaatgaggtacatcaggaggccacaaccagaaaagtcttgctttggcaggacaagaaatgatattcccaagaggaagtggctgtggaaatcaggaagcaataaagcctcgggtcaggagttgtctgggttcacagaagacttaagctacctgggaaagggctgttggaagtaggaggcttatttaatgcaaggacgttgcgtgcagtaatcaagagagatagaaagtggcatcttacagggcacttacattgtaaaaagaaaaaaatcagaagtggcgtcaccttgggaaattatgtgactcctgactagagattacagatgggacataagaagtctggctgccaagaagtgggcatttctttctaaataagttcctagctaacagaaagtgggattcccccataggaagtgtgcacatcttccttcctatcttctggggtgtgggaattcaggccccgatgggacagtgaagcctccattcgcccccaagctgacagatcctcccctctgcccccaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctg

SEQ ID NO: 66249 - DNA, 1058 bp, Homo sapiens
ttggtggccacagtggcctcctgtcagcaacctcagggctcagtctccctggccacatgggccttccgacgtccacacacttgggaagaagggaggccttggagacccagaagagtgctggacggcgaggttgccacgatttgctgtgttacctgggcaggtggctgggctgcagtttcctcatcaggaaaataaaggggttgtaccagttcagtgctttgtaaccagggttacatggtagaatcccttgcagatgacatgtaaatgcagaaacatgattcgtaacttatttacgtattaattgagagcttctgagtcagtgggcctggatggagcttgggaatctgaagctgacatgctccaggtaaagagccaggacccctgttgagcctgtctacggctcctccaggaaacaatgttctccagcaaagcctcagctggagaaccctgatgaaggccaaggccctgctccaaccctctgaagtgtttggagcagggatagaatccaagtctgtctgatttctggtctgaagaggtctgtcattaaatcagacacaagaacgcacaggcccagcaacatgggactattctgtgcaaggacagagagccctccagaccagagtgcacctgcagaactagaggtggccatcactagaaggcatgtcgtgcctcagctctgctacacgcacgaacgtttccagcctaaatgactgacttttgagtcagcccctgaaggggcatgcaagctcatgctctgcaaactggcagcacacctctcaggggtctgctgggtcctcaacaccacaggacgggcatggaccgtctccgtgcagcatcattttactggggctatctggggaggaagggattctattaataagcacagatatattatggagtaggaggcatcattcatgtggaatatataacgaaacaaagcattagaagaaacacaggctttgaagctggacagaccttgtttgagatcttgactttgccgctaactagctatgtgcctttgggcaagttgtatcccctctgagcctccatttcctcac

SEQ ID NO: 66250 - DNA, 1086 bp, Homo sapiens
ccacttgagtcgccagtgcctcccacactgccagtcagttgctgttccactgctttccagcttctgctgcctcagggcctccgcctcctccactcggaggaccctgggcagacttcagttttagcacaagatacccaagaccagatcctcaccacttccccgactcaagtgcctcagtaagaatgggcttggcccagcccactgttacttagaggcccacattccagggcactggccagcctgtggacagcccggaccccatcagctgtgggcagggaggccctggaatgagcatcagaccccaggctcccggcccaggggaggctcctggaaggattacctcctctgaagcagtggttctcagcctgggatgcacattatgatcatgagggcctaggccaattccaagccaattaaatctgaactttgagggtgggacccaggtgtctatatgtttttcagaaacctttagttgaagtataacatttatacaaaaaaggacataaaaaaggacccagcgtgatgggtattcataaagtgaacacacccaggtcaaggaacagaaaatctcatcaccccagaagctccccttagacctccttctggtctgccctccaagggtaaccaccaccccggcttctgacaccatgatctagcttcaccagccaaggtagagaactgctgctgtaaagggaatgactatggttagccactggtgtgggggaaagtggggcttgggtttgatgttaagagggaacgccagcctggccaacatggagaaaccccatctctacaaaaaatacaaaagttagccaggcgtggtggcgtgcacctgtggtcatagcgacttgggaggctgaggcggagaattgctttaacccaggaggccaaggttgcagtgagccgaggttacacagcaccccatcctgggtgacagagggagactctgtctcaaaaaaaaaaaaagaacagctcaaaccaaggcaaggaggggtagaggagcctggtgcaggcccaggtggatggggaaagaggaaaaggcaggggcgcctagattgggagctccgtgagcgtgggattttgttc

SEQ ID NO: 66251 - DNA, 1049 bp, Homo sapiens
tggctgtcggggggcgcgcggggaagcagcggaacttgcggtgtgaggggccggcggggcccggagcggtccccggcccgggaaacttggaccgagaccaggttgtggtgcgggctggacggcggcgcctcggcgcggctgcggcgcggggcggccaagggggggtctggatggtgtcagcccgtgactgtgggtgacacggcgcgtgaggcggcctggccgggcgaacgtgtggctgggacactgggcggtgacgccgggccgagcgggcgacacagaggggctctgtgtgtgggagacaggcagcgtgtgtgcgtgtgttgtgtgagggaaagacccggggtcactggggtcacgaagtgcgtggcttggggcgtgaccggcgcagggccagggccacccgttactgtgagtgtgaaatagagggagaggagcccaagtgactgagaacgagccgagctcgctggcgccatggtgtgcgtgtggggtcaagtggtgtcagtgtgtgtgtgtgtgtgtgtgtgtctgcgcctagggtgatgatgagtaagaggcaggaggaggagggaccggacctaggacaccttccggcagatgtggggcgatgaggaagttggggagccaggagacaagggtctccaggactgtccccacgagggcacccctcaggagttcagcttggtgaggagatggaccctgagggataggccctggctgagggagaaagccgaggctgggcaacatctggtggggtggcccagatggcagcagggtaggggccctgtggtagtctcagcttccccccgcccacctgcatccacacactcacgcatcgaagtccctacacctggcaaagttctgcccctgtgtaatctgtattctcagcggacccggacacaatcttgttctcagacccccccgcccccctcccccgcgcaggcctcagtctccccatctgcacactgaggtgctgggctttgaatggactgtgaatcatcactttgggatcctctattgttttgggtcaactgcctgtgttctcccttccc

SEQ ID NO: 66252 - DNA, 1060 bp, Homo sapiens
gggctgtggtctcccccaagtccctcccaaagcctctgcccaggtcttccaggtcagggtgattgggggcagggcccatgctgagcacattagggacttgggatcagttttatggccggggcaggtggcaaaggtggcttcttggaggaggtagcagagcatgagccggggctgcagtgaggtgtccttcagcacccccagacccgttgctgtcctgtctcagggccagggttggcaacacagggctgtctgtggtgctgagaggttgacggtggccagaagcagtggagataccaggcctgggtggctcaggcaggggtcgcctgccagttgcccctactccagggtaggtaaacttcatctccttcaaggtgaagttgttacaggctaccacttgacctctctgagcctcagttttttctgtgtgaagcatggaacactgtctttgaggggttcagtgagacccagcttagagtgggaaggggacaggcagtagtgctcagtgaggagggttagggagcctcctctctgcccgagataactgtctggtctcagacatccctcctctagccccagactcggcccaggaagtggggcaaggattgcacctgtaccatacccagactgggaggagctgggtgggccaggtgtggccacctcagcccttttcttggcctcaaggggccaatttagcccccttagcctcagccccaccccatccacctgagccactgaaacccaggcctggtggcagccaggaggtctgaggtgcagaaccatgcccaacttctgggggtgttgctgagagtgggctggggagcagctgctgcctggcctcgaggtgctccccagcccttgagggactggtttataccccatcgtggtgacctgggagctcatggctgcccagggctgtgggagggggcaggagtggagcacctgtctcactgagtggccctgagccagcctctgcacatctctgagcttccagcagcagccctagtaagctggggttccaccctgggacctctttttccccgctctgggaattcccagactt

SEQ ID NO: 66253 - DNA, 1039 bp, Homo sapiens
aggtgatatgggcttctctgagcctggatcccacatttgcagggctctgggaggcttgtcacctaaatgcacatgctcagggcccttaagaaggccagggttgccctctgctggcagatcatggtttagctcaggagtgcggcttccccctcttccccaggatcagggcccttctcttccccaggaatcaaccctgcctaccggactgaggatgccaatgaggacaccattggggtcctggtgcgcttgatcacagagaagaaaggtgaggagaaggtctgaccccatcccagtgcccaggagaggagggtttcctccaggagcctgtgaggcagccgcggtgggcagagtcttgccctgctctgccttccctgccagggtgcctcaagcagcctggtgctctctgacccaggagtgcacacctctgcctcccattcttgcctgatgaagtgggaggaaaaggcgcacagcccaggctgggagtggtggtatggagggtaggtggggggttctctgctggggcagggggtgggaggtgtgtcccatatggccacagtgagggtctgactgcagctacccacagagaatgctgcggccctggaggagctgctgaaagagtaccacagcaaacagctggtgcagacgagccacaggcctgtgtccaagtgagtgggctggtgggagataacggggccaaaacctacattaaccagcctgcctcctggggatctcccacttgggtctccctcaagtcaccctgttccctgctggggtctcctgcccctggcctggcctatggccacttctgcctgtgccccctgcaggctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggcca

SEQ ID NO: 66254 - DNA, 1003 bp, Homo sapiens
ctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctgg

SEQ ID NO: 66255 - DNA, 1051 bp, Homo sapiens
cccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattcccccccaaaaaaaagtcttaggtgactagactgagtggttcttggggagggaggcacagaggactgtcctgggccagtgagtcccttgggcgtctccccaagttgatgctaaatttgttctcagtagtcaagaaaaacctatggtacatcttacagctgatctgacaggggtctgccctaagggtctcacagctgctggggagctttaagtggc

SEQ ID NO: 66256 - DNA, 1010 bp, Homo sapiens
ggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagt

SEQ ID NO: 66257 - DNA, 1062 bp, Homo sapiens
gtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctg

SEQ ID NO: 66258 - DNA, 1039 bp, Homo sapiens
tcttctctctctggatgctcaggtaccctgctgactacaccccagcacacggcgattggggcacaccctgtctccatgccaacatatagggcccaaggaacccctgcgtacagctacgtgcccccacactggtaaagcctgcagcccatccaagtgagtgtggccagggtgagagaagtgggagggggatacatacaggaactgcctcaaagtccctggtttgggtctggagcacaggtgtcagctagggcaggtaacagctgtcaagttaccagttgctttcctgctccaaggtccataatatcactcttaataatagctatcacttctgttgactgcttgttgaaatctaaataataacagaaataataatagctatccctttgcttatgttatctcataatccttatagttgctctgtgaaataaggatcattagctctattttacagataaatatgtagttaaatatcacttagccagtaaaaattaagctagggcttaaacttcagttctctagtactaaattctgtgccatttaccttatggtcttcggacttcttttaactatgggccccattcttcaaatgaactcttgcccagatcatatgttaagagctttggttggagctatttggaggctttgggctgacccagacctctggcttccttggtcccctcagcagctcctgaggcagtgacagtgaaccatagggctccagggatgtcactttgaaatcctctggccccccacatcatctggcctcccccatctcctccagggctcttggcaccagagcacaacaacttccacaggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttat

SEQ ID NO: 66259 - DNA, 1043 bp, Homo sapiens
ggaagagaaaaattccagagcacattctccaggagcataaaggaaagtcatcagcatctttggcctgttaactttaaagaatcataaaatcatggcattttaagccataacattttagaatcttagaatcctggagtctgtgttccaagctgggacagaccatagtagtcatagattagctttagtctctcagaccaggctctgcctgcatacccttaggacagaagcttactgtccctataaagtgagagagaaaataataatagctgatctttataaagtgcttctaatatgtcaggtactgttctaagtgctttttacttaacagttaatgtatttatcacaatgaagtaggtaccattactgttcccatatcacacgcgagactgatgtatcctatagctattaagtctcagagctgggggtttggacccaggcagtcagtctgtctccagactgctcataaccatggctctgtgctacagagctttcagaaacaggcaccttctgattcaggggtgtcctactctcctgcatagaaaagggatgctttcagctctgctaggtttctctacaccttgatatattcctttaaattaggggtcagcaaacattcctgtaaagggccaaatatttaggcttttaaaaaggccatatgctctctgtcagtgactaccattgtagcaggaaagtagccttagtcaatatgtaaatgaatggatgtggatgtgttacaatataactttgtttaccaaaactagcttcaattacaaaaaacatggctgaaatttaattgttttaaatgtttatagtatgaataaaagattctgtggtaaaattaatttggaaaatacagtcttgtacatactcccatcttagagattcacagttcacctccccaccttctttaagagacagggtcctgctctgtcacccaggctgaagtacagtgttgtgatcatggctcacaacagccttagactcctgggctcaagccatcctcatgcctcagcctcccaagtagctggggactacaccagcca

SEQ ID NO: 66260 - DNA, 1346 bp, Homo sapiens
aatagggatatacatgttctctcttacatctaaacatctggatatagacgcatataggcacacctactgtagtgtagcagaaagcagcctggagtggaagctgcattgaattctagactgggttctgtgtaaccttggataattgatgtccatgcattggaccttgatttttcaaactgcaaaatgagggaactgaactaaatcatctccaaggttctttcttgcaattagactccttatctctcagcaagatgatgtgtactcagcgtcttccaccccaacagggaccacctctctagctgcccttagctggccaacaaaccatctccaaaaatggagtactcattcccttcagaggcaaccctttccacaggaagtctgagtaacagaaggccttgccttctactatgttgaaatcttcctgaaatcccattaagtgtccagcagccacatcccactgttccctcccagacaggctatcacagtccctgaaaaagaccaaaatgtacccacccccaccttttttttgagacaaggtcttgctctgtcactcaggctggagtccagtggcacaatcacgtcacactgcagtctcaagctcctaggctcaagcaatcctccctccgcagcctcccatgtagctgggaccacaggcatgcaaaaccatgcccagctaatttttttaattttttgtagagatggggttttcccacattgcctaggctggtctcgaactcctgggctcaagctgtctgcccaccagctaccatgcctggcctacctctgtttcaagcaagtaatgtataaacctgtgccattttttaatgcagttggggttgactggccctcccatactcaaaaagattcctcccagcattcagattttgtggcttctagtaccacagaaaattcagggcactttgacaaattcagttcaatttcactgatacttgctaagcctgtttgtaattaggtctcctgctgattcatcactgtctcacttggctaccaacaaggagtcttaggggtcaaagcaagattcagacatagagctttattttgtccagacatataaatctgatgatcaataaaccaattagtctaaaaggcatccgtgatgcaaggatcaagcctttgaaggtggtagggcttctacaactgaaaaagatttatgacagtgaaaaaggattgcagaaagcgctgaaaaggttttatcttgttaatgtacatactctttttattatcccatttgattctaaaattatggttaggaacctaagagaaagaataggacatcataaacaaagcctcttttataaggcagagctgggacttcgagtgatcta

SEQ ID NO: 66261 - DNA, 1240 bp, Homo sapiens
agaaacgcaaaatgattgtttaaaacagactctcctcctcctgcattgtctgcagagccatgtcttcatgtccaggaaaggccctgggctctacatggagtactgctgggtctccatttctcttatcagaattctccttttagtgtgactttcctgcccatgatttccttctcatttctcagcatctgctgtatatattgctggccattaatgcaaatgcagagtcagcctacaatagccataattctagccttggttcaacaaaaacagcacagtccctgaccttctctggccccagtacttctgggatcgaaggaaccagaggcattacctgttacctgaatgggcagagggggttacgggatctctctagaggtagaatgtccttgtcctggtggaattagagagtgtataggcatactttattctcataacaccctgtcttagcctcttatttaaatgttttaagtattgccaatgcagccccaccttctgctaatatactatatagcaccccatatccatgaccccccccccaagactttatttgagtggaaaatatgttgctaaaattcttcgttttaccataaacagtaatttgagtcaagaatgtttcctctctagtgtttgaaattataataaggaaaatgtctaaaaagttaggcaagtcccacttcagaactctgtttctcttctccttccctcaggacaccatgaaggtaagttttttgagtcactccccatttctaaaacatatgaagtatcatccttcagatgtctcgagctgagctttgagtcagcctgggaagtctttgcagatcttaaactgggcctcatctatatttcctacctaccccaaatttcatatgtgctttcttaatggcccaaaggaccacctctaattcatgaggaaatatcccaggtggggcacccagtaacacctcagtaggagatattcaggggtatgcaagaagtatgtctgtctggcctcagctgggtgtacaggagaaggagttattagcaaggagtgccccactggctaactaggttcggtgtggcacagtgcccagtgccttttaagctaccatggccacagctcagtcccttcagaagagatggtagtccagcaaggttcatgtaatgtggtcattatttgtgggcctgtctttgaaagcagcttataaatatacctccagatgatatttcagacaacaaagagtgctcagttgatctggtgaca

SEQ ID NO: 66262 - DNA, 1050 bp, Homo sapiens
gtatgggctctgtggttagaaagtcctgggtttgaatcctgattacccaactcactagttgtaaggccttgggcaagtcacctcacctctctaagattcaaatgtgactacctgcctcagggttgtggatggttttatgtaagttccatttactcaataagtattgaatgtcttccatactggaatagaaaaattaaatgatgccatctttgcctgcctgaagtagctcccatttgggagcctggcatataaactcactgcagtactaatgtgctaagtattgtaaaaaggaatacatggaaggaggagggaacaacggtctgcctgggggtgaaagtgtaggggaagcttcagagagtggagaacaacagagatttgaagaagtagaagctgttctttaagcacacaaaggaatagtgggcattccaggcagagtagagcatgggcagaggcttagagatgtgagaacatgacactgtgaggaacgtagaagtaggggagtggctaaactgtgagcagctagatgaatctgaactatagatatacaagggctgacttggagaggccttgaatgtcttgataatacccgcccattttcttgtttagcacttatcattatagaattagaaagcttcaaaagaccttagagatcgtccagttcaaccttttctcttgaaaaaggagaatcaaaaagcagtgttttgtcccaagttacccagtgagtcagcagccacatatggactagaatctttggcagatctcctgactctcgtcctatgcttttctctgccaatctagtatttattctactgtcattctctttcttggggcttacttaaaggagaaaagaatacaggttgtctgaagacctagatttgagtcctcactgtgtcatttcctagattcgcaaccttagagtcacctgacctatcagaacctcatttcccccatctctaagtaggaatcatgtcataattatacacacacaccaagaagttatcagacagcccctgttttttggacaaacaagagctattttatgtaaatagg

SEQ ID NO: 66263 - DNA, 1031 bp, Homo sapiens
attccctgcagctcgccagtggaaggctgggtggctgggccttgaatctaatatacaggctatcttagattcaggtctggtggacaggttcagagccagcactacagaactgctgcctgcttgggctgacctacattttcaccagtatagcactctcagcagtcaagcctcccagctagtaagagaaattcagattcatgcatttttctggagctaacagattcaagggtctatttattttatttccttctgcctatcaaagaaaagaagggggggtgaggcggggggatagtacttgcaaaccctgcagttagagtgtttcccgtcattctttgtagcttcttagcccacaggactaaaatggggttttgtgctcaggatcagattttgtaggctctgcctcctaaacatctttgtagtccctcctctcttcatcctattgctagtgttttagcttttcctttgggctactgtagtgacttactatcgtgttcctccttctctgatcttaaccactctgaactccttttcattctgccgccagagtagtttttgtaagacatacatatgaaaccccccagtttaaaaccctccaatgttttcctgttattttttgattaattccatcccttagcctggcattcaaatcccttcacagcctgtcccccagtctacctttttatctttatttcctgccacttttccccgcacgcagtaaattccaactgtacttaactgtttgccatttccctaatgtggtatgcactttcataccttcatgcatggaatcagtatatatttctttgttcctgccccctccgcaccttgacaaactcctcccattcattgttcaaagccaactaaaatgtttatttctctaagaagcctttcccaactattctaaacatgttcttcatttcctcctcagcattctgataacactttcagcattctctgattatatcttacatatattactgctagagattaatttaaataactatattattttcccattagactgtaagtgc

SEQ ID NO: 66264 - DNA, 1050 bp, Homo sapiens
tttcaccttaacacactgcggggaaaaagagcaaatgaagcctaaatcaagtacaggaaaggacatgataaagaaatcagtgaaataaaatggagaaaaacagagaaaatcaataaaccaaaagttggttattttaaaagactggcaaaatcaacaaacctttttagctttagctaggctgatgaagaacaaaagagagaagtctccaattactaaaatcaagaatgatacagaggacattactacagacttttaatagaaataaaaaggaatatgaggtaagaccgtgaacaattgtatgctaacaaattaggcacctaggtgaaatagacaaattcctagaaagaaagaaactgccaacaccgactcgtgaagaaatagaaaatctgactagacctataagagagaattagtaatcaaaaaactttccgcaaagaaaagcccaggaccagatggcgtcattggtgagttctaccaaatatttgagtaagaattatcaccaatcctgcacaaactctttgaaaaaatggaagataaaggaacactttctaactcgttctatgaggccaacattaccttgataccaaaaccaggcaaagacatcacaagaaaactatagatagaccaataacccatttgaatacaaatgtagaaacccagaacaaaataggagcattgttttgggtcctatccaacacctgatattgttacactttaaaatttttttgcctgcctagactgggtgtggtggctcacgcctgtaatcccagcactttgggaggctgaggtgggcggatcacaaggtcaggagatcgagaccatcttggccaacgtggtgaaaccccatctctactaagatacaaaaaattagccaagcgtggtggcatgtgcctgtaatcccagctacttgggaggctgaggcaggggaatcgcttgaacccgggatgcggaggttgtggtgaactgagatagcgccactgcactccagcctggtgacagagcaagactctgtctcaaaaaaaaaaaaaaagtctgtctgataggtatgaa

SEQ ID NO: 66265 - DNA, 1081 bp, Homo sapiens
ctaaggtcacactgtatagcagaggccaaactaaccccagttacaaagtaggtgcttttagggctctagcatacatggctatgtcttggacggtacagtgattaggatctcagatgagcctggaaaatggattttaatttctgaaactgttctcacaactccccctttgatgttcaaactgatctcctctcctcaggagagaactccaaggtcacttaattactttttcacctatggttgaagaagagcatctaaagagaattcttattaactgttctcatgaatataatctccttgtggaccctttttagcctttatcctaatttgactcttctatatcatttgacacctgacccctttcttgaagcaagctttcattgcctccataattttcattgaccataattgtttatttttgtttgttttccctttcttcttctccagctgttcctgaatttgtctcctttcagaattttcttcccctgctcatccattaaaagttgatgtttcacaagggctccgtttctcccttagcctcagctgctgtctataggctgatgattcataaactctagggctgtggcaaaccattcttctgagcttcagactagtttatccagccgtctcctgaacatctcctccatgaatgtctcatgctttgctcagacttattatgtctaaaactgagctcattatcttatcattcccctgtaacccattttttatcattttgtgattaataccactatctgcctattcctaaaatcagaaaacatcatccttgatactcttgcctcttttgccttctaaagccagttattaagtcctgcctttttaaaaaagattgcagtaaaacacatgtactatcttggctgggcgcggtggctcacacctataatgacagcactttgggggactgatgcaggtggatcacttgaccaagagttccagaccagcctgggcaacaaagcaaaaccccgtctctactaaaaatacaaaaaataaccagatgtggtggcgcacacctgtaatcccagctactttggaggctgaggcatgagaatcgctggaacctgggagg

SEQ ID NO: 66266 - DNA, 1160 bp, Homo sapiens
tttcttttctaaaatgttctgattgtgtcagtgtccaagcatcacccaggggtctatctagtatgtgttctggagtgtgtcagatctctgctgaaatctggtctctgtcactaattagctatggaactttggttgagtaatctttctgcatctcagtttccttgactgtaaaatggaataatgacctatacagatggttggtttgtagtcggtgaaaatgtttataaagcttctcgtgtcgtgcctggctcatagtggacactcaattaatggttgttgtaatgcatagcaatgagtatacacctacagggaaaagagcatgggacatacagttagtgacttagattacagaccctattctgccacttaagagctatatgacatcagataagttatcaagctttctgggcctcaatctatcatttgttttaaaaaaaaaaaatgataaaacagggttaggaatgccttcctcacacgacagctgagagtaataaatgtaacagggctagccactgacttgtgatgaagtttccaaaacacaattagaaaataattctaaaacgggagaacagatgaagcccttaaatgaatccatcattttataggtgaaaagatggagtataagaagtgttttgaagaaagtgttggggttgagtctggaacccatgtctccccatctgggtctgtgtattcattgtctctctaccacagaataacaagtgttctcccttctcttcattccgttgtggccacttcacattcctctgctagcccactccagttcaagagctctttctgactcctcctgtgttgacctttaatgaatatcctggcttcagccagtagaaaacataggtctaaatgctacaaatacagtaacaaaagatacaactctcaaggttagaaggctaggaaattaatctgttcaaagactaccatctttttttttttttttaaaccagtgtttgttttcccccccacccccagattgctgtttttgcttaaaactttgtaaggatcacctgttggaggttttgattaactgacatttgtactttgtttattctttgcaaagaacttttgtgggatttttcccttcgtatgtgttttttttttttttaataacaattctggaagatagtttttattttccagatgaa

SEQ ID NO: 66267 - DNA, 1041 bp, Homo sapiens
gttaattccctgctgtagattctaggaccacacagatagtataaactccacataagtagtataaattcagacttcatacaggccaaagtttcaaatttgtagggagacttttattttttaacccaaccttggctgttgaatctctgtacttttggattttttttttctttttttaactgacactatgactcctccaaggtcccaactttatgtaggggaatttgagttgcagctcttggctgttccagggcccacagcctatctcctacccctggtggctgtaaaaagcaagccctttgagtgcctagactaaaaaatctccccaaagcatcccaatatcagcttactacatagacttcctgatttttagtttcctcttcattttttgagtaatagggatttctttttctttcttaaaatctcaactctacgtaatacaatgtttgttatacttcataaccagcttttctaggtattatgcagtaggcagattttcaggttatttttcttctgtattactggagatggaagatctaagtaaagataatttataaacaaatgccaaatatattgcattacagtaagcatttatatggttatgttaaaattattatcatttggtaagaacatactaggtactatatattaattataatttcattaatcataaatgctatagtttttatagataaaaaaactatggtagtttaattcaggtcatgtgacttgactaatgtatatagcttctaagggatgagaaaatatttgaactcagttctttgtggtttcaaagtatatgtgctttctgttacagtaagctaatctgtcttaaaatatgtgctgctttctctcttccccatgataaactaaagatgaggattgtcttttccatttctagggctaggaaagcttccctttgaggagctagaatcctgttcctggccagcattttggggtagcctcaggagggcaaaagtacagggggtcaagtccattgtactgtcatctgcttcagaggaaatgggatggtggctgcaggga

SEQ ID NO: 66268 - DNA, 1083 bp, Homo sapiens
tgagttccagagaatacagtggaaaaagatcaggagatgaagtggggagagtgatgagagttggagcatggaatgtacagagccacataggattaaagtctggaagatgagagttggaaaaaaggaaaaaagcaaacaaaaaaataatatccccagctgagaaggaagaggtcttttctgtttgtttttagtaagatcattcgtattttattcacattggtcttgctggttaaaaaataatccatggctcatcaatgtggatgatataaatttattaatactgaaaacatactacttgtaataagaaatatttgtacatatattctgaaaaccagacagatgcacacttgttctcctgcaagaaaatatgtttagggataccaaaacagatgagtagcttatgctaagcattaatctttattcaaacattgataccacattgtcttttctattgagggccattttgcttcctgatgaatgtgttagaacttatttttcaagtagcaggatgctccatctaaatgatctatttggaaatacttgttccagattataaatcaatctggaaatctcagtggcacaggaggggaaaaattctacagtgagcttttaattttatctctaaaagctaataaatgatggtcagacttacagtttgtgattatctttatccgaaatgggaagtctggaatgttattgaaaaccagcattttcatgctttaacatggatgaaccttgaagaagttatgctaaatgaaataagccagtcagaaaaggacaaatattgtataattcatcttaaattaggttcttagttaaatttagagacagaatatagaatggtggtatcagggactgggtaggaagaggagaatggggagttagtgtttaatgggtatgaagagtccagtttagttcatgaagatgaaaagttctggagatggatggtggtgatggttgcatgacaatgtgaatgtgtttaatgcctcaaaactgtacactttaaaatgattaaagtagtcaattttgtgttatgtatattgtaacaacaaaacaagcaaaaccctccagtgttgtgagtat

SEQ ID NO: 66269 - DNA, 1044 bp, Homo sapiens
ctaaactttctcctatcatcatcataaacatcataaacattctataatactttatagtttacacaaagcattttcataagtttatctcatttaatcatcataacaaatctatgggacctagatatttatacctgttttacagatgaggagattaaagaagtttaggagccgggtgcggtggctcacgcctgtaatcccagcactttgggaggctgaggtgggcggatcacaagtcaggagatcgagaccatcttggctaatgtggtgaaaccctgtctgtactaaaaatacaaaaattagccgggtgtggtggcaggcgcctgtagtcccagctgctcgggaggctgaggcaggagaatggtgtgaacccgggaggaggagcttgcagtgagccaagatcatgccactgcactccagcctggatgacagagtgagactctgtctcaaagaaaaaaaaaaaaaagaagtttaggcacttgtctaaagttacactatcataatcagtgagaaagttgaatgcagttctgcctgatctcaaagcctgtggtctttctattatatagcaactacctttttacactaatattatagagctctgtgattgtgagcttatttatttatttatttatttgagatggaatctcactctgtcacccaggctggagtgcggtaatgcattcttggctcactgcaacctccacctcgcaggttcaggtgcttctcctgtctcagcctcccgagtagctgggactacaggcacgcaccactacacccagctaattttcgtatttttagtagagagggagtttcagcatgttggacaggctggtgttgaacttctggcctcaggtgattctcctgccttgtcctcccaaagtgctaggattactggcacgagccaccgtacccggactaatttaattatttattcaatgaatatttgatgagcacctgctctagtggtcactgctcaaagtgctggagatacagttgtaaccaagacaaagttcctgccctcataagtctttcattctagtgggggaa

SEQ ID NO: 66270 - DNA, 1014 bp, Homo sapiens
ttagtcaagtctcacattaagtagtggaacttcggtttggggtgaaggactagacaaagactttccgattagctctacttattgtgattcctgcctctttccacaagttgggatgatggtgggttattacactgatgctagcctgtaagggacattgaatgtatggaacttaaatcatgagtggtgtgtgataataaggtagaacaagctctgtgttaccccgtgtcattgctaagaaacacttactggaggtttactaaaggttggtgctgggatacagaaatgagttaggcatagctcctgccagactgcctgctagactgtttgtgcctccgggaacacacagaatttagacatagcgctgtcctgcagaactttctgcagtgatggaaatgttctatatccatgctgtccaatacagtagtcaccagctacacgtgggtcttgagtgcttgaaatatgcctagtgagactgaataactgaattttaaatttttttacttttaattaatttaaatttgaatttaaacagctatgaatggttaatggctattggaagcacagatctagaggtgccgatcagtggagagacagacatgtaaataagcaagtacaattaagtgtagtaggtactatgatagaaatgtctatggaggccagacatggtggctcatgcctataatcccagtactttgggtggctgaggcgtgtggatcacctgaggtcaggagttcgagaccactttggccaacatggtgaaaccccatctctactaaaaatacaaaaattagctgggcatggtggcgcatgcctgtaatcccagctacttgggaggctgaggcaggagaattgcttgaactcggggggtggaggttgcagtgagccgggattgtgccactgcactccagcctgggcgacagagcaaaactccgtctcaaaaaaaaagagaaatgtctatggagccaggtgtggtggttcactcctataatcccagcactttgggaggccaaggag

SEQ ID NO: 66271 - DNA, 1072 bp, Homo sapiens
aggtataactttttaaaggctcttgatatacactgttgagttattatcctagatcattgcagggactaagtatttgttaaatgaaagagtgactacccgctagaaagactgtgagtagtcatgctctttacaggagtagacgagtggctctaactccccatactgcctttcatatttgatcctctcagtgtcctccatcctcatttgtttacagtgagggctttatcctcttattagtcagacttaattgctttctctatgctcaggccagatgaaatcaggtctttattccttctttcccaaagaagagatactgaacttctcatttggtcatggtctttcttcacccttccatcatttattggtagcatcttctgactttgagggcccttcttgaaaccatagagacttgaaaaacttgaccaatcccttaggtaatatttaaaatgtgggagggattaaggtctcgttgaaaaaaaatctagaattagtttctgagagaccaaagggattctaattcctgctctacctggctgaccttaacctttgatctctctgggactctgtttattatctgtaaaaagggccataataataactccctttcttatcatatgggcttgataggattaattaatttataaaacaatatattattgaatggctactttgtaaaattgtatgataaattaaattcattccttcagtcatgcatcctttattgattgattgattgattgattgagacagaatctcactctgtcacccaggctggaatgcagtggcgcgatctcggctcactgcaacctctgccttctgggttgtagtgtttctcctgcctcagtctcccgagtagctgggattacagttgtgtgccaccacaccaggctaatttttgtatttttggtagagatggggttttgccatgttggccaggctggtcttgaacttctgacctcaagggatccacccatcttggcctcccaaagtgttgagattacaggcatgagccaccacgcctggcctcatccattatttattcaactggtcaacagatgttaattgagtacct

SEQ ID NO: 66272 - DNA, 1122 bp, Homo sapiens
aatcatctaaacctaattatctcccaaaggatgtgtttccagatactatcacattgaggaatagggcttcaatttatgaattttgaggggaggcagttcagtctatattattgagttattgtggagcatcttttttgagaccgggtttcacactggagtgcagtggtgcattcacgactcactttggcctcaacttcctgggctcacgtggtcatgtaatcctgccacctcagcctcccgtgtagctgagacttcaggtgcaggccaccgtgtcttgctaatttttgtagtttttcatagagacgggatttcactgtgttgcccaggctggtctccaactcctgggctcaagtgatacccctgacccagcctcccaaagtgctggaattacagatgtgggccaccgcacctggccatgtgcagatcttctgaactgtataatgtttaagaacccacatttgttaatatcaccactcatctcatcagacaaatcttttctaattttcatttgaaagctcaaattttatcataggcaaccaatactgacagttgttttcgttgaagtgacagtctcacattgttcattttcaaaaaattgtctgccaaacatccaagtctgaataatcatagtttttctgccagtcgttttttcaagtaaaaatggtgtttattaaagcagccagtacagtttgcaactcaattgcacaagtgctttagtgcttttctttgagacaattcttgtaccttaatatgcagcagaaatgctttatgtgaggctcggtgcggtggctcacgtctgtaatcccagcactttgggaggccgaggtgggtggatcacctgaggtcaggagtttgagactagcctggctaacatggtgaaaccccatctctactaaaaatacaaaaatttgctgggcgtggtggcacacacctgtaatcccagctacttgggaggctgaggcagaagaatctcttgaactagagaggcagaggttgcagtgatccgagattgcgccactgccctccagcctgggcgacagaactagactccatctcaaaaaaaaaaatgctttaaatgtacattccatttttccatttcttcacatagaatatgaaacagat

SEQ ID NO: 66273 - DNA, 1022 bp, Homo sapiens
aggtgtagtgtgttcttgcttattgctatgtagcaacagtttctcaaacattttggtgtcttcacattcatatttattgacaactccaaagaacttttgcttgcagtggcacagtcatggctcactgcagccttgacctactaggctgaagtgatcctccatcctcagcctcctaagtagctgggactacaggcatgtgccaccatgcctggttattttaaaattttttttgtagagacaggatcttgctcagttgcccaggctggtcttgaactcctaggctcaagcaattctcctgcctcagcctcccaaagtactgggattacaggcatgagccactgccttcagctgtgttagcatattctaatgaaaataagtatattattctaaatgtaaaaaattagaataatattttacatttaaaacaatctctttagtatcttattggatctgcctcagtattcagtctgttgcagtttgttgttttgcatggaatataaagaaaatccagtcccacaaaggaggaattttctttttctttttagacggagtttcactcttgtcgcccaggctggagtgcaatggcaggatctcggctcactgcaacctccgcctcctgggttcaagtgattctcctgcctcagcctcccaaatagctgggactacaggcgtgcgccaccacgcccagctaatttttgtatttttagtagagacagggtttcagcatcttgcccaggctggtcttgaactcctgacctcatgatccacccaccttggcctcccaaagtgttgggattacaggcgtgagccaccgtgcccagccgaaaggaggaatgtttttatataattgtggatattcctctttgatactacaccagtcatgtccagccctttgaatgtgaggacttttttgcttatctgtagtggatatcatgaaaattatacacactttttttttctttttttttttttttcagcttatcagctatcgttagtgttggtgtattttatgtgaagcccaa

SEQ ID NO: 66274 - DNA, 1027 bp, Homo sapiens
ttaaataagataatcaatggaaagcatttcacacaatatgttttatagtacacattaaaaaaattagttgttgcctttattgttagaaagataggcagaggctagaatggtgaatagccttgtgtgccctaccaatgagttcttagtattgtggtatttattaatgaggtatgattttgttttatgatctcatgcatatttgcatgtttacagtctaggaactttaaacagttctttaaatgccaaagtcctaaacagatgttagctgttagcttcctcattaataaaataagaagaaaaattatgctctgagaggttaaatgacttgtttaaggttacacagtcagtggaaaagtctgggttacagcccccaaattctaatttgtcatccccatttatatcctttttttaaattgtaaaatatgtcatatgtataaaagtatatttaacataaacccacaacttaaagaataacaaattgaaggcttttctacttgctacccagcttaacaaaaaggagatttctagtacctttaaagcctcttgtgaggtcctacttgattgaatctcccatcttctctctccctcagagataaacagtttcctaaattttatgtgaatcatttctttgcttttctttatacttttaccaaatatgtgcatatccctaaacagtatattttttacctttgcaactttttataaatagaattataggataaatattcttctgacttgctttattcttattcttattttttaacttttaaaaaagctttatttcttccaccattaaataatgtgtgctcatgataaaaactagaaattacaaaaagtaaaaagaagcataagtattgtttttagtcctattacccagtaacacttttttttttttttggtagagacagggtctcgctatgttgtcctggtcaagtgatcctccttcctcggcctcccaaagtgcttacaaatgcaggcatgtggcaccatgcctggctggcaaatgctttttgtagaaaatattttg

SEQ ID NO: 66275 - DNA, 1031 bp, Homo sapiens
ggtggcctccaagagacacatgagggttaagggttggaatacttaaatgaacagccttggtggctgtggttgggtgagaggcagtaaggctgttagaggggactttgcaggggacacggaagagaccttctcattcttaggggccattttaatctgttcgggtgatgtttttgtttgttttatttatattagtaaaatttggaagtcaagtcagcccaaagggtaaagttgaaaggggatttagttaaggtagaattaaggaggggagggtgtcttctgttatttgtatatcataaaaagtaagttgggggaaaaaagcatacttccaaactaaaggtgggagaagataaactggaatgtaatggatatctttctatatgatgtctctgccttttcttttcccctctcctcctggtgtatttaaaaactagccaggcattttgaaatttaaatagatttgatgagcttgagattgttaagggtgcattccttgcttgagaactaatgagtgagcctgaaaaatatgagactgaatttattttgtaggtaggtaacaagcacataggcaaaaagagcttgggccttttttaccccctctttaaattgattgcttgaagacgccatttgttagtgtcctggtttgcaaggcaattaggcccatcattgtattgcaggctaataatcctgagatgagtcttggcaccaccgctttatgtaaacagagaagacaggaaatatggaaatgtcataaatattcattggtgagatggtttggtactgatggagtttttcatatgattgtcttttgacattgataagatttagaataattggactgtatttctaaagattgaattttcttccaaaggaattcaggtgatcagaattctgtcagatgtgaataaataaagcatattgagtcatttttattttattttttggggaatgatgttgatgtagtcgcattgtattaactacagaaacagcatctccacctattcatcagaaattcgatttaaaccttagcgata

SEQ ID NO: 66276 - DNA, 1017 bp, Homo sapiens
ccttccaaagtgttgggattacacgtgtgagctaccacgtctggcctgtggtcattatttctatcttctatcaggtccactttttctgggatgaattttgcaaatctgcactttgtcaagatttttttttttttttttttgagacagagtttcactcttgttgtccaggctggagtgcaatggtgtgatctcggctcactgcaacctccgactcccgggtttaagcaattctcctgtctcagccttctgagtagctgggattacaggcatgcgtcactgtgcccggctaatttttatatttttagtggagacggggtttcaccatgttgatcaggctagtctcgaactcctgacctcaggtgatctgcccacctcagcctcccaacttgctgggtttacaggcatgagccatcatcgcccagccaacatttttttgatttttccatcaacttttagtcaataagtaatttcactgtatatgatttagccattttcagtttttgttttttctgtcgattatgtagcgtataagtttttttttgagacagggtttcactctgtcactcaggctataatgcagtggtgagatcgtaactcactgtagccttgatctcctgggctcaagtgattctcccacctcagcctcctgagtagctgggacaataggtgcatgccaccatgccccacaaattgaatttttttttttttttgtagagatgggatctccccatgttgcgcaggctggtcttgaaatcctgagctcaagaaatccactagcctcagcctcccaaagtgctgagattacagttgtgactcatggcgcccggcctgaaacacagacttcttaccctctttgaaatcagttttgactgacaaagggtgattgttcacaatatataaagactttctgaaaatagagggaaaaagaacaaccctttaaaccacaatgaggtttcgggacatagctattagaacaggtagacttaaaaaaaaagtgataacaccaaatgctgatga

SEQ ID NO: 66277 - DNA, 1248 bp, Homo sapiens
tgacagagcaagactccatttcaggaaaaaaaaaaaaaaaacaaaaaaaaaaaaccataccatgtacccacaaaaattaaaaaaagaaagagacaggaatctcatcctacttcccccttgagctatgtattcatctcttagaactgcttgctattgccacaagtagctagaagttaacctaataatactacactggaccctgtaacccacaccctatagcttaacaatgtatagccaattgctaatcgatgttatttctgtaatccaatgagaattcctgacaaacaactttgcatctgcacacttcctgtcccctttttttgccttaaaaaatccacttgtaactgctgctaattggagtgtgtattcagggcaactttaatctatgctcccgagtttcaagcttggcccatttctctactcattttgcctcagcttcttcttttttaagttgaaaagggttagagaatattaaatgtaattatttccccatccaagttcatagacctcataattacatgagtcagtggatcccacattagaatgccccccttttttttctttttctttttcttctttaaaaaaaaaaaaaaaaagacagagtcttgctctgtcccccaggctgggagtgcagtggcacgatcatagctctctgtagttttgacctcctgggctcaagtgatcctcctgcctcggcctcccaaagcactgggattacaggtgtgagccactgtacctggcctaaaatatctttttctagggttggtgctcataagcactatgatatctgctccacttattaaagcgaccctgttttctggaggttgcctggcatcccaactgcctgcagcccaacatcctcagatgcatccctttgaacacagctctaacaccacagccccaggaagtcctgccagaatccccagggttctctgcccgtgctatgagcttcctccaggctcccatagtcaagggcttccctttattataccataaggtaatgtcactgttcatgtcctcctttttttttttttttggtttttgaaacagagtctctctctgtcactcaggctggagtacaatgacgcaatctcggctcactgcaacccccgcctcccaggttcaagcgattctcatgcctcagcctcctgagtagctggagctacaggtgcatgccaccatgccaggctaagttttgtcttattagtaaagacgaagtttcaccatgttgtccaggctaatctcgaa

SEQ ID NO: 66278 - DNA, 1017 bp, Homo sapiens
agagaatggtcagtgttctctctggaatgcattccctgccctcccctctctcccattagatttctgccaacccttcaaagcctagctcaacggtcacccactccactccaggaagctctcctggtctcaggaagaattttttttttccctgaattctgtggatcttgcttgtgcctcttgttgctatcctttctcctggcctttcttgcagcccaaatgtgagctgcttgtagacaaggactctgatttgtttgtgtcaccagcagggccaagtgcataccaggaaccaagaactatgtgctgaattaaatggaaactccaaacccctcattttacccatgggggagcagacctggagaggggtcaggatccccttctcttctggatctttcctcttagccccattccaccctgtatctctctctaactgggattcacacctgaacagtccagctccccttagaagtccaggtgtctcaaactccactcatctcaagatgattgcaacatttctccatctgctaaaactgttgcttttcccataaatcttttttttttttttgagacagagtttcattcttgttgtccaggctggagtgcaatggcatggtatcagctcactgcaacctccgcctcccgggttcaagcgattctcctgcctcagcctcccaggtaactgagattacaggttcctgccaccacgcctggctaatttttctgtatttttagtagagacagggtttcaccatgttcgccaggctggtcttgaactcctgacctcaggtgatctgcccgccttggcctcccaaagtacccagccccataaatgcttctctcagtacatgccatcaccatgcactcaaatcaagaaaggctaggcacagcggcttatgcctgtaatcccagcactttgggaggctgaggcgggaggattgcttgaatgcaggagttcaagaccagtctgggcaacatggcaagaacctgtctctacaaaaaattaaaaaattagctgagtgt

SEQ ID NO: 66279 - DNA, 1431 bp, Homo sapiens
tgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattt

SEQ ID NO: 66280 - DNA, 1029 bp, Homo sapiens
ctttagagccctgcttgcttggctaaagaatattgtgccattgccttttacaaccaggaactgatgacttaaaggcatagaaattcatttgttttctatagcaaatgaggtctggttatccaagtgcaccctttgcagcctgcttctcgttgttaatcagtgagaggttttgtgtttgtttgcttgcttttaaatgagcaggaaactcttagaatccctgtgtccttgcctcttcattttgagtcccattgactctaggctttttcctcatggaatatcaaattttcatttctttttctaacacttgagctttctacttgacacaggcaagaaatagagtggagctttattgtagcctctgctttcagaaacaggacataatattagttcatttccaaggattgggacatctaatattagttaattctaaggatttttaatttgatgttttcagtgtttcatattcaccttctagtgtatttccatatgcaggcatttttattaagccatatagtttgtagcactttgtattcagctcttcccacttgtaaatgttatatgttttcataaaaaacataaaacaggccgggcgcggtggcttatgcctgtaatcccagcactttgggaggccaaggcaggtggatcacctgaggtcgggagttcaagaccagcctgaccaacatggagaaaccttgtctctactaaaaataaaaaaattacctgggcgtgatagtgcacgcctgtaatcccagctactaaggaggttgaggcaggagaattgcttgaacccaggaggcagaggttgcagtgagccgagatcacgccattgcactccagcctgggcaacaggatcgaaactccattccccccccaaaaaaaaaaacacaacaacaacataaaacataatatgtttcaaaaacaaaacaacaacaacaacaaaaaatgttctattgagttgaagtatgtccccgcgcccaccgccgtttttttttgagatggagtctcattctgtcgcccaggctggagtgc

SEQ ID NO: 66281 - DNA, 3139 bp, Homo sapiens
ggctcacgccggaaatccccatattttgggtggccaaggcaggcggatcacctgaggtcaggagtttgagaccagcctgaccaacgtgatgaaactccatctctactaaaaatgcaaaattagccaggtgtggtggtgcatgcctgtaatcccagctacttgagagactgaggcaggaaaacctcttgaacctgggaggcggaggttgcagtgagccaagaccgtgccattgcactccagcctgggcaacaagaacaaaactctgtctcaactacaacaacaacaacaaaaactaaagtgctagggttacaggcatgaaccattgtgcccagcccagtatctggggctttctttttaaatttttaaaaaatgtgtaccacactacacagatgtagtatcttgggctaaaaaaaatcttaaatagacaaaggaactattcatttggactagtaatactgttactatgcattcttgcatatctcctcaattaggaattgttatctaataacgaataattgtgctggcaaaattagaagattgcattcaaggactttttttgagataggtgctatatgcagtctttcttcctttgcacctttactttgggttgctgtttgtttaaaaaaaagaggtatgttcatattgtgcattgacacgttttgtagctttaaaatgtttgtgcttactttaaccacagcaagtgaaacctggtgtatttttttttaaatccacaaatgtgattcaaatattagtacgttgttttctttagctgctgtaagaagtgttgaagtactctacttagaatccaacactagaaaagataaattttgttacaagtgtttctgatgcattaaacaaataaactttaggttaaagtgatcacaaactgaggaagcagtgcaaacagtggtgttgaaagctattgaaaggctttacagattttctggatgtgttgggacttactggctgacatactttggaaaatgctttctttgtcatgtttggtatgtgtaagtgatcaaaaaagcattgtggcaatgtgacaccatattatctgccatagctgtccttatatttcaaaaagttgtttttttttcaattaaatactacattgtactcatttgatcatgttcaaaaaatttttaaactactctaaaaggaaccttgaagattttattcttgtaatttgtttaaattgctgacagttgtaatcagataaaatggagttatgttgcaggcacattaaaagtggggtactaatgtgccagcccccttccaacttccagggcttttttggagggaggtgcccaccacctggggaggcatttttcagcaacactaatctctctgtctaccctcctatactagatgttaactcattccagcaaactacaaagtggattgatgatgtcagaacagaaagaggaagtgatgttatcatcatgctagtaggaaataaaacagatcttgctgacaagaggtatggagttattttatatgtgtgtaatgtttgatttctgtgatgcagccttttatttttgttcactgagaaattgttttgaaaggagacatgcttaatccttaagtttacgtcctcccctgcttttctttagcatgggaacctcaaatataaatgtaaatattaaacagccagtccttaagggaaatgaattttattttgtttaagcccatgtgtaaataactcttgtgcaagtttgtttagacatgaagccagtaaatattttgctttttttagatctcataagtatgaaaagtgttttgttaaagagcaagccattttggaaaaaccttatctttaaaaattgttcataatgattaaatgcacactcttttcttagtagtcttcttataaaacattcattataattcagtggtgtggatttttgttttttggttgttggtttttaattgtgtggctgagccagactgtgtagttgcactgaatagcttgattgtgataccttagtcaaatgagcaaagcgatattcaagtcacaggatgcaaaatatattaacattcactgtaggacccatggcttgaatatttgctttcagcattcttaagcgatttactgcatattctttctgctttaaatagttttgaccatactacttaatagtaagagcttttactatttatttgtttattcatgagatggatattgaaattcgggtaatgaacttgtgatattaattcaagtgttgcaaagaaagccagtgttaaaagacttgtggagatatgaagcccatttctgcacatggcacctcagttagaattggtagtacaggccgggtgcggtggctcacaactgtaatcccagcactttgggaggccaaggacggtggaacacgaggtcaggagttcaagaccagcctggccaagatggtgaaatcccgtctctactaaaaatacaaaattagctgggcgctgtggcatgcacctgtaatcccagctactcgggaggctgaggcaggagaactgcttgaaccaggggagcggaggttgcagtgagctgaaattgtgccattgcactccagcctgggcaacagagtgagactccgtctcaaaaaaaaaagaattggtagtacagttgcaaaaaagtctttcttaatttaaaagtaaattcaaagtgattgcatcttttctttataaaaatatgttttggacatgaactgctatgaaggaaattttcactattttatttatcctcactctagagactttgtaggtacttttctttttttgggatggagtctcattccgtcgcccaggctggaatgcagtggtgtgatctcagctcattacaacctccaccacctgggttcaagcgattcttctgcctcagcctcctgagtagctgggattacaggcgcctgccaccatgtcctgcaaatttttgtatttttagtagagacggggtttcaccatgttggccaggctgatcttgaactcctgacctcgtgatccacccgcctcagcctcccaaagtgccaggcgtgagccaccgcgccctgccagtacctttattttatttatttatttatttttgagttggagtctcgcattgtcacctgggttggagtgccatggcgcgatctcggctcactgcaacctctgc

SEQ ID NO: 66282 - DNA, 1048 bp, Homo sapiens
aaaaaacaggtttgaaagtattctagacccaataggaaagagacacattttagcttgagagaagctttcaaagaagcattaattcctttactctgatagcttaggctgctcattgacatttaccttaggtttttttgttttgttttgtttttttctctatttaaccatcaacagtctactttttgccacttgaaaggcatagggattcaaacaggttttaggtagggaaaaagggaagccatatttctgattctgtgaaatttttcccagtggcattttccagtcatttatgtttggagtatgcaaatttttaatatttctcccttttgaaaaaggagttttgtgttattttcattcctcactccctgcaacctcttgcatgagtcttctttctacttccttcccaccctctcccttttacaaaaaacattgtttcttttttctttttagtattagtttggtttttttttttttatttattttttcccatctcacagatcaggcttcagctgtgggatactgcgggtcaggaacgtttccgtagcctcattcccagttacatccgtgattctgctgcagctgtagtagtttacgatatcacaagtaggtatattgcaacgggttgacctttcttatttttcttgcttgtttgactgattttgttgttaggtacgattgcaattatgggacacagcaggtcaagagcggttcaggagcttgattcctagctacattcgtgactccactgtggcagttgttgtttatgatatcacaagtgagtggagggaattatgcatttctaatcttctttcaacctttagcttagctgcatgcatgttcttgtcttgtgcttgttttccttactggcatgtaaaaataagttttatcatagtaaattacataccagccaggtcagaaatatttgctttggtgtttataccaatatgctttatatgtaactgtgccaggttttttgccccagaaattttcttttgggtccaactatgaatcctcttcaagggtttcttagtatcctgttattcgtaaa

SEQ ID NO: 66283 - DNA, 1030 bp, Homo sapiens
gaaagttatgatgtttgtgagtctctggctgtctatggcattaggacagttgacaatatatcaacagtattttataaaactgctcttggggcagatacttaccattctgagtggagaacaatcagatactcaaactaaagttcaaatacaaatatttaaaccaaagttgccattgtcttgttatttgtaaaatgagaaaagtagggatgagaataagctacctggcaggaatgtataaagattagagatgatcatgtaaaaggcttaaaacaatctctgatatgaagcaagtgctgaatacatgaaaatcattatcactggaaattttgtttgtccttaattgtccttaattgactatgttgtattgatttgtttattcattatttcttccacaatcatgaatcccatttgaatcctaaactgctggccaccattaaacttattatttgttaacttctttgttttgttttacaggcaacaattggcattgactttttatcaaaaactatgtacttggaggatcgaacagtgagtaatattttcagtgtgcaattttctgcaacattccaggttagaaaactgcaatcaaagttatcaatgattgtcaccataagaagtacttagcaaagttaccaaagatagtttacagttgttgagaaaaactcttattaccgagtgagtagtacttggcagtcatcttgatttggaaaaatgaaaacaaagagctttacagagaattaaaggagaatttttatgaagaaattaaacctgctaaagaccttctaaatgccacccttgaggcattcaaaaagatttcaatttgtgaacttcaagattttttttgtcaggataggatgcgtatcaaagtgactgacaaaaaagaagttatgtgggcagggtgcggtggctcacacctgtaatcccagcactttgggaggctgaggcaggtggatcatctgaggtcaggagtttgagaccagcttggccaacatgatgaaaccccatctctattaaaaatacaaaaaattag

SEQ ID NO: 66284 - DNA, 1060 bp, Homo sapiens
aaaggaatgtttggctgggcgtggtggctcacgcctgtaatcccagcactttaggagtccgaggcaggcaaatcacctgaggtcaggagttcaagaccagcctggccaacatggcaaaatcccatctctactaaaaatccaaaaactagctgggcgtggtggcgtgtgcctgtaatcccagctactcaggaggctgaggcaggaaaactgcaacccaggaggtggaggttgcagtgaactgagattgccccactgcactccagcctgggcctcagagcgagactttgtctctaaataaataaataaaggaatgttgaaatacacaattggaagtttccttgaggagtctgttttgttactacctctggctattgtcttgagatgcagaggcagttttagtaatgtcactcagtggtttacagtagaagatttcactatatatacatgttaccaattataaattaggagatgtaatggcagagagaagcgcatactcagcctactactgtttttttcactttatattgccttttctttttttccatcaatgctgatcaaattgcaatatgttagataaggaaaaaatgtcttattgtcagagactagcagtactgaccagttgtttttcttttgagacggggtctacctctgtcactcaggctggagtgcagtggtgtgatctcagctcactgcaccctccacctcccaggctcaagtgatcctcccacctcagcctcccaagtagctgggacaacaggcacgcaccaccacgcctggctaatttttgtatttttttgtagagatgggattttaccatgttgcccaggctggtctcaaagttttgagctggcgagatcctccggcctcagcctcccaaagtgctgggattacaggtgtgagccaccacgcctggccagtactgaacattttatattggctagatcagtggtttttaaactttttttccccaagacccctttctgctcttacaaatttttgaggatcctgaagagctctgttaatgtagttgttattgttgttcttcttcctcctcctcctc

SEQ ID NO: 66285 - DNA, 1131 bp, Homo sapiens
cttcaggtttcctttgaatttcttgagtatttgtgtatgttctaatgcataatggagagttttatggcttctaatttcgtaccttgtttaagcctctactaccctcccccctccattactgaagcctggttagattttttttaatagacttcattttttagaacagttttagacttacagaaaaattgaaaagatagtgtagagttcccatatacccacacatctagtttcccctgttatcaacatcttgcattagtatggcacatttgttaacaattaatgaactaatattgatatgttattattaacttaagtccatagtttatttagatttttagttttaacctaatgtcctttttctgtttcagcattcaattcaggatgtgaagttaattatcttttgaggttactatattgtcaagtaatgccattcattagctttgacaatgaaagattgatctctgttttcatggtcagtgtctatagttttcttatgcgttagaagtctgtagactccatgtccttttgatgtaactcttcatgaattatttatttttaggtctgttagaattccacaattcagctttcaaagactgtaatctatggcaaagccttgtttcttcttaatagcatttaccacatttacaattatcttattttttatgtgtttgtttttatttcccacagaagaatgcaactcccatgaagataaaaactattcttttttgttcagtgtgtccccattgcctagcgtagagccaggctcatagtagctgttcagacatgttgggtaaatgaatgatggctgaatctagtagtaacgaaagctagtagcctatgttacactctttgacatggttacgcaattgatagtttaacaataacacttaaaacttacatcatttgattgtatacaggaatatatcagatacttaagggggtagagaaaccaatcgtttagaggcccaaccatttcattcaaaaaataggactgacctgaattttgtacttttttttgagttgagcaaaattcgtcttcctttattaaagttgttaaattatttgctattaatgtaacgcatgaaaagtattcaaattataccaatgatgtgctcatggaactgatttgaa

SEQ ID NO: 66286 - DNA, 1050 bp, Homo sapiens
tgaaaggggtagcgtcggcagtggagatttttgccccttaggttagatggggctgtggcttgtcggaaaacctcattttgttctcttgactttcatcactgacaattcttttggcaatgttgatgatttttcaatctctgccagatgctatgtcatgatcattttacttggaatttttctcatctcacctcccctttttctcttttcaacatgaagcagcgtctgagtctcatggtggtacaaaagggaattactggggaaatgttaattattcattccttcttgagtattttccaatgatatattgaggattcatgtgagagaaggcttggaataacaaacatctttgttttgtcggatttcctttggaaaatggagtagagtaggaacagactcatcatctagttacctaaattagatttaaataccatttgggctaaataattcttttatgcttaatattctgtactgtctgatgagtgaaattgttatgtcatttacctggtcaggttctgctgtcactgtacttttgtattagatactagatcctaattttgtgatggttgtatctacgattacttcttgtagtaattccagttttatgctgtattatacaaacttgacactcgacaattcagagatgattaccctcctttgtttttctcatactttgcatgcccatctttaaaattcagacattgagagattagttctgagtcatcaaacattgagtacctactaggtgttttaggtgaggttatagaaaacattagttatttgttttgactggaaggcatgtaagtgatataaattcgtagcttttattactactttgaactatttatactaatttgtatgccatcacagaggttaatactcttgcaaaattgcctccagttagaactgggaaatcatttttctcctttcatgtgtagattatcttcccctcctcccttttggggggaaaaatacaatctccctcctttttgcttatatattttcctgaagtaagtataaacttgtgtctttaggtgagtaacttggtagaac

SEQ ID NO: 66287 - DNA, 1049 bp, Homo sapiens
caacccctgcctcccaggttcaagcgattctcctgcctcagcctcctcccaagtagctgggactacaggcacgcaccaccacccctggctaatttttgtatttttgggagagacggggtttcaccatgttggccaggctggtcttgaactcctggcctcaagtgatctgcctgcctcagcctcctcaagtattgggattacaggcgtgagcccccacacctggcctagagtgatttttttttttataattaatgagccaatattggtatattagctagtgtccatactttattcagatttccttactttttctctagtgtcctttttctgttgcagatcccattcaggatattatattttatttaatcgtcgtcttttccgtaggctcctcttgactgatagtttctcagattttccttgtttttgcatactagacttttcatacatccatgttgaaagaattaaaattgttatccatagtgggcaggattttctctttatgttatgggaccttaagaacagactttttttttgtttctttcccgtaaaacaaacaaacaaacaaaagaacagacgtttgtttggaagactgaagcaagggaattgcttgagtccaggagattgaggctgcagttgctatcattatatttgtttttttgttcttacctccattgtgaagtatcattatcactgtcattttttaattttatttttatattttaatttttttttgagacagagtcttgctctgttgcccaggctagactgcagtggcgagatctcggctcactgcaacctccgcctcctgggttcaagggattctcctgcctcagcctcctgagtagctgggattacatatgcccgccaccatgcctggttaatttttgtatttttagtagagacgtggtttcacaatcttggccgggctggtcttgaactcctgacctcgtgatccacctaccttggcctcccaaagtgctgggattataggcatgagccaccgtgcccagcctatcactgttattgagagagacagtgtactataatag

SEQ ID NO: 66288 - DNA, 1117 bp, Homo sapiens
tttgaattagttttgtatataatgggtcaaagtttttttttttggcatatgaatattcagttgtttccagcaccatttgttggaaagattttctttctccactgaattatcttagcaccttttttgacagccagttgaccatgtatatgtgggtctatttctctgctctattctgttacatatatgcttacacctgtacccactgtcttgattagtgtagtttgattaccaactctaactttgttcttctttttcaaaattattttggctattctaggtcctttggttttccataaaaatttttagaattagcttgttgattctacagaaaagagtccgatgggatttttttttttttttaggattgtgttgaatctgtagatcaatttgggaataattgaaatcttaattgtttatattgagtcttctgattcattaacacaatttctctctccatttacagtatttagatattctttatctgctctgcttttatgcattttttggatttgttggaaaactgtaggagagggaagtaacatttactccctacctacctgctccagtctgggctctttacatatcttatctcagtatttcacacagtataggatgccctctggttttccttaaataacattaaatcccatgggtagaaatttcttccctttgtaattttttttttttaattttggagacagagtcttgctctgtcacccaggctggagtgaagtggcgtgatctcggctcactgctacctccatctcctgggttcaagtgattctcctgcctcagcttccctggaatagctgggactacaggtgtgtgccaccatgcctggctaattttttgtatttttagtagagttggggtttgccatgttgcccaggctggtctcggactcctgaagtcaggcaatctgcctgcctcggcctttccaagtgctaggattacaggcatgagccactgcacccagcccctttttaattctttttgttttttgtttttgttgagacggagtcttgctctgtctcctgagctggagtgcagtggcgcaatctcggctgactgcaacctctgcctcccaggttcaagcgattctcctgcttcagcctcc

SEQ ID NO: 66289 - DNA, 1098 bp, Homo sapiens
acatttattgctactgccaagcaggccttctctatggccaggcaacagggagtgctgaggaaggaattccatcgtcctgaccaactttttgctggagtaagagtatttaacaaagttcttcatattcaggcacctccaaacatattttctttatttcctccagagaacaggctttagtactgaggtccttgtaaacatttaacaaaactggtttaagaacaaactaaaagcatctatatccttgccctgtgttgctggggtgagtttatacaaggagaagttggaacaaatgcagtgggcacaatgaccttcttactcagttcaaagtaggtcttgggatgagagttccacacggccagtacagctgactttctgtgatttccaaggggtgcccaagacattaaacgccatggtccttgggaaggactgatgatgtttctgctcattgttgatcagggtcaaaccttttcactaaccgggactgctctttccaagaagtcagaggtcagaaagctggtagcgtcgtacaagaccgtctcgacagcatgtgtagatctgcttctcccatgtggctacctaaaacacaagaattcacagttcaaaggaagcctgggattcttccatttcaaaaagatggaggcttatgattgacacacactagtcccatggagtctgagaaggctttatgaaggcaacagaattacatccataattatgtgcttacaaaaattgttggcccatagtgatggatgcatcccaatcaccaatggttgggatgcaccatgactatataacagagaaactaattggcccaagtggaaagcaaacccattagtattgttcaggtttagcacagatggtctgcctctagggaggagatggttcagagatgggcttgactattcttgaaccttataaaattggatgcaaaaatgttctgaatatgtgtctttttttctgaggaggatttcatcaactcctcaaggaaaacagcatgaattctggagttagtctcagctttactaccaactagctgcatgacctagggcaactttctcaaccccccaggccccagttgcctcatttgtacaatggaaa

SEQ ID NO: 66290 - DNA, 1078 bp, Homo sapiens
cccccagggaaagccccgcaggacggccctgggtgccggggcggggatcacactttcttcactctgctggtttccctaggagacagatttcctaattactcctggcctttctctgcctcttcctactgttgctggccctggggaaatggacactaagccactgggaaggacctctgggagggacaggtgggcacgcctgcccagcttcagctttcttccccgtagctgcaagccccttactctgtttctcccggggaaggtcccgtccccgcagggcatagggatgcgtggggaatgtgccccagctcccacactgcctgccaggatgagcgagtcagtgtaatcctgggctccacaccccacgtcctccacctcagcttgcttctactgagaaaggcgggtccgtattctgtcttctctgtgtgtctagattctaggcagggaagaaggatgcttcctcgttattgggccccctcagaaaacccaacagtctagagacttaaggaatgatcctaatcaagcggggtgctcagccccacacctactcacggtcactcagcacgtcgtaggcctctgctatttgcctgaaaatctctgctgaagacggctcatttgacttcaacgggtggtgcttaagggcgagtctgcggtacctggaagagggagaattaatacaagtcttatcagctggtctgtttctgagggcggaccagagttcagagccggcactctgttcactcctgcctagctataaatccggggtgacttcaccagctgtggtggctgcggaggtgcactgctcagctcttgaagagtagctggtgcggggagcacagttgaccgacagttccagcagctgcccccctgggcatctgagctgaagcaactgcccctgagctgccctcaatgcttacgtgtggtggggataccagggctggcccattcctgcaagacacaggactcctccaacgggcaagctttgcgcgagggctccccagaggctggctgagctgctccccgggcctcgctgcactctccctccttcctcccctccctgtctccactcgcaggtgtcagg

SEQ ID NO: 66291 - DNA, 1070 bp, Homo sapiens
ggcagggctcactctgatctcctccccgctgctcctgcactttgcccactcaccttgccaagagggatggggttcacgaagaagaggttgtcattctccctgcggaagcgagggtgtagcttctcctttacgatgaaaatgatgtctgctgggatgatgttggggccctgggcaggggacgccaaaaggtgacaaggactagttggccgtgtgaccttggccaagttcctgcctctacttgtctccatgtcttcatctgtacaatggggagatgagagcaggttttctggaagggccttttcagtttggcccccatagcccagatggattagaagcccgagaagcttacccaaatgaatccccccagaattacttctgtactgagcatgcccaaaatagacacactcagctggaggggcggagaggcttcctcagacggcaggcaggtggaacactaagctgggcgtcaggcaactgcccgtatgtctctgtcttgctagtaactccaggcatgacacccctgtcccaaacttcattaagtcaccaaaactctgctgaggtctcttctgggcgctggggacagaggaatcagactggcccctaacactgacagtgaatcctcagcacgctcaagacatgataaagggaggcccagaggctggggctcagaggaggctgcccagagcggggaacactggagctgggttttgaagcgtgtttattcgaagtagatgttttatttgtattttgtctgtttgttttgtttttagacaggatctcgctctgttgcccaggctgaagtgcagtggcatgatcatacttcactgcagccttgacctcctcggctcaaaagatcctcctgcctcagtctcctgagtatctgggaccacaggcacacactaccatgcccagctaaattttttatttttagtagagacaaggtctcgctatgttgcccagactggtctcaaacttctgagctcaagtgattctcctgccttggcctcccaaagtgctgaggctataagtgtgagccaccaggccagaccggaggtagatgtttcataggt

SEQ ID NO: 66292 - DNA, 1574 bp, Homo sapiens
ctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtctcctccctctcttgtagctcttaccagaggtcttggtccaatggcctttttggtacctggtgggcaggggaggaaccacctgac

SEQ ID NO: 66293 - DNA, 1326 bp, Homo sapiens
ctccttagtatgccatgccaaccctccattttacacatgacgaaacagagccccagacaaaaggttgtctttcccagatcacatggcaggaagaagtaaagctgacctgagatcccaagtcttaggaatcccagtcctcagaaagccacttctctctgagccttggttttcacatttgtcagatggaaatgattgtgatttctcagggctgttgagcaggtaaatgaaaatgttttatgaaagaaagcaccaagtttcattttggtcttagcccttgctatgtccctagcaagaagtagatattcatagggatattttgtttgatgtgaggagttcttacagcaagagcttgtagaaggccaaaagcttctggattctattcccaaaagcaggagatgacagtgacagggtggttttggtgaggagagatgaggtagaaaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaaggtgtgtaccagttgttttcccttccccttttcctcctccccgatactctggtctcacccaggatcttcctcctcctacagggacctctcccaatgttgctcgtaatgccattgtcaactgtgctgagctggtgacctatgacctcatcaaggatgccctcctgaaagccaacctcatgacaggtgagtcatgaggtagacggtgctgggtctcacccttcccccatgccaggagcaggtgcgggggtctagctgacaccagaagaccacatcttttcatcctatttgccctttgcagggagagtaagatatctcttacttgccatattgaagccaattgggatgaagctcccactttgcacattgaggaactgaggctagattggcaaaatgactctttcaggtcctcagaagatgtctcagctggagtccctgtctgtttttgtttttttgtttgtttgttttttgttttttttgagatagagtctcactctgttacccgtgtaatctcagctcactgcaaccttctcctcctgggttcaagcgattcttgtgcctcagcctcccgagtagctgggatgacaggtgtgcaccagcacactggctaatttttgtatttttagtagagatggagtttcaccatgtta

SEQ ID NO: 66294 - DNA, 1047 bp, Homo sapiens
ttcccagggcttgggggctttttctagtgggctttgagctgctcaatctggcctctgcagggccggctcccagcccttccaacctcctcacagcccgacctgggacctagccaattcccggagagtctctgtcccatcgtgaccccctcacaactctcccactcaccaaagtctgatgactgtgctagggggtgcttatatagagtactgagtgttacaaaagcagaagtctggatgagaaccaatttgtgatattaagcaggtggggtgggggtggggagtgtacctaggttcattttccgccctgcttttcccctttccagtgtgtgcacttaaccagtccctgggccctgttccccatccccctccaaggcatggattgggtgggcttgtgtgtcttggggcaggtggccctttctaaactctctgcctttgctcacccacaggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagt

SEQ ID NO: 66295 - DNA, 1037 bp, Homo sapiens
gacacccagtatttcctttgctgatgcttgaaatccatcagacaaagccccgtggggaggacaagaaaagggccatggatgggtgcagtggctcacacctgtaatccaaacactttgggaagccgaggcaggcagatcacctgaggtcaggagtttgagactaccctggccaacctggcaaaaccccgtctctactaaaaaaaaaaaaaatacaaaaattagctgggcgtggtgcacgcctgtagtcctagctactcaggaggctgaggcaggagaatcacttgaacccaagaggtggaggttgcagtgaaccgagaccacgccactgcactccagcctggacaacagagcaagactccgtatcacaaaaaaaaaaaaaaaaaatggggtcgcgggagccaaatgtgcagagtgagcagtgtggctgggcaacaggctttcacccccaagtacatgtcacttcactcagtcctcaaaacagctctctaactctagatattatgatatctagagtttctgtaagttcagtgttttgcctctgtttgtgtagttaggaagtgattaaccacacaagaaatcccagaggtattgcaaggctactgctttcagtaatcaaaacaaggtacagccaataagtgctctgaatttagggacttcatggagaaagaccatgtgggctggggcagtcagggaaggcttcctagaagagacaggtcttggggtgagcacagagaattggcccaggctgtggacagctatagagagagagccaggaaagcctgtgagcagtgtgcagctggagatagagaccagtctcactgcgtctgagcctctgtggcctcgtctgtaaaacagagataatcaccccagcttcatggggttgtgaggaagatcaaatgagatgacatttgtgaaagtgcttcgcctacttttggcacatggtggaagcttaggaaatgtcagccccacccactctcctgactttcgggagcaaaccagtagagaggcaagcatgcagccactggggcaggcagagc

SEQ ID NO: 66296 - DNA, 1047 bp, Homo sapiens
tagcattgaaggctcttttaagacacatctattatcagagaggcctatcatgttcatgacctgggtgtccaggtactcagaaaggaacaggtcccatgtatggatgaggtaggatttaatggggcagcctgaaagcccctggcctactgccgtgcttgacacccggtccacaggaaagccagttctgtccttcagcctagtacagtcgtcaaataccccatccctgttccctgggaaggcccttacagatcagctcgctgaagtccaagaagaataagatcaaattccccccagacattctggaacttcctcaaccagcatcaacccctcttctagtaataggtttgtcttggctgttctccatacctgcagctcagcctatccacccccaccactttcctagcaaagaaaattccttcctcacaaaacctgcacctccacgtggcataccctctctcttcattgtctgttcacattccaccttcatgtttaagttcccgctccagggacttcaccccatggatgacacccgctgtctagactccaaggcacctgcagcccctccagctacgacgatcctgcttccatgtgtgttcctcctgcctccccaggaaggttgatgcctcccacaaagcccatgttctgctgacaactttcttgtgccctcaggtctacagccagaagtgtaggagtatttcagaggaatggatgatacatttgagggtatccctgctctggccaatttcgcctctggccaaccccaccagggttgtgtgttagggtagcagtcctgatgaaggaagaatcttcactactagtcaagatggtttctaaaccctattgaggtcaacaaaagcaaaatgctgctgagtgtgagttctctgtccttccacaccccgcccctgccctgtacacagagccaagccctgtccttgtccttgttctgattcctgggcctgggccttgcagataaggccccctaggtcattgggttagggtatcagtgctggaaggttggtgccacacacgattcagctccagggcaga

SEQ ID NO: 66297 - DNA, 1072 bp, Homo sapiens
ctgacctgaagtatagactgctttatgatgaagacgaggggaacagatctgagaggattagatagaggggcaggggatgagacaaaggaaatagaaagtgtaattagaggtttctgtcacaagttacccggcaggtgatatcatttactggataggaaacagcacatagacaggtttgggagacgatgcagattgccgtttggggcatgtgcctgtaggacatccaggaggagatgcaggaggagtgaagttgagggctgagctcagccataaaggtaggcatctctgggagtcgatgagggcagcaagaagagcctgggaagggggaaccaaacacacagaggcagactctgagcatctccagtgtgcaaagagaagcaggacagggcatgcccacaaaggagatgaggagagctggtcaggaggtgggagaagcagcggagagagaggtgccgtaggagcagatgctgcagagtttcaggacgtcgtggtcagcactgacgctgcacacaggtccgggagaatgtggctgacatgtatcactggttttagtgttaaggaggaccttacagtggtgggaatggaagccagacttcattagtcaaagcagctaatggtgaggacagtgagaacagacaactttttcacataaactgaggagataagaatagctgacatttatcgaggcaccattctaggcactttacatatataaattcatttaatccttaaaacaataagtactaatacatttaaaaatggagaaattgcggcacaaaaagtgaactttcctgaagttatccatctagtaagtgacagagagctgggtggtaactagaagacaatgcaaggtcagggggttgtttgtttgtttccctaaatgggaaacttgaacatttttatgaactgaggaacaggaatttaaagttcatgaggccagacatagtggttcacacctgtaatcccagcattttgggaggccaaggtgggaggatcacttgaggtcaggagttcaagaccagcctgggtaacatggcaaaattccatctctactaaaaatacaaaaattagc

SEQ ID NO: 66298 - DNA, 1031 bp, Homo sapiens
atatatatatatatatatatatatatatatatactgtaagttctggggtacatgtgcagaatgtgcagttttattacataggtatacatgtgccatggtggtttgctgcacccatcaacctgtcacctacattaggtatttttcctaatgctatcccacctctagcctcccacccctaacaggccccagtgtatgatgttcccctccctgtgtccatgtgttctcattgttcacctcccacttatgagtgagaacatgcggtgtttggttttctgttcttgtttgctcagaatgatggtttccaggcttcatccatgtccctgcaaaggacatgaactcatccctaaagagattgtttttaaagttccactgcctgcttaagaaagggtgttaccttattccagtactgtggtgaggtcaacataggtcaaagaattggctctgaacttcgtagcactagagtgcatccaaactcatcggatttttgcatttaacatagtgcttagaacattgttaacacttatgaaataatgaatgaatttagggaactacttgtaatcacatatataagagcctatctgatcatctagaatgctagtttattaattatatggaaaagcatacctactgaggggaccagggtattcttcctctctggtcaccacatcttggaaccataaagaaaatctatatggtaataaacagagcagaaaagaaaagggtaacattttgcaggtggcatttttgtgctgggtgcttttctttcaaacatttgtttagtacttgttacatatgcttggacctgggaattcaaagatgagtaagaactagttcctaaccttaaagagtttacagtctaataggagaatacagtagtaagtaaataattacaatgaagcatcagaactatgaaaaaggtattcttggtgctatgggaacacagggacatgacacctctaaggatagcatctcagtgaaagtgatacttgacctgagtttcaaaggatgtaggtataagtcaaggaaagggg

SEQ ID NO: 66299 - DNA, 1027 bp, Homo sapiens
gcactcatagtaccataaacatttcacttttaaagcacttctctctcaaagctctttctaaaccattatctcattggacaatcataacaactttgggagacagcactagcatcagttttcccatttgtgaggtaaggaaaccaaatctgagagaaattaatggcttgttcataataaaccactagttctagccatagccaaagagaactcagatcttccaactcctagcctttgttcttcccatctaatctcattgcctctcaatggtcagatgaacataaactccaactcactgtgggtatgttttctgttctgtcttgagccaggatgataggacactatggggtggagagtaagtaacttgttttttgtttacttttaagactataattgagaatctttattttctcccgtaagggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtaagtg

SEQ ID NO: 66300 - DNA, 1045 bp, Homo sapiens
taagagaaagatagtgtagagagaaataaagcaaatgtgtcagtgttaatgggtgtatcgagatgaagggtgtgtaggagttcattattatatttttgcaacttttctgtatacctgaatttttttcaaaacatttaatttaaaaaatgggctgggcacagtggcccaaacctataatcccagcactttgggaggccgaagtgggaggatcacttgagcccaagagttcaaggtgcagtgagttatgattgcaccactgcattccagcctggatgagagagtgagaccctgccaaaaaaaaaaaaaaatgaaggcattcaggctttgattggggcatgagcaagagcaagataatctctaatgcattttacaaaactaagatttagtgcatataaggggagggttgtgtggatatactgtaaactagccccttgatgaatagaccatcaaataatttttcttttttgcttgatttaacagcaagtgatataatcagtattgagtcatgcaaagagtatctgcttggagtagtaaaagttccaacaaaagagctgctgatcaagagatctggtaaggatcctggattatcactttctgatgccaccctttccctttcacttccctacaagaggtaatcttctctgtctctcatgtaagatattcaaaagaaaacacaaccccttaacacatgcttctgaactctctccaatacctcaaatgttttttgaaacttttttttttttagtttaaagatcttaattaattttatttgcaatcgggaatacttcatttcataaaataaaatgtgttccaatgagctgagcagaagaggttgattttatagatggagaagtcctgaagaaaggataaacacagaccacgcatggtggctcacgcctgtaatcccagcactttgggaagccaaggcgggcagatcacctgaggtcaggagttcgagaccagcctggctaacatggtgaaaccccgtttcttttttctttttcttttttttttttttattatactttaagttctagggtacatg

SEQ ID NO: 66301 - DNA, 1059 bp, Homo sapiens
ataaaaatatataaaatagccgggtgcggtggttcacacctctaatcccagcactttgggaagccaaggcgggtggatcacctgaggtcaggagttcgagaccagcctgaccaacatggagaaaccccgtctctaccaaaaatacaaaaaaattagccaggcatggtggcccatgcttgtaatcccagctacttgggaggctgaggcagaagaattgcttgaacccaggaggcagaggttgcagtgagccaagatcaagccattgtactccagcctgggcaacaaaagcgaaactcgtctcaaaaaaaaaatatatatatatatacacacacacacacatatatatatataaaatatacagtatacataaacatcccttttctctctaaattagtgattctccacattttgagggatttgcccttttgaggatctgatgaaaactgtaagacaccttgtcttggaaaaaatgagtatagaatatacactgccaattttgtatacaattctagaaaactcatagctccatggagtctatgtaaatgttgcttgtctcatttcacctttaacttcagcaagcattttataagccctcatgccataaattctaagcattatatggtacactcagagaattgttattccaagccaacatgagcagataggggattggtagaagatagcatgaaccaggaattcactgtaagggaggagaaggctagggtttaaagttaggagaggattaattcgaatttggagatttgaatgatattacatcctaatgcttccagcaggatggtgtaccctctaaatttatcatcagataacgaagtttagcctcctatatcaagttgctgtacatgcttgctaaagagtatctgccaaaacaataggttttatgtcaccataattaagattgagttgtttctcctgaccctccctgatcagcttattctgttattccataaagctgtccctgaaatgtgacagtaggatgatagaggttttataaaaaggtagcatgagaaggatatttcaggtggtgatggtaggagggtg

SEQ ID NO: 66302 - DNA, 1144 bp, Homo sapiens
aatcctcaataaatacacgattatttgttgttattacctttagtaacagtgtcttcactacctcccaaagtagtccttaccattattggacagtcctggtgttatacccaactgatttgaaatagtaattagtacctgtttgctattctgaatggccagactgaggagtcctgctggaatcgtggatgccactgtctgctgtaggctattagttttcctttttttcttaaattatgatattagtttggtctggtgttacccttcttccacttcacttctcattcctttgctgttctaaatgtagaatttattctaaatttacgatttattatttttcctatgaagggaacagccttctattcttagtatattaagagcttttatcaggaacaaatgttgaattttatcaaatgccttttcagcatttgtgttaatcatttttattgttccattaatgcactgaattacatttatggatttcctaatattaacccagtctcatagtcaagagtacatcctgtttagcctacttacagtgagtagttgtgagagttacaatgaaaattaagtgtctattttagtatcaactaattatacttatctctttatctatactcagacttcatagagaagcagaaatattctaagcaagttactctttaaagctcaccagtgtttctgtttcatttaataggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggtaggtttagatattaggctttcttattcttatatggttcttttattagattatacttaagagttttttttttctgagtgaattttgtgttgttgaatatttctagtcttactgggcagtaaaacaggagataggccaagttttttttattttttaactatttttgtagctttttattttgatacaatttcaaatttacaaaaacctgtaaaaatagtacaaagaactttggtatactctttacctagttctaccaattatttgcattt

SEQ ID NO: 66303 - DNA, 1643 bp, Homo sapiens
aagtagctgggactacaggcacctgccaccacacctggctaattttttgtatttttagtagagacggggtttcaccgtcttaaccaggacagtctcgatctcctgacctcatgatccgcccgcctcagcctcccaaagttatggtgttacaggcatgagccaccgcgcccagcctaaactgttcctttttaattttgactcaagattctgatttttaattattttagcactgacctctttcctagcagccttctcatagttctgtgttttaaatgttgtgttttacattttacaaagagcacctttgtgggcattagctcatttgaaccttactataaccctataaagtattgttattatccctatattacagatgaagaaatttgtcctttaacttgcagaagtcacttaacctctctgactttcttttcctcatctgtaaaatgagggtgatagtagattacctatctctcttgtggaacaatcgtgaagatctagagagaaaatacatggatatgccttctgtgaacagctgagtattaatacttacaacagtaacattggaaatcatggccaggctgggtagtcctgctggaatcgtggatgccactgtctgctgtaggctgttagttttcctttttttcttaaattatgatgttagtttggtctagtgttacccttcttccacttcacttctcattccattagatctcattctttgctcagagtgtgtaaaataatagtaactaccagttactgggcatcttccatgtaccaagcatcatagttggtattttgtatgttatctcagtttagtcctaacaaccactctttgatggaagttttttcattgcgtacgttttaaaaatgacaaaacagactcaaaaatgttaaatgaattgcttgagtcacacagcaaataagtggcagagctaagattcagcatggcattataaatcatttatcagagcttgaatcccaacttaacctcctactagttgtgtatccttagctaagttacttaacctctttaaatttggcttttctcatccattaatagtggataataccaacctttgcagcgttaaaaggattagaaatactataaaatgcctagcacatactaagcacttagtagatggcagatattggcaatattttccaaatcttatctgtcagacaccaaagtccacattcttcctagtagaccacacttcctccctttaaaataatgcagtttagcaaagctccatgagatactgttcaaatcacagacactggacttgggtccataatgctacagagacatatcagacacattccttgccttcaaattgctacattttgaacttctctgcctggtaatttttatttggtaggttactgacagatgcacacattttttaaaaccactattacttttccagttgcaaatctatttttaacaaactgaaaaaatgagtcaagaaagaaataactctatgacatgattgatgcttgttatttgcttattcacaatttctccccctctagagatgctaagatttctcgcctgctgctggatgcccagtacccagttgttgctgtcgacagctacatgcctgtgattgatgtgttttcaggccaccaaaatgggagtcttc

SEQ ID NO: 66304 - DNA, 1125 bp, Homo sapiens
aattctttttatttaccagttaaaactccatggccatgagcacaaactcaaataccaccatcactttatccacttacacttatagttatagcagaaaccccttcctttccacccaagagatagactcctttgcctgacactactagctaacatcagtacctgataacttgtttgtgacagtaagagtgtccagaaggtaggcttatttttgtattatagttttttattccattcttctatttatccctcattgttccacctccaaccagcccccttcttttagtatactacctacaaactagtcttttaaaaacagtgctattacctaaaacccagtgaagtatatagatatgtctccttacacatccagtactcatatgattgacattcatttctcatggcaaagcggagcaacatagcactgcctgtcttctgtgtactatctccagagttttctctttgtccctgctcattcaatcctacaaccctagcactttctgtgaaagcacactgactcgatttctgcaggagattttaattaaatttgaaagggaggcaggtggtatcaaggcatgaattgatgatgacttcagttgggtggtgtgacatgtctgtgtgtctggttctccttacagaggtgaagttccagcagcgatttgtgtttccagtacagtttggtggcccaatgatagagcactggtggaattccaacctcactttccaaatttatgtaaagaaaactccacagaaaaaggtactttgagtgattttggcctttgccttaccttcacactagggatttggaggatacctaaaattatattcttacctaaactaggaatcttcaggtgcaggcagtactaataatccattgttattattattattattattattatcattattattattactactactaatctctgctgtttgtcatgggccagatataatactaaaggctctacacgagcacactatcaattttaatcaccacaactctgtgaattaggtacattattatatttgttttacagatgaagaaactgagatttagttaacatgtctaagatcactcaatctaatgaaagagccaggacaccatcccaaatctgctgtctttag

SEQ ID NO: 66305 - DNA, 1065 bp, Homo sapiens
tgtgatgacccatgcttgtggtcccagctacttgggaagttgaggtgggaggatcatttgagcccaggaggtcaaggctgcagtaagccatgatcgtgccactgcactccagcctgggtgacagagcaacaccctgtgtcaaaaataaaaataaaaaaataaaaacttgctgccctccctttttcctcatcttgcctgtgcaaactagattgtttcatgtgaagcctgtagcagtatgcctcactgcttgtgtgaactcctttcagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcggtatgtctctaacatgagaaagctaaatttgacatttttggaaagtgtgtctgatggtaataatcaacaattgcataatactgtgatttgggatgtgttttcatatgcatcatttaatctacagaaatatattgaatccctgctatatcccaagaactgtgtaagtaagtatgggactaaagaaaattaagatacagactctgttcttacatatcttacagttagcaggagagagaaacatttaaatggctatctataacataaagctttagggcccaaaatagatgttttgtattaaaattgctgtgggaacacaagaaagggagcctttgattctctcagacagggttggtggaaggctttgaagaagaggtagggcctctgagtactagaggtcctgaaagtaagatttcaaatatatgttggatttatcagacggaaattaggtttattgtttggttagtttttaatcactttttttttctttttagcactttctttgtagaatatcactttcctgtgggcttttcggaaagcggattgggaaagacagctttgatcactgaggttgttcgactcgcctccagta

SEQ ID NO: 66306 - DNA, 1033 bp, Homo sapiens
tatacagcacctgtaagtcactgaacctgaagcattgagaattagagaacaaatgtattaataatattagtagctgcaggcatgacagctatgcattttacataacttaccttacttaattttaatgacaacctcaagaggaaagtattatcttcattttacagatgttgagacaggcctagtaggatttgaatattttgtgcaagaacatatagcaaataagtattagagccagaattcaaattcacatttgcctgagtccaaagcctatggtttaattaatatattttatggtttccttagagcttttataaggaagagctgatgtagttataccctcagaaccatccttaactggtatctgttaaaaatattccaaaaacacttcttactcacaggagacaaaactcttctggcctgtaagacagggattctcttttctggcagctctggttttttcaaagttcttttttctatcaagccttatgctcttttcattggcttagcatcttctagaatctatacatactatgtccaatccctgttccacaagtagttatttatatgtgtgaaggttcatactcctgattttccttttctccaggtcaaaaaaagatactgaaatacaaggtagtttatatcagcccagtagtaagccagtgagggctaccacagtttggaagaagcagggaaaacttttacatgagattgtggggaaaaaccataatgaagaataaagggttttaactgagattgaaagatagtgttttgagaagcagagaaaagatacaaaatgggcgtagaaagaatgacctgtgcagaaaaacacatttttgcgctacaagggacccaattgactagatgagaatttgtgtggaaaaggagttgataaggcaggctggcacattgcagccaatctgtgaaaggcttttcatgtcaggtgaagaggaaatcacatatcacaagagtgttctaggaatctgtgtctggcaaccctacagtggggcagactgaagagggaataacgagaagc

SEQ ID NO: 66307 - DNA, 1044 bp, Homo sapiens
tgcttgtgcttttgaggtcttacccaaaaaatccttgcctggaccaatgtcatgaagcatttcccctatgttttcttctagtcgttttatagtcctagatcttacatttaagtctagtccacttttagcttatttttatgtatgatgagaggagtctactcttattctcctgcatgtgggtattcagttttccagcactatttattgaagatatcaacttatgttttcttcatatactgttacatgccactaacttgggatatacagagataagagatggccctttcatttaattttccagaaccctgtgtaatacatactgtgtgatagatatgcatgagatactaggaaagaacatagaatggtccctcttctgtggggggctcattgggagcactttctagaaaattctgaatattcaaaccccttagaaattccaggagggttatactttgtcaattgtattctaaaatgtatagagaaaattaaatactaaataagaaaatagtctaaaaaggataaggaaaaaacatctaacattaccaaatgtaagaatttattaatattataaaatcataagcatataattttgtcagtggaacagattccagaaatagatccatctaactgaaaaaaaacttaacatttattgtttttatcctattctcatttataatatattaaatgttaaaatagtgacactttatattgatgacttaagggtgaagtgagtctggtttagtcatgcttttctgttgatgatataaatttgcatcagcactgccagacagtttggcattatgtttcaaaagccacatgaattactgtatatcgtttacctcattattccacccctgggaatttaccttaagtaaatactatgaaaagagaaggaagctatatgcttcagtctagtattggaaatacatttttaatattgggaaaatgaaaacaatttattcaacaatattaaagttatagtctatttgtggaatcttttatatccatagaagataaaattacatagttatgattgtgtggcag

SEQ ID NO: 66308 - DNA, 1360 bp, Homo sapiens
ttgtgaatactaaatgaaaaaaatgtttgtaaagtgatcggtctagtagctgacacattgtaggtacaagtcttataaaaatattaagactcaggcagcgtgtacagagatttgagatgtattccctgcccaaaaggaacttaaagattagttgaaaacaaaactgacatacatgaaacagtattgagcaatgccagacagtatataattaaatgtctgattacttgacacatatagtaatatcatatgaatattctaggaagttaataagggctaatcttatgttattaagaagccagaatcctgcttctactctatgctcttgctgtttgactttgagcaagccatttcatcttcttgggccttaattttcccaccagtaaattgaaagagttaaaacatcaaatgtgccagcacccaaatttcataattctagttaagaaagaaggccatggaaaaggtagaatttcaataggagacacatgaggtgaaccttataagtgacagtccaactgtagacatgacatggtttttttttttttttttttaagacggagtctcactctgttgcccaggctggagtgcagtggcgcaatcttggctcactgcaagctccgcctcccacttcctgggttcacgccattctcctgcctcagcctcctgagtagctgggactacaggtgcccgccacgacacccagctaattttttatatttttagtagagatggggtttcaccgtgttagccaggatggtctcaatctcctgatctcacgatctgctcgcctcagcctcccaaagtgctgggattacaggtgtgagccaccgcacccggccgacatgatgtgttttttagaaaatgaagcgataagaggctgaacgtggtggctcacgcctgtaatcccaatactttggtggctgaggcaggaagatcacttgaggccaagagttcaagaccagcctgggtaaaaccctgtttctacaaaaaaattagattccacatgcatagcaagaccctgtttctacaaaaaaaaatttttttaattagctgggcatggtggtgcacacctgtagtcccagctacttgggaggctgaggtgagagaaatcacttgagcccaggaagtcgaggctgcagtgagccatgttcatgccgctgtactccagcctgggtgacagagtgagaccctgtttctaaaaaagaaagaaaatgacagaaaatgaagagataagacatcaaatattagttcacaaaagtatgtgctctaaccaaaaacttggaaaaagtatgctatttcttaagctgtgtggtaggtattcgcattattattattttatttactcttttgtgtacatatttca

SEQ ID NO: 66309 - DNA, 1064 bp, Homo sapiens
gctcaactccgtctccagcacctaagcagtatcctcccgccatccctccccacggcgcctgcgttccccggcaaccggcgccgctgggcagcctgggaggcaggaaaaagcgactcttcctctaacagtctccggaaaacggtgcgaagagaaggcgccaagacgccttccctccaatacactacaatacccaggacgctttgctacaatacctctccggggttggctggggggcgcctccagctgcgcaagcgcatagggatgcgccctttgtggactccattgcgcagggtgcattgccctgaagagcgctcctccttccggtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatggggtacgtgacccataccccttctccctatgggccaggccccagccgttggagaatggtatctctgggcgttcatagaggcacgggaaaggagtctactgataggagaaaatgttggcggcctggagatatttagatggagtagaaggcagattggggtactaggggaggcgccaagtcaatagaaattggaggaaaaataacgttgttgaagggagaggggaatgaggcaaaggttggggaagctgagagactaacataagggatctgagaatcacttccacaataaaggaggcttagaaaagggagtagaacggtgacaaaggtggaggagaatcggccagggaaggtggagggaagtg

SEQ ID NO: 66310 - DNA, 1050 bp, Homo sapiens
ggcgtggtggcacatgcctgtaatcccagctactcaggaggctgaggcaggagaatcacttgaacctgggaggcggaggttgtggtgagccgagatcgcgccattgcactccagccagggcaacaagagcgaaactccatctcaaaaaaaaaaaagttctacttttctattattatctcttaaattcctttttttttcttttgcaagagatagagtcttgctgtgttgcccaggctgaagtacagtggcttttcacaggcataatcttggtgcattacaacctcaaactcgtgggctcaagcagtcttcccacttcatcctcttgagtaggtaggactgaggatacatgctagcatgcccagctctgtagtgatttaactgacatgtatatagtagtccctttttatattctatgaggtaaactagggcaggagttaatattttcttttaataaatgagaaaactgaaatgttcattgacttgcctaagatcacagaatcattatgtggcaggaacaacattcaaacccaggacttcgtatttttagtccattgttctttctatagcttgcattgaagggtttgatatttgaagtgacaaagatctaagtttgaagcccaacttaggtatttacattggtcgagtcatttaacttctcatagtctattttcttatctctaaaatgagaatacttctgcttacctgagagtgctgtgagaataagataatacataaaaagcacttatagttcctgacactgacacataagctcttaaagaatgatagctagtagataattatacattgagaactgtgaagaaggttcatagtttatgtggaagctctcctttcagtttcttatgttatcagcttttttgtccccacaagctgtatgtttattcatatctgattagatagtctttcatccatcttcttaaatttattatggatatcaggcctcttaggaaggctttaatgagctattcacacagatggggaaataaagggcaaagtgaagtgatttgctcaaggtcacaaattgagttacta

SEQ ID NO: 66311 - DNA, 1032 bp, Homo sapiens
tacattttaaaatacttatttaaatgcatttacattattatgtaatacaatacattaaatacatttttaatatgatactttgtgatgaactctttatatctttaagagaaaatacctttgctgttttcattactgacttacatttagcatttattgaccaagattttatctctttatgcataatttttctgaaatgtctctctcttttttttcctcagccctggaagaaagcgggacttttcccctgttccttggagtcagtattttgagtccatggaagatgtagaagtagagaatgaaactggcaaggatatatcctttgcaaaatggcttattctttagtgagcttatgatgttgtctaagttaaaagacttgtgtagtttctaaaatgttctttattcctgctacttatttcaccttattcctcacttgttctttatggaatattgcctggaagtccatgccaatatctttcttggctgtaattctctaatgcatggagaagggattaagaattaaattcttgaaactgatatactgtcttaggggcccaggggaaggtttcatgagtcaagtgagttgaactagtttcatttctagaatccaggggttatgtcctcatgagggcaaagggaatttttttttttttttcattgaacaaaatggtcacacaggcttcatgcttcaaacagagggttagtgtctcagaaaagtctgcttacatctcttacatttggcagtctgcagttttgcatgtaagtttctagcggtattactatgattaaataatgaaaaactttagtgagcaaaaacatagatgttttatctttaactattcatacacttttcgagtctacaagagtggttcagagggtccagtcctgctccttctgcatggaggaggtcattctgccctttcttgggctgtgttcacggtaagtaggttgttgatagtacaagttaatgttagcacttttgaactaatgaaagtatagggacaaatcttggaagttaacacattctatttggga

SEQ ID NO: 66312 - DNA, 1050 bp, Homo sapiens
ttatttatttgattccaatgatgtgatacaatagatactgaataaccttctctcttcctttcttttctttcccagtgtgaagagtggccagattcgaaatctggagtctgcccgtgtctcaatggttggccaagtcaaacagtaggtcttactcttcccccttggtctggttagaggcggaaacatggtgagggaattacagattgcttcttttgtcttacaccaattctaccattccggtaaatgcctttattattttaaataattttaaaggtgagttcagttgggacagacatagattttctttcgcctgccttcctttctctccttcctttccttccctttcttttttttcctcctcatttaatactggattaccttagcaaaactctgcgtgttaaaaagcaaatcccagagcatagacattacaaattatgttaaccttagtgatagcagctgagtttcattctagtaacagtctccttctaagccaaacctggctgtgagggaattataataaaaaagctctggcatagcctgagtgaaagccagattctaagagtgagctaagattatttagcccaattgatctttcctgatagaattacatggcattctgggtattgctgtatagtcacaaaataaactttagatgaattgagaaaatgttgcccaacagaacagacagaagttagatgaaaatgataatggctttgagtgcttactatttgccaggcactgtgcaaggtattttatatgcactgtctcatttttaaaaccttatattatggaaaaattttgcacatataaaagaagagtgatacagtggatggaccccagtgttcccattgtccattttcaatggttattaacccataaccatgtctcatttgtttcatctgtgcccctatgtatttcccctagtcacaaaatattttgaagcaaattccaaacaaatataatttcctctgcaagattttcatatgatctaaaaataagggctctttaaacatcatcacgatgacattattacacgtaaaaaaattggca

SEQ ID NO: 66313 - DNA, 1027 bp, Homo sapiens
actggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacct

SEQ ID NO: 66314 - DNA, 1132 bp, Homo sapiens
aaaatgcttttcttcccagtctctgctcactgatatccttttccttcttcaaggaaggcctgtctcagatgctacctcttgcatgaagctttctgagattcccaagtctcctcccttccctgtgccaccacagcatagtatacattttctttggagcactcatgatattctgtcccaaattagagttaattgaggtcatgttctcttttccttcagattataaattccttaagtgcaagaacccttatgtctcctctccacgtagtacaatgcgttgtatatagtagatgcttaataaattgaattaaaatgaatttgaaattaaaacctgccttcttggattccaaagtccctcttattctttgaattgtcattttctttttctacctgtggaataaggctttggcgatggtacttgtgttctgtgtaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggtaagggagtaagtgaagctcactgcttttattatactaagtgaaatcctttatagctgctttacaatttctaagtattttcatgtcttcatctgtttcatcttcccaataggaccaaactgagccaagcagggaagttattttatcatttccatatatcacatgtgagtaaactgaatctccaaaagactattaacttgtcacaaagcttatagacctaggattagactgttagtccagtgctctttccaatgcattgactactttacaatcattatttcccatgtaggaggcagtttgtcacctgtagcagcagctgctttattcacaaatagttaatgggttcataataaatgtagatcactcttttgtgctctcagcaactcataattcatcacagatattacccataatattgccatggacaaagaagtttgattatgagcttttcccatctgcagttgagtccaactgtaatgtgactcctgtctggttacagagctggagtcactgttctgtagtaccagccacagtgcctcctccaggtgttat

SEQ ID NO: 66315 - DNA, 1057 bp, Homo sapiens
gtcccatcactgaactttataatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatttatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcataggcatgagtttctgtgtaatttttatttgagatactgtgtagttcataaagcttgctatctaaacaggaaatactcttgaaatacacacatcacataccctagaatccactttgcatctaaatgaatattctggcttagtactcaggaaatatttcttgattggtttatcagaagtcccagatgtgagaactaacattaacattcttatttttcttttctttttctctccttaagctgatctaatttgtttgcccatgttagcgccagctactataataagacaaaagtttaaagtttggaaatctctcacggtaataaccgtagatctatgcttcaatactgatgaaggactgagtttccaagggttcttatgaatctgtggtcctggtctctgttgcctgcctttcccagatcaggctcaaagg

SEQ ID NO: 66316 - DNA, 1032 bp, Homo sapiens
aagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaaaatgtcataaagggcactaaaagtaacatttgggtttcactccatatctagaagaatttagctcacaaaacaatttttgtgtgttttgagtaactgatgcataagtgcaatgaataattttcctgcttcactgttatttttaatttaacctggcaaattaagtgagacttgaacaaaattttgttcatcttgaagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgctt

SEQ ID NO: 66317 - DNA, 2009 bp, Homo sapiens
aaattctgatgtttactgaacataaaacaatagtggcaacactcctattggctttgttcttatcaaatttctcagtgccttctcagggtctggtgtgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaaatactaaaactacatgttttaaaacagaggtccagtttattctaacatcttgctgacttctgtagaatttctgattgcatgactattatttatcttcttttagtgtagaaaataattttttacaaaaagtcacttttgggctgggcgcagtggctcacgcctgtaatcccagcactttgggaggctgaggcaggtggatcacaatgtcaggagtttgagactagcctggccaatatggtgaaaccctgtctctactaaaaatacaaaaattagccgggtgtggtggtgggcacctgtagtcccagctactcgggaggctgaggcaggagaattgcttgaacctaggaggctgagattgcagtgagccgaaatcacgccactacactccagcctgggcaacagagggagactccatctcaaaaaaaaaaaaagtcacttttggctaatcatgcagtcttctgaaaaggtttaatagagaaatgctgtttaggctgggcttggtggctcacatctgtaataccagcgctttgggaggctgaggcaggaggattgcttgaggccaggagtttaagttacagaactatgatcacactgccgcactgaagcctggatgacagagtgagaccttatctcaaaaaaaaaaaaaaaaagagagagagagagaaaaagaaatgctgtgtttaatcttcttaaaatgtatcttgtcctacatagttctcagaatacatatggggtatagttaggagataacaataacaagacctaaacaaattgcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactattgttaatttgttccttccttactttcttattgttggatcttatatgactgtatgactgtagataatagacagctagctaaatgtagagcaccatttttctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaacagttttatttgagtgctttaatataatgcaacatttaagtcatcttaaggtgaaaagttattgaagtgttcttctctcaagttaacaaaattttacaaatgttcctgaagtgtatcgattgagggaattattttattctagcctgtcatgagtctgtctgagcatgatacttaacatgaacttgatgtagtaggt

SEQ ID NO: 66318 - DNA, 1057 bp, Homo sapiens
tatttttcaaagtatttcaggaagccattttctcctaacacctggtatttgtgttcaaagccattagaacctcattctcctgacccaggagaattctttagatacaccatcactcctctgtttatcatgtgccaaggaactcctattaatgcagttcaccttcagtttgtgatagcagtgttttctttgtgtgtaatttttttttttggtcttgttttgttttaaccaagtgaatttctcttttgtttaccaattgtttaatgactccatcaggacctcttaaaaaatcacactaatttaaataaattttaagcctatgaaaataaataattccaaaactcttcatcttttcctcagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgccctt

SEQ ID NO: 66319 - DNA, 1034 bp, Homo sapiens
tatttagaatgacatcatagcttataactttaatattttggcaaaggcaccgggtagtagtaattatgtagcttatattctcattatatgcctattagattagttttagggtgtttttataaatagataatcatgtagtgatatctttcttcaggggtaataatgcatattgagtttatcaaagtctcttatatcactttttccattctttttgccttttgcagattttatttcttagtaaaagagccatcaaaagatgaatgagggaaaaagaggaaattgaaatatcaattatgttagttgttaaactcttcttttaaaaaaacttatttatttaaaattttccaattagggcatgaagtttaaataatcagtgattataagaaagggctatattaggatactatttattcagactaattataatatgaaacatttatgtggaaggttggtttttaaaaagtatggtaggcaaaggactaagttaaatctctctttttttaggcttgctaaactcactgctgcagtcttgctggccaaagatgttcctgtgtaccttttttcaagatatgttcctacaccttttgtagtaagtgtgttgtgttggtgatcatatagcttgctgctcttgaaaacatttcttaaatcaactaggattcaaatattttttgtgcatgtagttctgtattgagtaatataagggaccaatggaaggaaaacaaattttgctttgagtttattttcattcaacagacatttgttaaacttagctaagaacttgatctataaaagttgacaagtctacagttatagtgaaatatgttaacatcttctttcagaaattgattcattgggcagacaaaaatgatgaaggatagatttgaacacattgttaacaggcttgatctgggtgtgtgtgtgtgtatgtgtgtaaaaattctctattgagtgacaataggatttacattattattaagcagaatcacagtctcagcaaatgccaaagaactgcttatcaagccatatacctggat

SEQ ID NO: 66320 - DNA, 1068 bp, Homo sapiens
tttttcatttcgttttggtttatctgtggcattttctgagctcaacgagagaaataaataagaagggagcatgcaaccctgttgttgttagaatcctaaaatagtaggactgggggaaaaaaaaacagtatgctctcccttcccagcattcttatctaggtgaaaacaaactgcgaatgcagatttaaaggggagtagaaacggcttttataagagaaaactggaggagcgttcaggaaaggacagagacagttccatctctttgctttagtgacattaggggttcatgtgttgacggaatgtatatgaagctcagatcttttagaatcagctgacaggtggaactattttccttcccaaccatctgcacactctgtaaagatagaacagcgtcacgtttcaatgcactggatgtcttgatcatgaaattacctctactttagagatgttactggctcccattcccagattcccccgcctgttgtaatgcttgctatgattaggttaggttattaggttgtattatattattgctcctgagttcacaggaaattcttttttatccttcccccgccaacccccccccgccccgccgcccatttcatactaggctcttccaagattattttaaggaaggttgttcgattcctagactgttcaaatggaagaattttaggtgtctggcttagctctgcagattacagccaaggagcacaggcccagaggggcattgagtgacaaaggtcagctgaggagttagcagcagagcttaagtgtcctctccaatgttctttctaccactgacactatctcttttttggcaggtgattagcctgggatgaattctggcacggttctgaaaagcgtgctgtctttcttcttctagctacaaattcctcttttccagttccttcctcttctgtcttttctccttatattttgaatctcatccagcagccacaacaggtgttgggcctgcctctcaaaaaatcctacagcttggctggcagggtcctaggggtggagcatgtccttgcaccacccagttggctgccagatcaatttcaa

SEQ ID NO: 66321 - DNA, 1049 bp, Homo sapiens
atctcggcccactgcaagctccgcctcccgggttcacgccattctcctgcctcagcctccagagtagctggggctacaggcgcccaccaccagcccggctaattttttgtatttttagtagagatggggtttcaccgtgttagccaggatggtcacgatctcctgacctcgtgatccgcccgcctcggcctcccaaaatgctgggattacaggcgtgagccactgcgcctgtccccaagcttttttttttttaagtattggaatctgttaaaagacatttcctggaatcctcatgatgagtgcagctgcttgaagccacgcaccccttcctttcatttgtttccttttcccatctgagtacaatcccttgtttctccagaaacaaaatttgaaaaccggtgatctaatccagttttctcatcgccctgagagggacaccaaagcccggagagtggagggtatctactctaagaccctttggcttgccttgcaggagtccgctgtggaaggcacatcacatcccacggcctggctctcaactgctctaccgacctcacgtggtttgagcacatcgtgccctgtggactggttgggacaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatcttccccacctacctcagagatactagatgtgacaatactgtgaaaagcaacacatgctatataaaacattagcactgctattgacagcagtgtctcagagaaattcagatgtcatagattgttatttctcgattgttgatgtcatagattgtc

SEQ ID NO: 66322 - DNA, 1052 bp, Homo sapiens
ccagttggcagcactactaaaattacttgttttcaatagtctcccctttatcctggctttcccgggtttcatcacgcgcagccaacctcggtagggaaatattatacccaatgacatctgttgagagaccatattcactaatgtttattacagtataataataattgttctattttatcgttagttatttttgttaatctcttactgtgcctaatttataaattaaactttatcataggtacgtaggtataggaaaaaaccagccaggaggccccgcacttcggtgttttctactagctctgcctacctccgtctgcgccgtctccctgactagtttgacccttcgagggccgccgtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgggcgtgctgggaacagagcctggggctggagccgcggagaccgggcgcggagggagggccgttggctgagagttctaaggcgtccctacacctttcttttaaggtggttggcgtttaaagttttaagtttacagttgaggaaatcgtgtcttaactgtgttaagttacaagttgcgtaacctccagatactgtttcctcttcctggaaatttaagcattgatagaggtttgatccgcttcacacgggtgaggaaaagatcgagcgaattgatggatgtgagtgcactttgca

SEQ ID NO: 66323 - DNA, 1188 bp, Homo sapiens
agcagaagactcagtggggcatggttttatggaagctgagagagcaggctcttcaagaagagagtgaacagcaatgtaggttgagcttctctggggatttttaaatttctagctatgcttggcagaagtatattatagacagattgtaaatgtttctcaaaataaaagacatgtctctttgttgtttttaaactagattattgaagggagccaacttctgatacttgctggatcatagagtaaaaatgaatttagagattttactaaaagcaacattatttctgcatttagtatttggctatctcaggttaatgaattattctgaatactgggcaatgtgagtaagctgttacattctgcaattctgaaccggcattaaatctgagtaatcataaaattggaatttcagagctggacatttgtgatcatatacttagtagttcttaatgttttggagtaattcactcttcagaatccattgaaaaccctcacacatctcccaaaaaagcacataaacatttgctgaaactttaggattggagggttatagatggccacctgaatcccaggttaaaagaatcactaatctaatataaccctcctgtttacgccttgggatattaagaggcctagacaaattaattaacttatccagagcttagacagttaccaaactacttcttgattcagtgttctatttattatgtatcattgccactgttttaatgcaggttcagtccctcttggtctattattaatcttatttcagttaatgtactgatcactgtgccagctccaaacacatggactctactccccatgtcctgtctgaagtccatcctttttttttttcaactgtccataggccaagcaaaaatgctactgttcagaaaatttgatggactaccagatttcatttatcttttaagtcattaattaagagttgatcatgtaaaaactcttactgatgtcttacttgtgccttcttttctttggaataggatgctgtatgattatgttgaaaggaaacgaaaagaaaattcaggagcccaactgcatgttacctacttggtgtctggcagtctcattcagaatggacattccgtaagttctcagagccttgtaatgagcttaaatgtgtttgtgttatgaagagtgttataacatagttcaggggagagaaaaaaa

SEQ ID NO: 66324 - DNA, 1052 bp, Homo sapiens
aaatggactattatatgttaagcacttagaatagcacttggcacatagtaagcactatttaatgatagctgcttttcaagggaagaatagaaaaagaggggcccaaggggagccaccagagataagagtatatggggtttcagcccctaaggaaagaggttcaagtaggaggaaccagtcaacaatgtcaaacaatgctgagaagccaagtaagttaggaagtgaaaattgtccatgacatttagtgatagccttggtaagagcattttcagtggagtgaccagattctggtgagctaagtaaatggggacagaggaagtgagacagcaaatatggacagctctttccaggagattagactgcaaagcagaaaagagggtggtagctaaggagggattgagacgggaaggatatatacatttcttaagttgagaatgacttgaacttgggttgttagaaaggtgctgtaggaagaaaaggttgaaaatcctggggaggtggtatgactgataaagatgggtcctcaaggagagaaagatatagaattgccatagtttctataagttccatgagaatagggatcgtgtctaaattgttaactatatacccaaaatagtgcctggcacactaataagtagttactgagtgaattaatgatagacattagttctttttttttctttagctcaaaaccttgagtataataagcatacaaatatttattaaataaatatatggccaaagaggaataatttacaagtctcttatcttttagggaaggatttcaagaaaatattaacaccctgataagtttatttgaaatatattactagatttcaaaaaattttaaaatctagttgggtattccaggctctaaaaatcagttcccttgttatatctagcaagtaagcaaacaagaataaaagtgacgcaaaagttcaaaatgaaatctgccagggcccactaaaataaacatggcaagtagaaatgtggtaataggaagcacttcagtgaaactttacctaaatacttaaagtatcctcagtagaaaa

SEQ ID NO: 66325 - DNA, 1031 bp, Homo sapiens
tatcagaggaaggtctttaaaaacaaaggctatttcatttcccaaggataatgaaattactgcatcttttattattgttggttgcattcctactcttttgaattagaatacttttatcaaaaacaagaatattcaattagtggtagaaggcacctaattccaatcctatctattactaactagatgtataacctagtaaaagtgactcacttctctctaatatttgtttctttatgtaatagagagtttcatacatttttctaaagtcgattctaaacaatattagagttaagtattgtgtggaagaagcaagagtttgaaaataaagttttatactgacattagttttttttttctttttttgttgaaccacccaagaatgcatatgctgacattaacttaatgtaacatttctgtccccagatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgtaagtcttctttgaagataccccttcattgcagctcagagtgggtaactagaaaagcattaatggttgcagtggtagtagtttatttatataagattctgatattcagttctgatttttctactttagtttgaaccctttaatacttgatattgttatctgaaagagttcttttgcttttgataatgattctcaccaaaccttggatttcctttgcaaaatggtaatgcctaccttgtgcacattacaagattgttgtgaaacccagatgaaaacatgtgaaaacacctcgagaattgttgacattcaaaaaaatgtttatttgcaatatgtctttctg

SEQ ID NO: 66326 - DNA, 1112 bp, Homo sapiens
atctaacacctacgcgttttggcatgattatatagagactataccatcgcaacagtttgctatagaagagtttgtttgagactgctacttcatgaacagcctaaatgccagcaaaaaatcatatgtgttttctgtgcttgtaggcatctgcagcaggcaacaaggcaccagggaaagggaatatgatgagcaacttttttggaaaagctgctatgagtaagcatgttcttacctcactttgactaacgaatgaatgttaatgtaatgacatattatacctgaagtgaaagccactttgtctagtttttgccaatccaagagactacctgcattctaacaaatttccagtgtactgcccaatatattgatgaaagtaactcagctagaactttatgggtgagttaggctcagttgagatctctttgagagcagtttattattcctggtttaacttcctgccttgaaaagataatgaactatttgcttcatagggcccttgaaaatgggtgattaaaataaaagggaggctgcctggctacgcagtatagtgttgaggttaataacgtggatgctagagtcagtttgcctggtgtgacctttatttcttctatctctcaagggtccacaaaagcaaatattttgcctttcttcagttattttttgcagattactcacagtaatgaattagacttccagtgtgaattagaagggcccaagtagtaatggacatttaaaaatcttttttgagaaagcaaaaatcttctttatttttaaaaagatacttaagtaagaattctttcgtatggaaagaaccagtagtcacatattttcatacttctcatatcaagtgtacatcccctgagagtatgtggtagaataccaggaagaatgcaggagccacaggataattatggcacactttcttggagcatcagttttacaaagatttttcaaggaggcattttgttacatgcctatgcaagcaaaattagttagaattctgcctttccatgatggctaaattggtggtcacgggagggattgaagtgacttttttttttttttcatattctgcttatgtaagggtgacagtttttgtgtttgctgtaaaa

SEQ ID NO: 66327 - DNA, 1021 bp, Homo sapiens
atgccacagaaatccctggtgtggtttaggggccatccctgtgtactcccataatatctgtctcagccctcactacactgtattgcagtggtctgctttccttctctctctcctccactaaggtccttatcctatatgtctttttaaccatgctgcctgcactacccaacaatagtttattgactgaatgaacagaacacagttctttcttcagcatgctactttccttcttatgaacaatgaagtatcaagcctgtgtatatagtgggcgtaacttgtctgtgtgatggggttggttctctaaaactaatgtagagtttctctttcaactttttatcataatggagtattggagagtgattagtatagatttaaaagcttttgttatttttctgtataacataattgatccagcttaacattgtatcctctgaccttttagagctcaagtggagaaaacaaaagaaaacgaaaacgcgtactaaaatctaaaacttacctggatggggaaggctgcataggtaagacaaatatttggctccaaatccagagatagaatctcttattaccacagaggcaccataatcccttttagaacaggtacatctcaaactttaatttacatgtgaatcatgcccaagtggtactgatgctgtttgtctatggcatacactttgtgtagcagagtgtaagtcagaacacctaggttcttgtttaggtcatagactataaaaataagcactgagatcttggctaaaagttatgtcgtccctggtgaagagtttcttatctatggaatatctattttgcctaaatgtgcagttatgaagattcaggtggcataaatatatccaaaaacaagatggaaaccacagtatgggcttaagatgttatcatagacattgagaagcttttttttttctagaatatttgtttttataaatttgaacagtggaaaagaagctacagatgattagactgtaatcaagagtcatctttggtatttggttccatttgttct

SEQ ID NO: 66328 - DNA, 1033 bp, Homo sapiens
ccctgttactgatttttttttttcctagttcagacttgttttgaaaagattggctctgaagaatcaacctttccaggttcttaaaactagtgaagacattttgtcatctgtgctccctgtcccactattccccacctcccagtcctctgaaaaggcctctgccattttaattgtaacatgtgattggggagtaaaattctttacgtgtggaaattctgtcttttcagtgccaaatttcttgtgaacctgtgaattctggactttgaatgggtttttttttttctttttcttccttttttttttttttttggctttcagtcttttaatagttgccattttcaagcctcttggtttggccatgggtgataatatatgtgtttactgttgaatttcttaattcaacagtgcattttttaaatttaagaggacaaaaacattggtgccagttttttcctcctctttctgccccaaaagaaaaaagtcaaacgtctttgtgagagtgagagttcattgggaatttgtgggtaattatttattgctttgtttaaaatatagtactcgagttttggccaggtgtgtgatgtggacttttttgcactcctgtctccagacaggactgttaagagccttggatgcagcagtgaaaactgtgctcacattgcacttttttttttttttttaaaggtttttggtccaagctcaacctaatgaatcttggctttggttaccaacaaaggagttctgctttcctctctctgctcagactgttccaaatgtaccagcatagggggcttgccctgtcctgtgctggatcagatttgttctatgggtttagaaagctcatctttctctctttgtgactttgcagcagaaattgggtagttgggcccctgagataagtttggagtagacttctggacaagggaatgggtttctaagagcaaagcagttaagtggaaaagaaatctgatgttacccacgaaaaccaggtttgtttgcctttttttaatggcaacccagaaaagtggcatgt

SEQ ID NO: 66329 - DNA, 1049 bp, Homo sapiens
gccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttg

SEQ ID NO: 66330 - DNA, 1088 bp, Homo sapiens
gagccacgatataaatcatgacaatttggcttcattgccctcagtcttaaccactgtgctatattgcctcttggctatgtattagttcatacttccataccgcccagtgatgattgatgttttttttttttttttaagacagagtctcgctctgtcacccaggctggagtgcagaggcacaatctcggctcactgcaacctgtgctttctaggttcaagcgattctctgcaacctccgcttcccaggttcaagcgattctcctgcctcagcctcccgagtagctgggactacaggcgcatgccaccacacctggctaatttttgtatttttagtagagacggggtttcaccacgttggccaggctggtctcaaactcctgacctcaggtgatctgcctgcctcggcctcccaaagagctgggattacaggtgtgagccaccgcgcccggcctgattttcatttttataagtgaaagtgcagctggttgttgagatccaagattgtcagatttgaaggcaatcttaatgcttattcaaatcaacctcttatctgatgtctgcatcttctctgcagcatccctgccaagtggtctggaatctataaacaaagattcaattatgttcagtataccatacttaactaaattacaaagttagataagtaggctaataaatgttaagaatttaaagagaggctggactaaaattaagttttctgattaattttagatcaccaggaaacttccaaatagagcatactgctgtaagcagtccatttaattgctttcagtttaagtcgagaacattgttttccttgaaaaagcttgtctgattcttggccttgcctctgacttaacatttataagaaaatcaagaggacatttggcatttgtgccctgtttaagctatgctacaggttcataggttgaaaagtggtcctggggtgcttgcaagtgggttaggccagggtggtgttctccactttgaatgtcagagccttgttttcctaggatacttggtttcaagcttataaggtatgtgaagattacataaacatagcataatgacggtacagtgcagtggtcccc

SEQ ID NO: 66331 - DNA, 1061 bp, Homo sapiens
acaaacaaacttgctcccctctgagacataagctctgctctgggctctggcacccggtgggagaggcctcttaaggaaatcagaagaaaagcctcagctcctcagtggctgagctgtgcaacccggagaaaggaactgcatttctctgaacctgacttttccctctggcacatgacagacatacaggaacatagaagggcctctagggagagaactatcaaaccaggaaaggcagctctgttacctgttaaagggcaggaaacagggtggggactgttcacatttttttctgccttggacatatatgcttagattcatagaatcgtagaaagctagggactcagagacatccagtcccctgtttcctttgtgggaaattgagtcccagagagagatcaggacttgactaagcttgattcactccagcacaatcttcaatgccagtcgtcagatgtggagagaatgcttacagggacacccatcccctactaggcaggactagaagaaatggccttaatttgtaaacagaaggcttctggcgagacacaaaaaagaactcctgagtacaagaatgaggatggggtcctggacagaggaagggggacgcctgaaatgatctctgtactacacctcccaggggcaccgctgtcatgccagtccttttctttgagaatatgaaggattcaaggtccctctcccagagtccggcgccatggttggcggctgggggaacttgagaggccagtcctggaacaggtgcaacagctggagcaactgcgcagctgttgccgggctcaggctcagcagcctgtgcgccagtgagtgaggcagagacctctgctggtgggagaggagaggtgcagaacggcccagtcagagatccagagagaagtcagcctggagccggacttcaggccttcacttaggtgctccccactgcctcatgcacacctgcacaggtagatggggatgcgactaagctggacagacaagcaggtcccctctggccggtctcccactaccttcactgccccaggccatccaggcacttttttctggtg

SEQ ID NO: 66332 - DNA, 1314 bp, Homo sapiens
ttccttctgggcctcaatctcctcatttttaaaacaagagtattgaaggcttggtgctgtggctcacgcctgtaatcccagcactctgggaggccgaggcaggcagatcacgaggtcaggagaccaagaccatcctggctaacacggtgaaaccccgtctctactaaaaatacaaaaaattagccgggcgtggtggcgggcgcctgtagtcctagctactcgggaggctgaggcaggagaatggcgtgaacccgggaggcggaggttgcagtaagccgagatggcaccactgctctccagcctgggcgacagagcaagactccatctcgaaaaaaaaaaagagtattgaaagtcatcagttctcgccctttccctcctgccgccgagtcgcgcggaggcggaggcttgggtgcgttcaagattcaggttcacccgtaacccactgccatggccgaggaaggcattgctgctggaggtgtaatggaggttaatactgctttacaagaggtgctgaagaccgccctcatccacgatggcctagcacgtggaattcgcgaagctgccaaagtcttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctctgtaaaattgacagagaggggaaaccccataaagtggttggttacagttgtgtagtagttaaggactatggcaaggagtctcaggccaaggatgtcatcgaagagtatttcaaatgcaagaaatgaagaaataaatctttggctcacaaaaaaaaaaaaaaaaaaaaaaaagaaagtcatcagttctcaacctgggacacacctcagaaacacctgtatatatcaaggtcccacctcagatctagtgaacccagaaacccaggtgggggataccaggctgtgtatttttttttttagtgccataagaattctaatgaatactcctaggtaagaccactacaatagataaattcaaaggaccattccagcactaacattgtagaagtccaacttccaatttccagcctcttctctcctctatgccattgctgagtaatcttactaaaagcaatagtggtgacagagagcaaggcacacctaagaaatctggagagccactcactatgtgggaagctaataacaatgaggatgattctaaagtttcaagcctagcagcctgggattgtgatgaaaattgaaaactgacaaaaatgc

SEQ ID NO: 66333 - DNA, 1095 bp, Homo sapiens
gcttgaaactttagaatcatcctcattgttattagcttcccacatagtgagtggctctccagatttcttaggtgtgccttgctctctgtcaccactattgcttttagtaagattactcagcaatggcatagaggagagaagaggctggaaattggaagttggacttctacaatgttagtgctggaatggtcctttgaatttatctattgtagtggtcttacctaggagtattcattagaattcttatggcactaaaaaaaaaaatacacagcctggtatcccccacctgggtttctgggttcactagatctgaggtgggaccttgatatatacaggtgtttctgaggtgtgtcccaggttgagaactgatgactttcttttttttttttttttttttttttgtgagccaaagatttatttcttcatttcttgcatttgaaatactcttcgatgacatccttggcctgagactccttgccatagtccttaactactacacaactgtaaccaaccactttatggggtttcccctctctgtcaattttacagaggcctacccattctcctagtttcttgttgtcatcaaccttaattaggttgatttggtgttcagcacaaagggcctccaccaacttgacatacataggctcatcacagttggatgcaagcacacaaagatgggcttggcgcttgtctaagactttggcagcttcgcgaattccacgtgctaggccatcgtggatgagggcggtcttcagcacctcttgtaaagcagtattaacctccattacacctccagcagcaatgccttcctcggccatggcagtgggttacgggtgaacctgaatcttgaacgcacccaagcctccgcctccgcgcgactcggcggcaggagggaaagggcgagaactgatgactttcaatactctttttttttttcgagatggagtcttgctctgtcgcccaggctggagagcagtggtgccatctcggcttactgcaacctccgcctcccgggttcacgccattctcctgcctcagcctcccgagtagctaggactacaggcgcccgccaccacgcccggctaatttttt

SEQ ID NO: 66334 - DNA, 1627 bp, Homo sapiens
ccgactcagaggtgctgggcgagtgcgcccgccgcagccaacccgagcgctgccgcccgcgccgggacgggggcgcggctgccgcggggcccaggccagagcaggagccgcgtgccgcgcctgcggagccaggtggagcttccccacttccccttagggtctggagcgaggccgagcgcgccccggcccggcctggtgagggggtggagagtcccgggccctactcgggcgggtgtggagagttctcgtgggattagaacccgggctctacccaggtgcagtgtgtttgtgaattttgaacttcagagtgaaggacaggcacgttgcatgcggaggggcggtgagggcaccctgtgccttacgtaagtccgaagtttggagggaaacagaattgttggaacaagttaggggcaggttggaattggtgtgtgggagtgggaggggccttggatcagagaagtgcttggtttaatgttggatgaagagtttgggggtcatattgcttggagagatgtggctcctggccttgaaagggtcagtgaagggtgtggagaatccggagtttagggaacaggttgaatttgaggatgtgaagggagcttttcagactcgagagcagagggggttgggagcacacttgtgcagttgttttcatacattttggaaaatgtatgcttagcacagaacttggcacatagtgaggaagcagtaagtgactgtcgtttatatttgtaatactagtactactaagtccagtagtgcctgacagaaaagctggcttgggtttaaaagttttggaaacaaaggttgggtggcaggggctgcttctatctccttggcagtatgggtttcctactggcttgctggcaattaaaagtctgttgtaggactcttgccttgaacttctttcccctaacaccagcagcctgctattcctcggttctgagctttgaaatgcaaagtgccctgtataaaataagactgttataacttaggattcttttggggacacacccagtcaacataacatctgcagctctgtttgataaaaaatgcttacctagaatgagattttcaagaaacataaatcacgaaaggccagatatttgtaccttctgttttgggaattctgccatgtgtttttttgggtaaggaaagagaggcattgcttgtgtatacaagtgcagcttctagaaaccacaggttctagaatgcactctgttttgattcaagccgccagagacacctgtcactgtcctaggatattgggctattttattcctggggttgagggggacctgcatcttactttctatgttccttgtcactcccctcacctttttttttttttttttttttttttttgagatggagtctcgcactgtcgcccgggctggagtgtaatggtgcgatctccactcactgcagcctctgtgcaccaccccttcaggttcaagcgattctcctgccgcagcctcccgagtagctgggattacaggcgcccaccaccacgcccggcttttttgtatttttagtacagatgaggtttcactgtgttggccaggctggtcttgaactcctgaccttgtgatccgcccgccttggcctcccaaggtttttttttttt

SEQ ID NO: 66335 - DNA, 2189 bp, Homo sapiens
aacagcaacaggattactaggttggcacaaaagtaattatggtttttgccataactttcaatggcaaaaacagcaattacttttgtaccagcctaatagcaattttagtaatattcagagatatattgcttagttgtattctcatcacatagttggatcaattgataaaggaaacatcaggcctgctggaaatgaaattttgtagtaaatgcactggtatttaagtgacgttcttaattttttttttattttgttgaagtccagtgcctctttaggaattgctttgtggaaaaagtgtaaagagtttgtgttttcttgaaaattttggttgcactggtgacatttttgttctttgcctgcttttttggcaagctttaaggttcagaaccttaatgacccctgtgtacatgttttatttaattcttttatgcattcacggtttgcttttggatatagtatcagtttttgttgatttgtgaaactgtgtgtgtaaaggctacatcagtgatcatttcaaaatgaactcagagttcaacttcatattctttgaggatctgcaactcgtatatattgacatattaaatatttggaccattttgagcaatattcaggaattatgtaatatgtgtctactctgtgccaggtctttgggaaacattagtgaatgaaatattaaagatctctctctctcatggagcttatattctaaatttagagacattccttatctgttgatttaaaaaacatacttaccatacaggcttacataggtagattttgaactatacattgcagccacacttaagcatcatttaaaaatgattaatgaattttaagaattcatttagtctgtttgaaatcaaggatggttattccaaatcatactgcttttagatttgaaaccgagacctttttactttttaggattctttttcttcggctatgggtaatgactgaagaaaagctagacaaaggctggtgaatcttttaaattggcagtttaaatttttttatcttcgtggtgttaaaagtgcttttcagaaattgaatagataggccaggcgcggtggctcacatctgtaatcccagcactttgagaagcagaggtgggcggatcagttgtggccaggagtttgagaccagcctggccaacatggggaaaccctgtctttactaaaaacacaagaattagccggacgtggtggtgcacgcttatagtcccagctaccgggaggctgaggcaggagattcgcttcaacccgggaggtagaggttgcagtgagccgagattgcgccactgcactccagtctgggcgacagagcgagactctctctgaaaaacaaataaacaaaacacgaaaattgaatagataaacaattgaatagtgccttacttatcccttctcatcccatctcaacttccctgttcacttagggttaacatttctgcatttaaaaaatttcccctttctgtgaaaagcaagtagttctggtttattactcagttgacagacaatgtttgctatgtgtgcagcctaaattacatttaggactaatgaataatgaaaccatgtgattgtagtgcaagaggacaggaattccctagtctgtaaggatttgtttaaaatatgtaaaatgactcatttctttatccttaatgacacatatccgagaatttgagagtgtccttatgtgttataccaatacaggaaacatttgccttgtgctaagatgttttttaaagctcttgatgagattacatgcactctaccaactaaacagtaattactattgaagaatagctccaatgtatgaattcagaattgaacagcaggaatttaggaggtatttgtttattcatattttcactccctgtcttctagttaatcctgaaagagttgcctaccttgaattaatttgtatctgagttggcttgagtatatgatgtaggatatgtttgttaaatttcattccactaattcagtgagcattttgaggggcacacattgtgcaagatgatgcaataaaaaaagatgaataagacatggtaccttttctttaagactccacagtgtggttggggaaacacatactcaaataacaatacaacgtgttaagtgaggtaaacagacaatgctaacagagtagaggaatgggctgactgacaatttgcaggaagcctgaggaag

SEQ ID NO: 66336 - DNA, 1046 bp, Homo sapiens
ccatttatataagtaaaagtacggaagataggagtcatttcaatagcttgagtgagaaatgaagaaacaatcagccaatgtagactctactctccttgtaccccccaacaaggtctccctctgacatccaggctggagttcagtgatgaaatcatggcacattacagcctctacttttcaggctgaagcgatcctcccacctccaaagtaactgggactacaggcatgtgccaccgtgcccaactaattttttgtatttttagtactatacagggtctcaccatgttgcccaggttggtcttgaactcctgggttcaagcaatcctcctgcctcagtctctcaaagtgctgggattacaggtgtgagccaccatacctggctttagactactgtttcacagtttgataatgaaaggaaggaaatagagtgcatgaaaaagggaaagtacaattgtaagaaccaagagcagaacagattttactcagaatttgagttcagggtactcttggagagcccattcctgggccttgggcagaacttgagagtctaagcgatagccatcgtatttcttttttgatgtatactgcaggaacagtaagctgccagtttgcttataaattgccactagcttttcaaggggctggaaatatttatctcatcttggtagaaagcaggttatggatataagaattataattcataggagaaggtagaggccaggcttagtattactgaggccatttgttcattttagctgtagatatgaaagatatcccccaaactgttaaattgtggggatacatggttactgacatctaaacatatctaccagtagctcgctatttttttcaaaataatggctcgcagttcctccatgaataatgtacatgagtatgtttatttcctgtgttacacagtacttggcatacgtttagcctcttggctagtgtgttttcattagataaatgactaggaagaacagaattctataataaatgaattaaatcagtatgttttcaccttacagttgcaggtttctcttacc

SEQ ID NO: 66337 - DNA, 2188 bp, Homo sapiens
tgtaaaaagtaaatactacaaccacacagggttattataaggcttaaataagaatatgtgtggaaacccctagcacagtacttggcacttaatccttcagtaaatgttaatttactactagggatgctggtttttttttttttttttttttacttttatgtattgagctgtgctgggccctatactgtaaagctcttttttaccctgtgagttgcatagccaactgcctggtttaaattctgctccctcagttacttagctatttttgaccttgagtagagcgtttagcttttctgagcctcagcttccatatttgtaagtggagataataatggtaacagcctcaaaggattgttgtaaggtttaaataggataatcaatattgtttcatagtgatatttaaacagtaaaatcagattaatgggataagattagcatttttttaaaggaatagaatagatactagcataatgaaccatttgtttcagttttacatgtgtttgatcatgaactggggagtgatgtaaaatgtatttcttactgtggattgtactaaaagttccaaagctattggctaggtactaatagtccatagtatgtcatcaataaatgttagtgacaatagaaatatttaatccgtaatggagatgtactgtcaaaatagatatatattggtttaggaatccagtcatacaaatattttatcacatttgctagtgaaaaagtacttgtattttgtactttctaagaacttaaactgagcttttggtgactaggagatttgtcctgaaatgccgagacctggggtagcatttggggaggattacgatttgctgagacctggggtaggattggcctggatttccatggtgctgcaatatctggcatatagtaggttcataaatatttgtgcgataaatgactttattgtagcctcaattcagaatttctcaactagtcaatctttaacaccaatctgatcaattcatggactgagatttactgttctgttgcatttctttctctaatacctctttaaagcctcttatatgtgtttatcagcttagatgacttgattatagcatttaggataatataaaataagatgataattgtataagctaaatacgaatgaaaggagggagaaagatggtcatttgtgcaaatgtaccaccaggccagttttctttttgagcttgcctggatgtttcacctactgaatcccaggcacaacaatattcttacatgtttatttttctgatgaggtcagaagggttgtaaaatgcctgcaggatagatgaaatttttcactaaatacttcagtgtgaaaacattttgcatcataaatagtattctggaaaggagacaggattggaagttagtggatctgagtttgcatactggtattctactacttagtagctgtgtggctttgggcaagcatcttaaactctgtgcctaaatttcttcttttttagtatgaggataataggagctattttgcagagttgtgaggattaaatgaaatgatatgtgtaaactgcttatagaaagtaaatacctaataaatattagctgttattatatgcagtcattcattttgtaccccctcatggagcacataccacatatttgtgccaagcactctgccaggtgctagggatacaaagatgagtaagacacaaacctttgtgaaataatgttaagctaaagctgtccaggtgcagtcgctcatgcctgtaatcccagcactttgggaggccgaggcaggcagatcacttgaggccaggagttcgagaccagcctggccaacatggtgaaaccctgtctctgctaaaaacacacacacacaaattagccaggcatggtggcacatgcctgtaatcccggctgctcaggaggctgaggcagcaggatcgcttgaacccaggaggttgaggctgcagtgagccgagatgacactactgcagtccagcctggatgacagagtgagaccctgtttcaaaaaaaaaaaacccaaaaaaacaagaaacaaacaaaaaaaaacctgaagctgagccagtttatcccagattgataacttaaataaggctagtattagatattttaattttaaagttccctagtttttaggctaagtaaagattctgtttgtatatcagattcaacttacccattgaactctttt

SEQ ID NO: 66338 - DNA, 1692 bp, Homo sapiens
tgcaacctcaaaagattggactctattaaagttgatgataatgagactttgactttaataaattcacctttgccttaattataaagaaaaactttacaaaattcagctaccttcagaaaacgaattctttaaaagaccatagtgcaaaatgatgctgtcatgaatctcattggttcattcagccaaaaaaaaaaaaaaaaaaaaaaatttaagccattgtttgacactgagacacatacctagagatcatccctaacttcaagttaggaagtcagaggcaaagtaaagtaattataacacaagtagtaaatgttactgcaattgagataagtgcagaatgccatgagggcctacaggaagctaatgtaattctctctgggttagtgggaaaactgcaaaggagagagcagtgaacagggttttgaagtatgaatagcaaatcatagtgaaaggggaagaaaatcattctgggaggaggaagtggcatatataaagtcctagtggaggcaggatatggcatatctaggaatagggagatgtgtaagggctggggagaaaaggattattgaaggaatagtagaagattggctgaagtggcagattgggtcctgtttacaaatcttggaggcagtgggaagccaataaaagttattaagtggaagggtggtagggtcagttctcttcataaagaaagggaagcaatgttaaagatagatggaaagacagagtctaagagacagggaggccagttacttatcattgaatgcccacaatctataccaagtaggtattggaggattaggtgagataaacaactgtgttgaggtaagtgctactcccattttatgaatgaagaaacaggcttagcaaagataaatactggtaggcacatagtcactaggtgactgcaggtctgtctggttccaaatcctgcattctttttaattctggtatcattctaccttgtggactaacaggaataattctttgcctcaagcagggcaaaacttaattccaaaggattttgtatcatggtggtggtagatgtggtagtgaggacaaccacatgggcttggtctgcctaggataaaaggccataaggtccaaagccttcatcttagcagcattcccatgtctgtgtttgattctgtgacctcctttatcatgtgcctcttgctgctttgactgtgctgatccagtgcggattacctaacaacaaagccttgttgttggggccatttctggattcaacaagaaaccttattcactttgactctactcttatacctgcttttgcaaatcctgttggtctcggttgtcttaaatttttttttttttgagacagggtcttgctcttttgcccaggttggagtgcagtggcacaatcaaggctcactgcagccttgaccttccgccttagcctcctgagtagctgggactacaaatatgcaccaccatgcttggccaatttttaattttttgtgcagatggagtctcattatgttgtctgggctggtctcaaacggctagtctaagagatcctcctgccttggcctcccaaagtgatgggattacaggcaggagctaccacgtccagcctcaactgtcttaatttgtctttctcactaatccagagattagcaaactacggtcagcaggccagatgcagcttcatctcatcttgtgaaagca

SEQ ID NO: 66339 - DNA, 1430 bp, Homo sapiens
cggctggtggagagttaagtgtggaaagtgagggcatttcaggcagaggcatagaggcagaaatagcatggtttagggcaagaatcatagttgttgatggaatgtaaaataggcagggcatgaagtggtatgaagatgaagaggtaggcagatccacgtcatatagatcggggtccccaacccctgggctgcggactggtaccagtccatggcctattaggaacacggccacacagcaaatgagtggcagcattagattctcataggagcatgaaccctattgtgaactgtgcatgcaagggatctaggtaggctgtgctgtcctatgacaagctaatacctgatgatctgaggtggaacagtttcatctcaaccatctgctccccccgcaacccctacaccagtcagtggaaaaactgtcttccagaaaactggtcccttgtgccagaaaggctggggaccactgatatggatggccccttatggcatgttgaaatataagtggtatagcatcaactcttctgattacagaaaattgtctctgtgtatttaaagaaaacacattagtcctcagttaaccattttataacatattagtataactatattatatataactatatatttgtgtagtgctaaataatttggcaaacagcagtttacaagcttttgaattcatcattaatttaatcttgtctatagttctgatatatggttgtattattaccaagttacacatgaggaaattcatgtgcaaagaggttttttttttttttttttaatttgttcaaagacaaatagctagtaagtgggactattcaaatgagtgtcttggtcttgggactcagtaagtccaaaattctttttcattctgctgcactcatagaaaatgaatgtacaggggtaaaaactcacgcatactcaggtaccaagggatgctttcctttggatttgagtttttgggatagcatcttcccatcacagttgagtgaggttcttttttaaattttgcattgagtgtggatgctttggcaatgacacttcattcctgatggtttaatgcaattagcaacatgcctatcttgtagtttgttttgtttttttttttgcctttattaataagcaatcactctggctgagagaaaatcctttttcaggaaggatcttcagggaactatagctgttcctgtaattcacataagattcattttaggtcactggccacaggtgcatgtcattcttaaggcatcatatccttagagcgttgctcttcctgttaagtatagtaatagtcaaaggataggcattaagaaagtacttcaaccattagattcatttatgaatgctaagatattcagtatctcagtgacacctgaagtagtttccagcatttctgttctgtgaggtgaaggaagggtgagttattgctt

SEQ ID NO: 66340 - DNA, 1138 bp, Homo sapiens
actgaaaggttcataataactgtcttggcataattgatactgttgaatgcatacatgttctccattcatctttaagagatgttatgagactttgatttaaaagggggagatcttcatttttctggccttttcctggttcctttctcataatagtccaggtagattgaaacaccacatttcacaaggcttcaaataaattattttgatgttatacatactcttaatattaagtttgaaatcctaatagcattttacctataatattatactttaatggagatttaaaaaatttagagaaacatattgagtaggaaataaaagtgaaatcaaagtattgttactgaatcactaactttagaagttatctgatgtgttgccttcatttctgagattgaaactatgatctaaagagattttcagttcatgacatgtgttgtatgtgtgtgttgggaggtctccaagaccacccacaggttcactgatttgctagggggacttaaaggactcaatacgtagttgtattctgtgctgtgatttattacagtgaaaagacaccgagcaaaatcagtagagggagaaggtgtgtgggacaaagtctggggaaaacccatcacaagcttctgaagtcctctctcagtggaggcacacaaggtgtgcttaataccctagcgaggagttgtgacaacgtatgaaatgttctcaaccagggaaactcgttagagacttagtgattggggtttatattagctgatcacataggcaccctctacctagcatgtgctagaatttcagattccccgcaggaaagcagatgtttggcataattatattgtttctgtagtttaggtacagtgaacaactcatcagttaaggagggtgggaaccctcctaacatccaagtttctaggcaccagccaagggcaagccttggaagcaggcctttttaaggatagacatcttctcccactgatgtgttagaaagaaagaaaaggatagacaggcctgctgtgtcaactctttgctgtgtatgtgtacgtgtacatgtgtgcacttgtgcatatgcatgcatgcaacatttagcatagagtgtgcttttcattaaacgttagctgtttttacttatttattatggggattc

SEQ ID NO: 66341 - DNA, 1051 bp, Homo sapiens
aggaaatgcatatgcatttcatatcaaaggaaatgcaaattactcttaaccatataaaaacactcaatttcactcataaaatataagcatataaaatgcaaaatttcatctgttagattagcaaagcgaaaaggtttcagcactcatggtgttggaaaagatgtgagtagatcggcttcttgggaggcttaaggcagagggatctcttgaggctgggagtttgaggccataggtcactatgattatgcctgtgaatagccactgcactccctcctgggcaacactgtgagacctcatctctaaaaaaagtgaaaaagaggtgtgaggaaatggcactcccatgcattgctggcgggactataaattgatataggcttcatgacagaggggcaatttggtgttcctctcaaaaagcatgtatcctttgacccaggggttctgattctagcaatttatcctatgggtacatctgcagacatgtaaaatgatatatatgcaagatattcattacagcattctttcaatagtctctggagatttaaactcaccttgttgcctgtatttagaactttttattcttaatataattttatcttctctcttttttttcttaatcagttttactagagactgatttattggttatttcaaggtaccatgtaaaaaattgaatcagctagggttgttagttgcaatcgacagaaatctactctggcaaatttaatcagaaaaggaatttattgaaaaagaatattagcccaaaattaccaccttggtaggtagaaaactaggcttggaaaatggcatccaggatcaaagagcaaagtctgtgtaatacaaattctttgaaattttttgaagcatctttatgacctaatgtatcatcaatattttaaattgtttgccttaagagatatgtattctattcattgggggtttatatatacataaacataaacacacacacacacacacacacgaccacattaattttattgttcaatttttctgtatttttgccaccttttggtctgcccgatccattttgttt

SEQ ID NO: 66342 - DNA, 1063 bp, Homo sapiens
ctgttttctatatttgccttaggtccagtgtttctatctaaatatcttctaccttactcagtatattaattaagagtctttctaaaatagttgattcctctgtgagggaaatgcagggaaaaaaataagatagttgagacaactgaaaaaggacaaaaggcaactttttggggagactattttctataacaagcatttatcaacctcagtgggatgtagatttattagtaagtcttaaaaattaatatatatttagaccaccaaatatacattgagggtataaagaagtgtcagaaggagacagaagtgtatactttcctctacctttttgatagtatttaagacttagcgtttattctgttcttagctttgatttttatcatctatttatataacccacatgtattgtgcctcctgtgggtcttcctagaaagtcatcttaaaaagtattttcttttccctttctttcagactttatattcagagcaccaatcaaattaagcaagcctggggaacttcgtgaggaatatgaaagcttgagaaaggtatagtattatcatgtcattcattttcttaaagtagattgaaataatgacattaaagaatgcttagtgggagttttgaccaggttttaaaaaatttataatgcagagcctttcttcacactgccttataccagcctagttagatttggagctataatggcagcagagcaaaccttaacccaagattccctttttagttgtcttttcaaagatgaagacgtagttcacagagcctgtcacatgccagctgcagtaactggccaccagagaagtattcttggtacttttaacaggtgcccttgctaataattgcttgtattatttttctttatctcacaagtttcttctaattacatgtagctggtgttatccattattgctcactccattaaatactccaaaagaactgtcttgtaggtcagtaaggagatagtgaaataatttcctagttagaaaacaattaccattgggaaagcttttatctgtgtccatatcatcttatttatgatgttttcaaa

SEQ ID NO: 66343 - DNA, 1753 bp, Homo sapiens
agtacttgatgtctgtcacccacacctattcacacactccctccccttttgaaaatctctaataaaaacttgctggtttttgcggcttgggcatcacggaacctactgacatgtgatgtttcccctggatgcccatctttaaaatttctctcttttgtactctgtccctttatttctcaagctggccgatgcttaaggaaaatggaaaagaacctacatgaatatcgggacagattccctgatagtagtgagacctcgtcactacaaaaaattttttaaaaaattagccgggcatggtcgtgcatgcttgtggtttcagctactcaggaggctgagctggggagattgcttgagcctggaaggttgaggctgcagtgagtcgtgattgcatccctgccctcccaccttagcaacagagcaagaccccgtctcaaaaaaagaaaaaaaaaaaaagatttccagtggttttttttttttgctacactattgctattttttcttctttcttttgaaatgttatataattgaagaaatgcccacttttagcatgtgctagcatatctctttctagaaccagaaaataagtatagaatctcatagtatatctttaagatatacaggtaacaggtgtggtattaaggagaaggaaaaattctcaatagaatgtttaaattttaactacatgagggaagaacagttaatttataggatgttcagaatccaagaacattagatatggttgttgtctccttttgctatttataactacccagatgtggagaaacagttttatcaaataatgtgcttttcaaagaaaagaacacacttggagcattcaaaacacgatcaaattcaattagaatagcaggttactcaggttatttctgcagtgtgctgtttttcctcgtcttattgtttagggtcaggatcagtagttataaggttactatattagtataattatttttatggtttaagtattaataaaatcacttaactactacttggaagccaaattaaggaattttccagaagctgttacaactgttgtctctagtataaaataaaatattttgttaaaatatgtaatgagtgaagcttttaataaattagaatagctttatttttttctgcttatgaacataagcagaattgtgcatttctgttaattgggaaaaaaccttcaggttatcaaaaagttttaaagcagaaagggaaaatcgccagtaatcctgccacttaataaacatgtttaaatgtttatcaaaaatttaagcttaagactttttaaaaaatagattttagatcacattatgcatgccacttttactgcccttttaaaatttagcatctcgtatgaagttttccatattaatatagatctatgtcaacatttttaatggctatatagaattatagaaaatattgtaatatatcacatatatgccaatattttccctaaatccaaaaccattcaagagtcagaaataacttttaaaaatataatatgtaaaaaagattccataagataaactgatttttaaaatacccatctctagccaaatttgtttaaaaactcacaagtaatctgctttcagtgatgattgttcctctaaaattgcaaacttggttatatttttccagattcaaatcagggtttaaggtcttatttgctgtttacatttgagagtaaacttttttgtttattgcagactttttaaaaaatgcaggtgttcaacaaatcataatacag

SEQ ID NO: 66344 - DNA, 2497 bp, Homo sapiens
gttcaggcttacaaaaatcagacctatagaaatcagaaacataaggctaaggctttgttgttgtttattgttgtggggtttttttttcctgtttttgtgtgtttgttttgttttgttttaaacctgaggcagcagcctatcaaaaatatccatttgttctttagcttaatttttttcttaagaataattaaaaatattagtagcctataattgctttgatatacatcatcttatttaaatgttattaaaactctagacagtgaaaaaggaaaaaaagtagaaatggaatcttgatgtactataggtacacagcaagactctgttaataaatactattatattgttatctcatttactcctgcaggttaagttgcactatccctcttttgaagacaagcaaatgatgcttcctttgctcacggtcaccaaggttttcattccaaagcccatgctattttgataatgccatgccacctccccaaaataaagagcatatctctctgccataaatttctttgtacagccaggttcagtggctcatgcctgtaatccagcacttagggaggcctaggcaggcggattgcttgagccctggagttcaagaccagcctgggcaacatagtgagaccccatctctactattataaaattagaacaaaatttctttgtagaccgtgtatcttgacttatcctgtaactgcaggataagagcataaaaatgtaggacattagaactgcgttaagtcactcttttgttgccaaggaggcctcgtccagcttctctggctttctgtggccatctctgctcttcttctagtccaatgcagttacatctggcttatgggaataaggaagattttcaggcttagccctttttggctatgtgactatactttattttttgataatgtgtattatcttagcttttatgatttcatattgcttaagaatgcagagcagttaaatctttagccctgaagagtatgtttggcaagagccaagtaaaagtagatttacttagaaatcaagagggctctatagctgataagaaaaacagtctcaaaactgccatgtgatctgtttgttctaataaactacagagtaaaatatgtttttaagtttagagttgcctaaaactactgtgtttgcataatttatatttttagctgagagaagaaaagttacaagaggaaaaaccctctgaagatcaaatccacaagctgttaccagaggatacagaaacagggaaaaggaaaatggatgaacagaaaaaaagagatgaaccattagtactgaaaacaaatctggaacgtgtaagtaaatcacctttttaatggatacctgcctcaaaaatcagtggttagcccaggtgacctggacctgaaagacctatgttggtaaattgtgagaccagtaacagtcagtgactgtgcagcttaagagtagtgaagaacttacgtccaggccagagcttgagaaaataatttttgaatgggatattaagacttgtgggaagattaaggaacagtgggaaaagcaggtgagtgagaggaaaaacctagtatagtttactacttgtgattagatttatatgtatgttgttatttggacttatgtgttatttgacatttaagatttgtacattgtcttctgtcctcaactagattttcttaaagcatgtattttactttcctttatttgttgtaataccctaagcagcacagtgtagatataaggtaggtttagatacttagtctatattcaattagacttctaattgggccaaatcctgcctgagtttgtttcattacttatttgccaagtaaattactagaaaaggttgcaagttgtgtatttaacttacataaggaagcacttttggaggatccactaattatacccaaatggataatcacaattgagttttatttctttagtaagtcatattggattggacatatattgcttatgtatgtacttagcacatctttagactcctatcttttaaaatattttgtgattcaggcttgttaaaatttcaggttgtctttctggtcagctggaatcgataaagctttaccatctataatgacaggcaagatagcagagtggaggcaaaaaaaaaaatctctggatcagcagtctacctcttatacaggtcccagcattgtaactgtttgtacacttcggccaagttacttaatttctttgtgcttctgggtttatttatttttatttttctggagcagggtcttgctttgttgcccaggctggagtgcaggggtgtgatcatggttcactgcagccttagcttcccaggctcaagcaatcctcctacctcagcctcccaagtatctgggactacaggcttgtgccactatacccagttgtattttttgtagagatagggttttaccattttgcccacactggtcttgaactcctgggttcaagtgatctgtccacctcggcctcccaaagtgctgggattacaggc

SEQ ID NO: 66345 - DNA, 1318 bp, Homo sapiens
ttactttttttattttgtagagatgagggtgtccctatgttgcccaggctggtctcaaactcctgggctcaagggatcctcccaccttagctttccaaagtgtgggattacaggcatgatcatgccagtgtgcctgggctgcttttatattttggaggacttttaaatggctctaatttaagagttttcagtgttgagcaaataattccatttagtttggccagactacattcaaattgagacccaaaagaatcttaagaaagctgaccaaaggattattttttatatagaaactattgtgattagagcgagactgatcatttcactctcctgtcccccaaattttaatgactcctcttttcttgtgaaattaaatgaagactcttcaccccaacatttaggccctcagtgtgattctagcttatgttttcatccttgcttataccccaaaactctaaggagtatatatttgctttcccccaaatacatacactgtgctttcccttttcaaggtctttgctcttgcaattttcatctcattgaaatgccatccagcttacctgttggaaggttatttatctctccatgtccagttcaaaagctatcacattcatgaagcctataggagttcctcttctgtttctccacttctatcagccactcccccaaacccccactttgtaacttttacaagagttctgtcattttcctttacatcatggttttttgtgtttgtgtttctctactagattgtaagtttgttgagtataggaaatgtcttatccatttaaatctcctgtagtaccctgcacattggaagtgtctgatacatgtttatgaaattaaatttgaatggaaggaggaaggagcttactctagaagcagattatcatctgttatttttttagaatagaaataaagtgagcacagtgtttaatttattacaatttgttatggtacatttaatccaataataatgcgaattattagaaaacaattggatacagcagttatggttatactaaagactagaaaacaaaaagggaaaaattacttgtcatcccacaacctagaaatgagccctataaacgttttgatacatatccttatagatatgtaccatatgaacatatagaacatatagatacattcatttctaagaacatataaatacacaccatatattgtttttcttttcagaaaatgtaacctagtatacatactgtttttcttttttgagacggagtctcgctctgtcgccaggctggagtggtacagtggcgtgatctcggcttactaccacctctgcctcccaggt

SEQ ID NO: 66346 - DNA, 1018 bp, Homo sapiens
caggacagtgataataaaagtagcactgagatcccactggaaacctgctgttcctcagaactcaaagggggaggcagtgggacttctttggagagggagcagtttgaggggttagggtcaactccagatgccaagttagacaaaacctgtataagcagagccatgaaaatcaccacagttaattcagtgctaccccaaaacagtgttttgggtggagtcctcaaaacaaagcaacaattgaagacattaaatcattttgatctgactaatggtgttctagttgagagcctaagtgaagagccacttccttctttgcgtcgaggccggaaaagacactgcaagaccaagcacttagaacaaaatggctcccttaaaaaactgcgacaaaccagtggggaggtgggtctggccccaacagacccagtcctgcgagagatggagcagaagcttcagcaagaggaagaagaccgacagttggctctgcagttgcagcgcatgttcgacaatgagaggcggactgtgagccggcgaaaaggaagtgtggatcagtatctcctacggtccagcaacatggccggggccaagtagcacctaatgaagtgttacctatttttaaaaggtcttaggccttgatcatttatcctgaagagctgagtgttctcactttggttttattttaatggcaaaacactgtctaatatggttctgagaggttccagggcctttgtagtcaatatccaagggaaaagcatctccgtttctctgtgacccaggccagaagcctgagtgacccatccctaagggcttctgggccaaacctggcagcacccactgggaatgagatttggaacggcctcaggagcataatggccacagttagtaatggtaaagaggggataccttcttaaactgatagacttcctgacttctttcagcagggtattgttttaaatcagccttgcagataaaaattaattccatctttttcagacaagtgaacaatttagttccttggcag

SEQ ID NO: 66347 - DNA, 1002 bp, Homo sapiens
taaacattgtggtcatcattgagataggtggaatctctttggtgactacgttggtggggaacatcactcacctgaatgtatgcattctgtgttctctgtgtgtgtgcacatatgcagatgtatgttttaaaaacatttaccaaactcatgattttgtagtcacaccacttcagttctgggccctaccaacaatttatgtcctccaagagctgctggagggcatgtttgtgcccaaaacagaagagctggctctggtttacagaagacagggagggtgaccttactataaatgcccttagaggaaacttatcagttactgccatttcacgcatttcctttttgatcttagtaaatattattggaaggctagtcttgttggtaggagcaaagacacttatttttccacttgccatctttctctatatctccagtaatttgaaaaacacttttcagttggaattgatttttgtctttggtaaaaagaaatatttttaatagataaaagatatatattttaaatatttccccaaattaatactttcattttaagaattgcatagcagttgtaacaagtgcagaatgaagaacaaattcttgttaagcaaatagtccaaactctaggtccagcttactgccttccccccttgtacctacagtgatgcctaggatggtattgacagttgttttctaaacttcctgctgagcaacagtccttcaaatataggtagagtggtctaggttaaggagggaggagggttgatctttaatcaggttggctttggaggaaggaaaaaccactaaggtattatctgaattttaagatgcttcccatccttaataactaaaacctgaatgcttttctttctgaaaaatctccctctctccttccatgattctgaagttggttaaaagtcgatatgttgatgtgtattatttgggggaacagaaaaggacaaggaaggaaacagaacgatgggaagggtttgtgagctagaataagag

SEQ ID NO: 66348 - DNA, 1033 bp, Homo sapiens
tgaggggaaatccaggaaatgtggtgcccttagaagggggctgtcagctcttttccatagagagggaaagaaactttgagaaaatgttcttgacccattgattgtatctgctggaagaagtcatctgggcctgttgggttggtatcagatcaggggattatgcatccagcccctggcccctttaatctatttgcctctttttaaaaaaggttaagtcttcttgggtgaggcttgccagggaaactcctaagtggcttcacttattttttaaattttaatttaatttttaaatttttgcttggaagcagcactggtaataaatgttttattttttgttcattttccctaaaggaaaaatgtccttaagagattaaagctcttaattgattactgtctggttacaaactggcaaactgactaaaatgggaagctgccaccgtgcctgactcatgtagctgatgaccgaaggctcatcctttcttttctatttgacagacatttactgagcttcagacttgagccaaccctgagctggactgtggagataaagcagttcctgctcttgaggagctcaatgtctaatggaatgcatttgaatgtatgtgtggctggagagttcatttatggtcttaggaaagccatttctggtcccatttagaaaactgaccagcacccagcaagctgcattctacattttagagaccccattggtatttgtgaatttgattgcaccaccgcttttcctttactaagtaatgttatggaaggagaatgaattttctcctctagtgattacaggacattaacatctcttcagaagctgcttttagcttaagccccaagaagtgaggtgggttgtggatcactgacatggtcaggggaggcccacacctcaattcagtaaccacctaatctctcccccaacctgatctctcatcagagctggcagcaacttgggattcctttcctttttcctgcctaacttttcattgaaatgtctagtaggagagtgagaaaagagaacaaaggctgg

SEQ ID NO: 66349 - DNA, 1036 bp, Homo sapiens
ggacaagctcctgcccactcctttggaaactccacacctgggccggagaaagactcgaattcgaaaactaagtttcagtcgcacctgcctccggcgtcgcttcagcctccgaggggtctgcggaggcgacgtcccagtcaggagggatgcgcgcctgcgagccccccggggatctcggagccgctccactgcggtgcctgccgctatcttccccacgccttagtaactgcgacgcgacggcagacagtgtaggcggcaaccgacggccgggacgtctaacctcaagtcccagcaagccccgcggccacgtcctctgactacctcgcgccagcaagacccaaactacggatcccgattgactccgcgcggcgcgtcacgctgtcagctccagccaatcggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcggtaatttgatttttcctatatttaatcgtgtccatctcttttctcctggggggctgggtgcactgttgtcagtgcccatttcacagacacggaaaaccgaagcccaaagattaaagaatcagtatcccccaaactctctaccaccatcacccttgcgtgctgctacagattccaaagtgcttcttgtccttttgcttactgaagtttttaggcgttttatcatgataggc

SEQ ID NO: 66350 - DNA, 1654 bp, Homo sapiens
tttggtagagacaaggtctcactgtgttgcccagactaatcgtgaactcctggcctcaagtgatctgcccacctcagcctcccaaagtactggaattacaggcatgagccaccgcacccagctctgttccctgtcctttggaatctactagaagtaaatgttctttgtaaagggctgtctgtggtaaaaaatagaatgacaaggtgatgagaaccccaacatgagtagcagaaatagataaaaggtctcacaaaagagtgcttggaagatttaaccaataagtgagggacagaagagaatagtcaagagctgcttgagtgccttttcttggaaaacttagtttcagccttacattgaactgttccctccctgaattcctctagcacttacactgcacatgggaattaagctgtcacttaatatgacatactgtcttgtattatttcaccaatttgtatttgcccgttttcctgtgagtgcttctctgtagtgatcaacacaagataagtacttttagcattgaatttcgcagagaaaaaacttgagatctgccacctcagtcttcagaaacagctttagaggatggtgcctctaattgtttgaagactgagggtactgtgggagagaacttggggaaaaaaatgttattctcagtggagcaggatctgaatgaatagagaggcttttgctgtgtgggaatgagaagctattacctttaatataatttttttttttttttgagacagagtctcgatttgtcgcaatctccactcactgcaacccccgcctcccaggttcaaacaattctcctgcctcagtctcccgagtagctgggattacaggcatgtgcctccatacccggctaatttttgtatatttagtagagacagggtttcaccatgttggccaggctggtctcaaactcctgacctcaggtgatccaacggcctcggcctcccaaagtgcggggtttacaagcgtgcgccaccacacccagcctaatataatttatttaatttgatgtgtcttgatttgggcggggagggtttttattttatttctgcagctgtagtttcacttgccataaagaagtgtaataaagagatgcaaatatgctcctagttttccctaagcagatgtgaatttctactcttatgaaactgactttaagaacacagcaattcttgtttcctgatcttaaaaataagtatgcaaatataatctttccgcctccatcacagaataacttgacttagatcattgcagtatgttattttgccccaaatacatcaaagcattttcttctgcctggcagttataaagaaaagctgcttgcttaatttgttttggctattaaagttgatatgtggtgttaaaccatgctttccagaagctattatctagacccttttagccttatacctggatttctgtctcctggctggcctgtcagcctgatcttaaagcacagctttaatctgtttacatcagactcctttgagaattagttaaaattaacagatttttggacctttttttaggcctgaatatctgcatttttcttcacatgtctctattacctctgcattttaacagttacctccaggttgagaactactggcttaaatgattttttaaagtctcttctggttct

SEQ ID NO: 66351 - DNA, 1029 bp, Homo sapiens
ggatttgttttatcagccagcttgtcagataccagccaagggccaaccttgcaaacaagccttgctaaagatggcagtcttggacccaggttcacttatttctgcacactgcccttctttttaatttatcctgtgaggtcccacataaaagaaactaatttttgctttctctttttattattacaaaaggaaagcaatttgcaattagtgttgaggaagacaaaattgaggcaaaaaaaaaaaaaagatagcttttaaaatacccgaattagtagtagagagaacatgaggagcagcatacattttagttgatgagcagtttttgagcatgatgagaagtaataatcagaaaaagaagcacctaatagcaactccccttcttccagatggttctccatactgtagtagagacattacttgcttcgaaatgggctgtgttgccgtaaagtcaaattataacctttcttgtgatttcatgtaattcactggaaatgtttcttttccacttactgaagattgcttctaggtaccaggcagtgaagttagagctgaggctatttcaatacattgtaatggctgcttctgcattttattctcccaaattggttaagacattatcctctgacttttaaaggcaagtttcttttctgtgatgcaatgcaggcagtgaagtgtggctaggtgtctgagaatatgattttcctgtttttgaatgacccataatttttaaatgactttattctgactttatttcacaaataattcaaatgctatggtggatttggctctacaagttggttcttttgcatgtcttcaaagagggatttacttgacagtgtaaatgagctatctagctagaaaacctgctaatttctttttggttcagtttgtatctttaaaattagatgtcgtgtttgatttgtaggctggcagtctatggcagtcaatagtgcagtatgctgccatgagtaattttctcaaagaaaaatttttgcttttacagggcaccaagggggaaaaaaaacttga

SEQ ID NO: 66352 - DNA, 1026 bp, Homo sapiens
tacagacaatgctgcagtgagtagccttgtatttcatttcacatgtattcagttatagaaacattcctggaagtgggaagttgaattcagggtgctaagttggcattcgtaggtgctgtaacattttgaacttctacatgagcagtgagagaattatttgcttctgaatagcagtgtttgggaaactttctaaacctctatagataagggaaatagaagtagagtttgtccactcaactcgtgttgggactgagtctgggacttggtttgtaatttaaaatgtagtgttgtttccaacaggctatcctggaattgctatcttaaagttaagacatgctggtaaaataataaaagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaa

SEQ ID NO: 66353 - DNA, 1068 bp, Homo sapiens
aaacattttagctgtgggaaaagttgaggagtttaaagttttttatatgagggattgatgaactttttctcttggttctttatagaaggcttgagttttacttgtttggtgtggtaaaatcccaactggagggaactacttggtaattcatatgattcttttatcatggaaatcaagaataaaagcacatactggggaggaagtattcctattagcttgattccttgtttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatt

SEQ ID NO: 66354 - DNA, 1019 bp, Homo sapiens
ttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatgactatcctcacagatttttaaatcctggtgttggatttgccctggcatgttgtcattatcaacagaagacttattatgtgcctactctatgtggatcatagggctagtcatataaaatgaagaaaggagtatggatgatctagaaggtttgtcctagccctatagttctgagattgcgttatcacagaaatgctctgaggataaactgtgggagaaggtactttttcctgtggccagttaacagagacgattaagcatacaaaagtataaaggccaaagatgtgagatcagttatctttgaagaattccattagcttctgtgtcttctatgatcctgtcttctctccacgaatacaatcaagaatatctggagcagtgcactgggcaactcaaaaaaagcacaatctagagtctgtttctgaccagtgtcaggtataactttgtgcagctgacacacatgtgttttgtaggtaccaagaactaggttcatgttccaattcagtttctttctagctgtataactttgggtaaatcatataaattatctgaggtttagtggggtcaaaaatgatgcctagagtttctgggaagatgaaataccaattataataatagcaaatgtttattgaacatttactgtatgttgggtattctgctaaatgcattatctcattaagttttagaacactcattttatagataagaatacaggcccaaagtttaaatcaactcttccagtatcatat

SEQ ID NO: 66355 - DNA, 1027 bp, Homo sapiens
aaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcata

SEQ ID NO: 66356 - DNA, 1050 bp, Homo sapiens
tcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatga

SEQ ID NO: 66357 - DNA, 1068 bp, Homo sapiens
ccccaggcaccatcccacagtactggcggtttctctgccaagtgtttggggcctgcactggccaagccatccgtcactgggactttgcagtgtgccctgtgggtggcgtgtggacaccggtccgggcaggaaggaaaagcatgccccggtgaaaacccaccgagcagagagccagcgggacctcctcagcattccacccaggggaagagttcagtccccatgaagataaggactgagttatttggctgcacctctcctcagcctcaaagctcagacctgctagagtgggttcacctggctgttggttctgtgggagagttcctgacaagctggttcctacatggtgcagtgaaaggaactctgtcctggaagtccccaatgccgcctctcagtcctgcctgtcaccaaccacctggggggcttgggcaagctactcaacctctggggctcaatttccctaactgtaaaatgggattgtaatcccttccctgcctgacgcaggaattgttatgaggcccagatgagatgaaagtcagcggtcagggctctgtaagttgaaaatggctggatgtgtgtggccctgccactgcagggatggcccaaggtcacacagaaagtttgctgcaggaggagccctccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttc

SEQ ID NO: 66358 - DNA, 1121 bp, Homo sapiens
atccggaaggttcagtatgccccagagaggcctggcccccagcccacagccgagaccaccaggcagttcctcatgtcggacaagcccttgcacctagaagcctctctggataaggaggtaggaggctcggacttggcagggggtgggggctgctccaccagggcctgggcctcagatcccagctctctcctggcctgcaaggatgcctcaggtaggagcttctatccccagcccaaggaccacaggggtcagggaatctgagacctctcatgggggatttggagaagcctcttgggcctaaaggagtggcaaagggggcatgaacttgagagatgtgatggacttccgaagtgaggagcagaccttcctgaaggtcctggacatctcccccacacctccaccagctgcctgcctcaggccgagtgctgaaggtcaaccagcattgcagagggggcacggtggggggccgtgaccttcctgccaaacactgagcgtcagggcgacaagccctgcagaaggaagggcctcccctcaaactctgaatcaaacccagctgactgctgtgagcttaggctggcccctcctcaaggtgtgggcaccccctctctctcggggcatggctgaagggaagtgccttggggcaagatgcaagttgaggtctttttgtagggattcagagctggctccctcagtgagctggtgagcccatcctcacctttccctgcttcttccagatccttctgtggacagaatttagagctggcagggacttcagacatcacctagtccaaccccttcgttgcacagagggagaccctgaggcttagataacctacccacggtcacactgctttcatcatcgtcaatgttattgttgttattgttgtcacaattactgctggccaagccagggctggagcccaggactatcaccttccaattccgttatctttcaagggtcccaccagggaactgaaggctaatgtgcttggtggctttcatgccaccttagcagcagtgggaagtggctgatgaacttggggcaaatgtcacaatgccttgggggattcggagaagcctcttgggcctaaaggagtggcagagggggcatgaacctgagg

SEQ ID NO: 66359 - DNA, 1119 bp, Homo sapiens
gatcgatgctaactaatagcagttccctggagctgccgtgagtaggaaagatgactgtggaagttgcttgggccgggctcagggctggcacccagggagggccagtgttgtcctcacagtgggactaaggaagggcctgctatcccctgtccctgatgctttattccactttagccaggagtgggtgctgataaagtttgatgatggggatggtgctatccatggccacgggggaagaggcttgctcagttactggcagagccaggtgtggatacccatctgggtcacatccagccagagctggagccatggcctgtcctgggatcctcttgtcagggatccccctgttgccccctgccatctctccagaggttgctggcctctgcccagacacacagctgacataaatatggcatggtggcttcagttcaatggagagcataaatggggagttggagtgggaccctgggcaggggagggtgtgagcaagactccctgtcagttctgctccagagggaagaccttccccgtgtgttagactgagctgaagtctgtcctgggagcttctggggagagggagcagatggggatcgtgccctctgggagctcctggtgtgatggaggaggcatggccctgtcctccaggacactcctgtctgatggggcaccatgacttctgtttcctgggactctctgtgtaacagaggggacacagtcctcttgttctgtaggagctgtgtgcctgaggaatgaagcatggcctccatcctgcaggagcctccaatctgatgggggatccatggccacttccctcagagagattccctatttgagagaggagccctgacctctgtcctcaggaaggacccctgtctgatggaggctcatcttgtcctctcactcaagaaaccccatttatggccttcacctttgaccccttcactttgaccccttccgctccctgattcatggggagctcaggtcccacaggcagcagctacggacggagatgggcacttataaacttggctgctgtggggcagggaggaagggaagacaggagactccttacaggagactgcaagaaggccctctgcagcaagtgagggtgacatagaa

SEQ ID NO: 66360 - DNA, 1017 bp, Homo sapiens
gagctgtccacaccaggtggccagcagttggcacagagcccagaatgtggtaacagatgcccagggaaggcatgacacttgggatgggtgaatggctggtgggagacaaggatgtaagaagggcactttcatttgggcggcaggggcttcagttcaagtcaccatctgtatcacaaatgaacctcaatgttgtcttctggggaatggggatgaacaactgtcctcattcacagggttttagggaggaggaacaggcagcaactgactattcacaatagccaaaaagtgggaacagacagcctaaatgcccatctgcagatgaatggataaacaaatggtggtatatccatgctgtacaacattattcacccatgagaaggaatgaaatactgatccatgctataaagtggacgaaccttgcaaaccttacgtgaaatgaaaaaagccagacacaagaggtcacctatagtatgagtcaacttgtatgaaatatccagaatagagaaatccatagagacagaaagcagacactggtagttgccaggggttggagagaggaaagaatggggagagactacatagtgagtaaggggttttactttggagtgatggaaatgcgttggatctagatagaagtggcggttttgcacaacgttgtgaatggactaaatgccactgaattgttcactttatgtatttattttatttttatttatttatttgtagagacagggtcttgctgcattgcccaggctgctgtcaaactcctgagctcacccaggcgcaatggctcatgcttgtaatcccagcactgggaggccaaggtgggcagatcacctgaggtcaggagttcgagaccagcctggccaacatggcgaaaccccgtctctactaaaattacaacaattagtatggtgtggtggtgaacgcctgtaatcccagctacttaggaggctgaggcaggagaatcgcttgaacccaggaggcagaggttgcagtaagccgagatcacgccac

SEQ ID NO: 66361 - DNA, 4223 bp, Homo sapiens
ccagctaatttttctatttttagtagagacggggtttcaccatgttcgccaggctaatctcgaactcctgacctcaagtaatccgcccgccttggcctcccaaagaggagtcttaaatgagtttcactgagggatttcagcagattttcattacagtgtccaccctgaaagtgtaggggccagagttccacgctggttaatctctcttgctgtgtgaacttatacctgtaatttccacctctgcacctcacattgcttgttttgaaactatgagaattgaactctaaggtcccctgaagtttagaagtcctgctggatgaagcccctttcctgttcctgcctacattcttctttccctggacgccttacttacgtaaaaactacatttcccatgagcacccacaggcgtgcacgcagcgcagccctccgtcgtcgctcgcgccctttatactcacttccgcccgcgagccacttcctttcctttcagcggagcgcggcggcaagatggcagtgcaaatatccaagaagaggaaggtgagcctctggggactgggttcggagaacgacggcgccgcgcgggtcgagggcttctcggggtgccaccgcgaggcctgcagctccgtggcctgccctggaagcggcctaggcttcctggcgttcctgcgggccgcggatggcggtggattgagtgagaggccccagccaggagggcgctgtgtggccgggttccaagtgaagcgcagagagatgggcaccaggcgccccttctgtcccggagaaggcgtttgtgagcatttgtcggtcaacggaattagtaaacgtggtattttgagggcgtgtgtcatttccctcatgtcttatcccgtggttttgggaagagaaggcagcagtgtattcttgccttaactggtcgtttctgggtacagtccgctggccccaggacctcaacttgaagggttgctgacggttgcttgctccgtctggggaccccgggaggaagctgcctcggatttaacgccttgtcattacatgggatagaactgtgtaaaaatcattagctttaaaaatagacagtttgtcatttcgtatatacacttcgatgtcaaaattaaatccacaacttctcgagagttaggatttgccagctctgttggtaccgtaaagccaaataacatggctgggattctttagacggtgcaggttgtgtctacaagtgagagagcttatatgttaagtctactatctattccttaacagtgacaagtacagtgtctttgctgtgctgaatgaagtgtaaataggccattagagcagtttcttgttttgcatgtggaactgttttaaacccttcgatgaagagatgatgacgagtctgacttggggatgttctctttgcccaggtggcctactctgtgctgcgttctgtggcacagtttaaagagccctggttgaagtaatttcctaaagatgacttagaggcatttgtctgagaagggttgctgcactcctgttggaacaagggtttggaaccattggttggaggtatttagttttggtgagggatgcattgactaataagactagactggctcaggcgaaagtgagcctacaccgatctcctaattttgaactttgctttgtttggattagtttgtcgctgatggcatcttcaaagctgaactgaatgagtttcttactcgggagctggctgaagatggctactctggagttgaggtgcgagttacaccaaccaggacagaaatcattatcttagccaccaggtaaaactcatttgactggccatcacctataattgttataaatgctaagttggtttatttatttatttatttttttgagacggagtcttgctctgtccccaaagctggagtgcagtggcgcgatctcggctcactgcaagctccgcctcccgggttcacgccattctcctgcgtcagcctcccgagtagctgggactataggcgcccgccaccataccttgctaattttttgtgtttttagtagagttggggtttcaccgtgttagccaggacggtctggatctcctgacctcgtgatccgcctgcctcagcctcccaaagtgctgggattacaggcgtgagccaccgcgcccggcaggtttatcctttatgaacttaaggggacagacggaacagtgaatctgggcttagtgaatgtaattgcttcttaaaagctagattttaaggccaggcgtaggatcacttaagctcaggaattcaagatcagccggggcaacatggggaaacccccgctctacaaaaaataaaaaagggtgtggtggtgcatgcatgtggtcccacctattccagaggctgaagcaggcgatggcttgagctcaagaggttcaggctgcagtgagccattggtgtgatccagcctgggtgacagagtgagaccctgtctcaaaaaaaaaagctgcgttttaaaaattttagtttttgtcaatgaaaattatatgctttgtggcagagattttgctaccacacatatatgcaagatttaaagttacatctagcatttgtgagaatcttgaattgtcacttttcccccccagaacacagaatgttcttggtgagaagggccggcggattcgggaactgactgctgtagttcagaagaggtttggctttccagagggcagtgtagaggtgagtgattctggcatatgccagaggtaatggctcttcagaatgatacttctaaaaactctcaacttggagactttaattgtttgttcattacaaatggactggtataactgttgaaattctcttaatgaataatgggcttaactttgtaagcctattctgctaatggctgatggttaaaggattttacattcaacttgggtatagaaatgatgcatatgatggattaactgtccccattggtgtacttggcatggccaaaggagccagggtgggagggcaaggaacctgcattgtgtgtaggtggtagaagtgctttaggaattgagggatactgaaattatatgctgtatatgatggtggtgtccgatcttttggcctccgtaggctacgttggaagaagaaatgtcttgggccacactactactggtagcgcaaaaaatcacgatgttgaatttgtgttgggccacaatcaaagccatctcctgggcagcatgcggcccgtgggttgggcaagcttggtgtagaaagtgatacttgtgtggcaaatgccaaattttcaactttcagttgaaaataatggtgatggtaacaggatatcccttgcttcctttaaagctttatgctgaaaaggtggccactagaggtctgtgtgccattgcccaggcagagtctctgcgttacaaactcctaggagggcttgctgtgcggaggtaagtgtcctgagacctaatggtcatgaccttttgtgtgtatcaacatacatgtctgccatttgttaatttagcagatgaactgttacaaagttacaggatctgctagtctcccagggttataataagatactaagtcatgccctcactgaactggcaggctaacaagactactaaagcagcaagaactgtaaagggtggtcagtcctgtaatggagaagtgttctgggtgctttgggagttaaacacaaatagaactgtccaaggaggggaccaactcctgttggtcttcttgagaaggctttacaaagagccctgttgcggggggcggggcagtgggcaatgaggaataattaggcctgttactgggtgtgttacgtatccctaggtagaagtgccttagtactagttaggataccatgaaactttagtagcaatcattcaaatctgcttagtgtgttcactcttaagatggtattgtgaagagataagatagacctgatgcaaaatagcttaaaatctagacacttaacctctgagttgcatgcagatagtagtaatgtgagggtctactggtaagatttcaacaggaagttctttgtgcagtttgactgtatgtaaaggcactgaaatgccttgcctagaggaatgacaggaaagctgtgctgtaggaaggttgactggtagggatgggtagtgtaggcaaggctctaggtaaggacatagaaaagacggcttacctggtttgagtgccagctaggctgcttagaacaatggttctcaagattaatgccagccccagacccaccaaatgggaaac

SEQ ID NO: 66362 - DNA, 1981 bp, Homo sapiens
aggatcctaggtgggtaagctttcctagtgaatgagacttcggaggttgcagagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaagtctttgttttgttttttaaacttggtggaggtccttggcaataacacagtggctctcttctgttcttttaaagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgagcagctgagagtgcttggcaaagggcatttgtggacagatttggttttccacagacatcttaagtatttgggggagtttatcatggaagtagctgggcatgttcatattccttggtgtatcgattgccacgttgatctgtaagaatcgatttgctgagatctgtcagatccaagagttggtttgtccttgttttagccatctgtgtacccttcagtgatgacacgatgacgagtcagaaaggtcacgtcctgctcttggtccttgtcagtgccatgttctgtggtgctgtgcacgagttcctttggcagaagtgtcctatttattgatcgatttagaggcatttgtctgagaagggtccagacccaggggtgcttgagtaaactgcttgctctctttggtcttgtgtgatgggggcctttgagaccccagctgtgtgctaacaactgtggtgtcctctaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgtgggagaatacaagttgaaacctggggtctatttaacccttggttccaatgggacaggtgttgcctttattctttccagaaagaagttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcagcccctgtaaaacactaacaagcctcctgtggtcaacacttggggtttttttgtttataggtgttgtctctccaggtgccttgtattttttttttttatatgaaaaaggacaaacccttatgtatgcattttattaatgttgctgcaaa

SEQ ID NO: 66363 - DNA, 1085 bp, Homo sapiens
cctcatcgtgggcatcttcgtgctccagaagtgagtaggatctgaccacttccgtggctgtccctaccctgcagcaggcccagcccccaccccagccaggtgaaccctctcctgagccctgggcctcagccaggagcaggcctgaccagggaagaaggacggactccggtggccccatcctccctcagacagaggctgggtgacttctggaatgaacatgcagctgggatcccagagccaagctctgccttgggtggctatgtgggcttaggtgaatttcagctcctcaccgggctggcctgctcatctgttagccagggcatgggttcccaccagccctcagcaagatagctggggtgtgctcgcagtggggaggtgtggttggtcccagggagggtctagggccagcctggggcccccacccagccaggaaccaaggggctgggattttattcttgactgatgttctctctctgtcccatcctgctctgatcggcgcatgtccctcctctctccccctccccctctctctgctgcactctggcatctcacagctatcacttgatcaggtaattctggtgtggtcttcctcctccttctgttcctctttctccctcttgccatcccttctccagttctgtctaaaaacccaccgtgcaccaagccctgtgcccgggccacctcgcagacagcgcgctcgcctgaagcctcccttacccccgcaatcctcttttctgctcctcccgtcccactgccgtgtgtgtccctctgctccctgttcccacggccgtttctgcaggtggggaccagcgtttccttgacagcttcctgacctggcccctctctgcaccaaagtgtctccctgggggaggggaccctgcctgggtacccccatccccctgcctctggcacttacaggggccttcaccacttgcccagggcagaccctaccaagtttctgcctctctcttcccatcttctccctccctggctctgcctctcccactgttcactcttcctgtttacctttctctgcctctcccatctctttctctctcttctttacattctatctctaacaccca

SEQ ID NO: 66364 - DNA, 1053 bp, Homo sapiens
aagtggagatatgggtgcagacaactctcagaagtttggatgagaagggaggagagaaagggaggagagctgggaaggggtgcaggggatgaactgcatgagccccaggcctgctcactgctgattggaaggagccagaagaggagagaggagaggccagagggaggagggagggtgaagtggtcatctgtagacacccgcctagtcctctgccaggggcagggagggtgcctggagggggtggtgctttctggaggaatggctgtggagggctgagggtgaaggaggtgcagtgctgggcaggcagccttcagtcttgccctgacctctgccagtcttcatatctgcagggtatggtggtagcagccaccctggggtgtggggaggatcccaggaggcagaagctccactagctcagagcatcctcgtaaaccaggttcaggtcaggagttgaagctcagggctgggcggggttggcctctggtggtttttgcatcttcagtgctcaccaaagctgtttcgtagacactgcaaacaagaaaggcctaggaaggtcaggacgtggatggcctgcttccaaagaggccacacccaaccccatctctgggcccagctctcaattacagggaagttcttcctttgggtctagcctaagtctttcccgctgtgtgttcccttctggtgaacttgttcaaccctgctccatggagccaagcctatcagctggccacttggagtggcggtcagtatttttacaacttgttttcatgaagatgatttgaagtctccttgcattcccagaatgtcagacccgccctgattcacaaggattgaccaaaacagggtctgagccaaccagaggaatttgaagacttagtcatcccccttggatcatctgcacattcttctcctttccttccagttaaaaaaaaaaaaaaaaaaaaaaaggaaaagaagaagaaagaaggaaagttagcctagatgaccagatgtccaggaagggacagtggcatttgggggtataaaccagctcagatgatgatggctgtggac

SEQ ID NO: 66365 - DNA, 1210 bp, Homo sapiens
aaaaaaaattaagggtggtcatggggcactccctgcccagggcacagctgtcccccaggtaccagggagggtagaaagcccacctcagagcatgtttccaaaatatctgacaagtgctagagccgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgg

SEQ ID NO: 66366 - DNA, 1612 bp, Homo sapiens
gagtgatgtggacatagttgtccttagatcagtctttctcaaacttgagtatgctaagaaagcacttggggagtttgtgaaaaggaatccatgcccactcccagagattctgattcagggggtctgggctggggtcaggacatgagcatttgagataagctcctgggtggtgcccatgctgtctgtccctgaactgcagctgggcagtgccgggatacgttctcacttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcgctactgatggctcatatcaggccctggaatgctggcagatcgctggcagatca

SEQ ID NO: 66367 - DNA, 1009 bp, Homo sapiens
ccccttgccccttcttgcagccagcacttaacaagggggtcagggagtcagggaggcaaaagaactttgaaggccctgagaacaagaaaagagcaccctggcctgtgggggcatctggtgggcagctgagatggggctcccaggatgggcccaacgatcctagaagaaaaagtagggacctggatggaatgtggggtggacgggctgctgggatgcctactggatgactccgagtccagctacagtactgccattgtcaccagcgtgccaccccctgtgccacgtgcaggttataatcaattggcaagcacattgaatgactgattcctgagccttcacctcacccccctccctcacccccgcccacattctgtactaagaacacagaaatcatattctcctggctctccagcaagagctgcccggcccaggctccactaggccaagacttattaggcaatctgtactctgccctgtccctgcctgagctctactctcacagtgatcacctctctctcctttgcaggagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctc

SEQ ID NO: 66368 - DNA, 1092 bp, Homo sapiens
gccccacactcccacactttccctggaaggcaggagattcaaggacagggtccataggctccccactctctgaattatgccctatgccaggagcattgccacagctgttggctgctttgatggtgcaacaggagacaatctgggaagaaaaaaaccacgtggatggactataggactggaattgtgtgcaagggcaggaatcagtgggagggagtgaagtcctttcaccatccagtggaggacagggctcagtaatcctgctgctagactctggaaagtatggatccaatgtcagtgtgtgtgcactcaggaggcattaccttgtctccatggaaacaggaagaaggatagaaaatgaagtgtctaagacaagatgtctcatataaccttggaacattaagttttgcaaataggacagagcctggcacagaacagtctgttgtttattcattcactcaagtattaagtcagaacccacctgggctcaggtactgttcatttaaggtacagaggatacaatgatgtgcaaaactgacatggtccctgccctctggacacttcagtctagtgggagaaacattaatccaaaagaatacaaggaattagctgagataagagaggaaagcaagtgccagggactaggagagcctgtagcagggggctggccatgactgtggggtcagggaagccttcccagggcagtgcttcagtgagctgagagatgacagctgagtaaacactagccaggtgaagagggaacaagagaatattccaggagcagacagctgcatgtgcaaaagctgtaaaatgggaaggagcagggcgtgccgaaggaacagaatgctgggcacagaaagccaggaaaggcaggaaggagaggggtgaaggggtaaggaagtgggtagattggccagctaggtggggctgtgtaacacattttcttctttgttcttggtacaaggagaaggtattgaaaggttgtgagcaaagaagggacaagatagggtttgctctcttaaaagatcattctgatttctgtatgaagaatgggttggaggagagcaagaatacatggaacaggggacagcagtc

SEQ ID NO: 66369 - DNA, 1014 bp, Homo sapiens
gaatgctaggaagtaaacctggtgggtagggggagctgtgcagtgggagtagccagccaggttgttgggggcctgggcccagaggggcaactctctaaggagatgcagttgggagctctgagctggaacctgcagaagtcattggctccagccagagccagtcagagtcatctcaagccgagcccagtccaggcatctacagacaaatttggaatctctatatctgtatattccacaaggagggatactatagagaggaaagagctcctccattaaggtcctgactttgcccgaactcactgtgtgactttgggcaacttacttcagctttctgcaccgcgttttcgcttctggaaggtgaggagagggctttctgtctgcctggctgacaccattgttgtgagaatcaaatgccttgtatgtaaagttatctcagaaaccttaaagagatgttatcatttggagggccaaaaaaggtgctaagttaaaaataggaaaacattttcatgtcatgtaaatgcggttgttagaatttgatcttgtatgagctattttaaaactcctcattgagaaagtaggcctcctaccatgtgccagccctatgctagtgatccctatggcctggcacatagtaggcatttagtaaatgtttgtggaagtacggaaggaggcaagaggcagggaagagagagaggagaggaggggagggagagagggaaagagagatgaagcaggcatggtccctggcctgaaagtgcccagtctagagaggcagatacaaaactattgaagctgatctgatagggctgctgccaaggtgggggtgggggtgggggcactgtgggaacacagaaaaaggaagtagaggctcagaggttttttcactgaggaagattcttcagttacggagtagaggttgctaagtggatggcgaggggtggtgtttgggcagccagcactgataaagctagagctgcttgggctgatcattggaggtatagactccagggcaga

SEQ ID NO: 66370 - DNA, 1048 bp, Homo sapiens
caccgagcaccaccttgccacactgggaggctgggctctgactctctgcctccttcctgtcgactggcaggactgtcatttctggctttttctcctcccaagggatggcagagatgccttcacttgctcagttaatctatggtcactgtggatgttccacccatagggggctggctcactgtgggttgtgggggtgacagtcgtgtgtgtgccttatgtgggggtgctgaaacagccaccagacaggccaccaagcaacaacagatcaggtagttgggaactcagatgaaggacaggcttcttccaactagggctggggagttgcggaaggctctgtggcagagggagccctggaaagcagctggggtgtggatatgtaagggcaaggccactgcagggagcaagtctagaaatggaaaactggggggctgggtgggaacctgaaagctaggaccaagtttgcccactttgttatccttctggtaaagtggaagacaaaagattttatactcttcatttttccaacatatgttgattgaatacctattatgtgccaggcactgtgctgggcactagggaaaccaggatgactgagaccccgcctctgatcacagtggggcacgaaggaggaggccattctagctggttccatggatcagggaggacttcagcaatgggtaggtgttgaccaggtgaacagagccgggggtggccaaggcatgctagatagaggggtctgcccaagcaaaggtcggaggggggccatcaaacaccaggtgaacttcagttctgggggggtagctcccttgggagggtcatggcacaggctggagagtgacagagctcggtggtggagaggcctggtgcacgtgagtgggcggttgctaactgggatctccatttccatatgcccaaagcgtacctacaccctgcatgctcccttgtcatgcttctcttgcttgcttatgcgtcaggcaacactacagatcctctcttgctctaagctaggagccctagggtggacttttattgctggacctgattgctg

SEQ ID NO: 66371 - DNA, 1047 bp, Homo sapiens
gttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgct

SEQ ID NO: 66372 - DNA, 1114 bp, Homo sapiens
cattgactaaagcaaaatcctatgcctgtgggtgagttgagcaacgtgatgaggtgttaacttcctacagggaggggctcaaatattgcccaacagtggtatggcccactgcctggggtggtcggtggaaggctggcaggacaagggagaccacgtggccagtgggtgctgccaaagtgacggaacagggagttcagacgggagatgccgaatgccctaatgtccttgggaacaccttatgcactgtgctccacctgagccaacctctgtcattaccgtcattccttaattaaccatatcttttctctctaaattccttcccacgccccacctttttgtgtttctgtatttgcggtctgtctctccgtacaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaactttttttttttaaaccaacaaaccaaaaaaggccacaaaattaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaag

SEQ ID NO: 66373 - DNA, 1010 bp, Homo sapiens
atgagataaaaattcagaagggcacttaaaagtacaatacattcttgtaattcctgctttcctctgatgtctggctttatttgggacttggtttcaagtcctgcttaccatgtattaactatatgatttagagcaagttacttaatcactcttttctgattttgtttccttagtggtaaaacagaatcactaatatctaccttacaagttgttgaaagacttaacattccattaagtctgttactatcttacctatcttatttactattgtacctccagcacctagcttagtgcatggtgtttaatagatgcttaatagatatgaattaattgaacaaatgaatgaaagatgtgtacatacagtgctcagcacagtgcctcgcccgtagtaagcactcaataaatggcaactatcctcatcatcattgtccctggtgggttgagtactacttggctaatatacagaggtcctttgcccttctcattgcacacattctgaatttctgggtaaagaaccattaaatgctcaggtcaaagattttctatgtgtatttttttagtccagcaagcatctctgagtcaccatgttctaatctacctgtgcaaatatgaattatttggagaggcctggcttttgccactttgcatacacaaaaattatttattttattgcatgagtaaaataagaatcataaaattagaactgtaataaaagcaattagaaaagaatgatttttagcaagtttaaatttgctctgaaaatgaattcagaaatgtttctgtgctttgatgttatctaatttttgccaaagtctggatttgggtggcatctaagtgccacaggtcagagaatgggttaattgtgtacaaactcgaggtcgaattttccttcttggattgtgatgacttgctagccaagtatctgtgccactctgacagcattatgcctgcatctcctcaaaaagcccaggggccccaaggactcctcccgaggatttggtatatttcac

SEQ ID NO: 66374 - DNA, 1047 bp, Homo sapiens
atcgagaccatcctggctaacacggtgaaacccccgtctctactaaaaatataaaaaattagctgggcgtggtggtgggcgcctgtagtcccagctactcaggaggctgaggcaggagaatggtgtgaacctgggaggtgaagcttgcagtgaaccaagatcgtgccactgcactccagcctggcgacagagcgagactccgtctcaaaaaaaaaaaaaaaaaaatagtgtctccacacattgccaaaagcttcctagtggatgagaaaattgatcccagatacaagtatatttactgaatgattccatttatacgaagttcaaaaacaggcaaagtaattgatggtgacagttgttggaataatggtaatctctgggatttaggtgggtaattggctgagaaggagcacaggagaaacttctgaggtgttggaaatgttctatatcttgatctgagtggtggtgacatgggtttatacacacaaacaattgagacttatggacgttattctctgtgtgttatacctcaacaaaaaataagaaacaaaatacaaaagaactaaatggagatagagcttgaagctcaggagaaagggtagaacagaaaagaagatcaggacaacatcagcctgttggtgagaatcaaacccataggtattagggtgggtagggaagagagagggtgagaagaaaagaatgctgaggtcaacgcccagcaagcatcgatatctctggtatgtgagggaggagtcagcaaaggatgagctcttggtgtctgtgcttgcctctcctgtccaaaagagagcaggagcataggcctcactgtggtctcaacctccaacctctggtgctgctggccttgtacattacacacaggaactacccgtgctgtgtattacataatacacatcgttattatctttgctatccttcccttatcttagcatagtccactgtcagtgggtatttgttttcaaactgaatgaagaggcttttgcaggattaggcctggtgtaacctcttttagtgggaaaattgtgcccaaac

SEQ ID NO: 66375 - DNA, 1599 bp, Homo sapiens
tgatgcataggtgccttgcctagaaaatctgatttcattggtctggggtgtagcctgggcaaccaagtttttaaaaactacttcaagtgattctaatgtgcaactcacgttatgatctacttttataaggcatcattctcaaaatttagtacacaaaagaatcacctggagagctttctgaaatgcagattcctgggccacatcctcatacattctaattcaatgggcttaaaatggagcctaagtatctaatttttagcaagcactctagataattttaatgcagatgaatgcaagctttacttgggaaaaaattacttggtgaggtttgccatctttaagctattgagttttcccacatgcaaacatggcaaaggttgccatttatttaagtcttttatgttcttcacttatattttgtaattttctccacaaaatcacatacacatatatactcatatatatacacatatatacagttttaaagttttatttctgtatttaaattgttaataatctaactagattttatctttatgaatggagtgaggtaagtattgaatttttccgtatatggaaagtcatttatccttacactgttttctaaagctttgcttttccccactaacttatgatatctcctctatcacataagggtcacatatctttagatattatatctgggttctctgttctattccatcagtctgagctaatactatattatcttattttattttattctgagctagcttttaattattgttcctatcatgaagagttcattaccttttctaatttattattgcccatatgcattaagttttgtatgttaatcttgtattcaggaaacttatcacactctctaattagttttgtttgtagactttcctggattgtctgtggagataatgtatgtttttagcaaataacaatttattatcttcctttccaagatttatatatcttgtttttttgtgtgtgttgctctgttggttaggacatctggtatggtttcaaatagtaggtgataacaaacatccttgccttgggatgtgggaaagtttctaaagttttatcattaagtatgaggtttgctttatgtttttataagataaggttaagaaatttctatttatcttagtttgctaggggtttctaaaaattagtttggctgttgaatcttattgaatgctttttctcttattgaaggctcagcatcagctgagatgatctgtgatttttcttttttaatctgttaatagattttttttctcatattgaaccatctttgcatttctgggataaatcttgtttagataaaaatatattttattatgctgaatttggtttgctattttttatctgaaatgcttgcgtatatattcataagtaagattggcctataatttttccttttttatattagtcttatgtactgttggaatcaaggttatacctataaaattaaatgggtagattcccctcctttttagttatttgaaaaagtttatataagaagggctcctcctcaaatatctgataaaattctcctgtaaaacttgctggacctgttgtctttttcatggatttttttta

SEQ ID NO: 66376 - DNA, 1087 bp, Homo sapiens
gattacaggcgtgagccaccgcgcctggctggaacactgtttttcttaaaatggggctgtttcagcatggcggtgcctccatgtggccttttggtgtcttcatgttatatcctgtccaggtggtgttggtataaataattctaggcaccatcatacctgagtttctcagtagccctaggaggtagcagggacaggtccaaatactctattgccactttacaaatgaagagcctgtaggagagggaagcaatttgtcccaagccagcatcaagtctgtggcacagccagcaccataatatctccaggtgctgtcacataccatatctgaatcttcgtaagaacccagggtggtcagacatatggatgaagacctggaggctcagaggggaggtttcccaaggtcacaccagtgagtggcagagtcagggctggtacacaggccccgccctggctcagcaggttgccgtccctgcagctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcaggtgagtctttctacccctgagcagctcaggaaggtaacaaattttcggaagggttgccaatagttctgtacttcttccaagagcgtgtgcagtaggagaaggaggctaggcccaaagaagcacttcctacagcaccatgctgggcgctgagtccatcagggggttgggaagagggagaagactcagggagctcctagctggaatggggtgcagtgggggaaaaaccccaggcctcagtaggcattgctggtgatctctttatgggctacatgtactttcatagcccctgctccctcaccccatacctgacccacttttctctttccctagggttggtcacatcagaaaaggagagtgctgctcacattctgaacaggaagggtggcggaaacttgctgggcatcatt

SEQ ID NO: 66377 - DNA, 1062 bp, Homo sapiens
gaattacagttatagctgctaatcttggtgggtttcaaatacaaattctgcctgaagttagcatgttaaagtttaatgctttttaatgacttgcaccttcttaaggaattatatagagcttactatttgaaagtgcactcttgtttgcagaagaggaagttgatacatgcacaggagagggaagctgctttttcgtggtatgaacagtagctttagggcagtgaatgaagtgggtggaaaagaagcagcgtatgccaaagaaattgtgaagaaagaattgatggatctagatggccaataagaaatgggggtgagaacatgggaagtttgaaatgcaaagatgtctcaaaggttttgaaacagggtgtctgggaagcgaatacatggtgtacccagcccaggagatcaagcctgtgtccaaatcttgattttgctacttattaacaatgtgaacatgggtaaatccctttacttagggcctcagttttattatctgaaaaataaggaagatggcctagatcagtgcttcttaaacttaaaatgtctatatgaattacctagggaatcttgttgaagtacaattctgattgactaggtctatggtgggacctgagattctcagcattttcactacaagtgatgcagagtagcaaaggcttagatgaccttcaaggtcctttctggttctgcagtattatacttctatttgttgaaggtgggtttttttgtttttttttttaagacagagtctcactgtctccaggctggagtgcagtggcatgatctaggctcactgcaacctccgcctcccgggttcaagcgattctcctgcctcagcctcccaagtagctgggactacaggcgcacaccaccacgcccagttaattttttgtatatattttttttaagtagagacagggtttcaccatgttggccaggatggtctccatctcctgaccttgtgatctgcccaccaccgcctcccaaagtgctgggattacaggcgtgagccaccatgcccggcctatttgttgaatgtttatccttcagagatctgttata

SEQ ID NO: 66378 - DNA, 1026 bp, Homo sapiens
tcggcctgtgttatcagattttttggtctgtgccaattttagtgtagttttaacttgcatttctcttatgagtgagattgagaatcttttcatgtttaagagctatttgtgtttatttttctgtgaattatctgttaatgttctttgccatttttttctgttgggttgttggacttttgatttctaggaattctttatgttttagtgaaattgtcttttttatattaattaaaattttttcttaggttttttcctttgactctgcataaggtagtttttgccatgcctaattttaaagtgttttatgtagtaatttttttcttttatagcttctgaatatcatttttagacctttgtgtttataaaataattgttcatggtttctttgggtactttctgctttatgtacattaaatatttttaagccttctggaatttaatgtaaggcataggatgtgtgtgtgtgtgtatttttgatggctaccctattgccctaacacctttattgattagttctcttttccctagaggttatctttgacttgtttgtctcttttttcaattttctcttcatccctaaccacatccattatctaattagttatcccagtaagctcagtttttctttaggctcctatatgttcttatattttctttctgttcctattgataatactttaaaccatttttattgtggaaatttcaatgtctattgaaatgtatattttatatatgaatatattcatcagtatatcaatgtatattgaaatgcaagtagtgtatgtgtgtgtgtttttgtgtgtgtgtgtatatatatatatacacacccccacacatatatatatagagagagagagagagagaaagagattgagagaggaatataatgaactcccaggtacctgttaccccacttcaataactattaactcatgttggatcttgtttgatctatatgcctacctccttgtcctcctttcctccctccaattattttgaagcaaatcacaggcatgctattactca

SEQ ID NO: 66379 - DNA, 1049 bp, Homo sapiens
cagattgttatatttttattttttttgtaacacaagtgattctcagtgcctcctgcttttgtggcttctcggaaacctaaattgttatgctgtctgaaaatatctcatgagcagttgggatgtatactaaagaaagatggcagttggatagttctttcagataactgagccttacattgatacgtttatcattcctttatgaatgttagctattaatggtctagcagctagcatttcaagtagattgaatccagtatcctgtagtaattttacttttataaaaatgtaataaatttcttttctttaatattatggtaaaatagggacctagtttatatcttctcgtatctgtaattccctgtatatatgggatctttttcagaagaatggcatggttttctctaattcagttttatatattgtactgtggattcttctgtaagtgaaaaattctaagagtagaccaaatatttgattaaaaatggcaaccaccttcagaatgcatattagatgagaggcactgagacataatccgttggcttaggtgggatggtgtaagagaggaagcatggtaaaatgataggaatgttggattatgatggaaaatacttccgtactagttctagcccagctactcactagcttcgtgacttttgataaagatcacggtttttggaacttcactctccccatttgtaaagtagagataatgatgtcttatgaagtaggcaagacagatttttatgaggatcataaaaatctcagtaagatgtgattaaagatctatttatgctaacaaaaggtgacatcattttaacaaaaggtactgagacttatttgaatcttgtcctgtggcaaagatgaaaaattcaagtgatatttatttatttatttattttcgagataggatctcaccctgtcagccaggctagagtacagtggcacaatcatggctcactgcagctttgacctcacagactcaaatgatcctcctgcctccatctcccaagtagctgggactacaggtgtgagacgccactccaggctaa

SEQ ID NO: 66380 - DNA, 1070 bp, Homo sapiens
ggtggcattacaggcatgcgccaccacacccagctaatttttgtattttttgtagagatggggtttcaccatgttggccaggctggtcttgagctactgacctcaagtgacctgcccatcttagtctcccaaaatgctgggattatagatgtgagccactgtgcttggcctgaattgtcctttttagatggaaaggggactgggaaatgcagtcttactatgtgtccagaaagaaaatgaaacaatttggctactatttggtttaagggtttaagcatttttgtaggccttaaaacatttagtctactgctcactaattggttatatcactagcaatgtatgacagtgccagagtattttaaatttttgatgagtgtctatataatcagtcctggttaccttaacaaaacttctgtgttcttgccccagtgttacctctgataatagtaattaacaccagtacttagcgcattttgggaatttggaaaatgatagcaattattattagaattataataatcataatagtattttctaaaaagaatagtcatggggctggttgaagatcatgttaaaaaacttgtctagagatatgatgaaagcaaagtgccttttttgtttttgttttttctctcttccagctcagattatatcttgaatttaggagttgtcattgactgttttttgaagttatctcaatgagatatctcaatccaatcctcaacacagttagggaatagctggtgacagagcacggggaagtccggggtctggtgttgctgttgaatctggcactagctgtcaagcctcttgagggcatttactccctcttgcgggcttcagttaatttatcattaaaatgaagggattggtgatttctgagcattcctcccattccaaaatgtcatggttgagtgaagcctattcatgaactttgttgggctttacaaacttttaactaccataggaggagctgggaagccctttctttagtaattctagttagtgctgtcgtatcttgttggtcggacctattatgacaaacgtgaatatttgatgatcattgtttg

SEQ ID NO: 66381 - DNA, 1116 bp, Homo sapiens
cttgatcactgactaacccttttataaattgtgattattctcctctgtcttctgtgctttatttttctctgtggtacttaagatcacttgacatactatatgtttaattatttgattattgtatgtctcttcccactagaatgtaaactctatgaaggcagagattttcaggtcacttttgcttattgctctgtccccaatatgcagaactgcagaaccatgcttgacacatactaggccttcaaatatttttgtctttttaatttaattttttaataggtaaaaaaaaatatatatgtgtatatatatataaagatacaaaggttcatattaaggcctccctttcaccagccttctgtcaccctagttttctaccccaccctgataaccactgttactcatttcttgtttgtctttcctgagattctttatgcaaatacaagtacaaatacaaatattcttattcctttctctcctcttttttacacaaagtgtaccatactatttatgtttctgtaccttgcatttttcacttactgtcttagggttttctccatattggttcatagacagcatccctgtattttgtttttttctgcatagttttgcattgaatagatacaccataatttatttactggctcctattggtggacacttaggttgttccagtcttttgctatacacacagtattgcattgaataactttataatacattgttttgtatgagtgacagtatattgatagggtaaatttcataaagtggaattactaggacaaagagaatgtgtacttgaagttttggtagatattgcgaaattgccctccgtgggagttgttttatgtgtgagtgcttttctccccacagcttcaaccaccaagcctatgcaaacttttgaatttttgccaccctgttaggtgaaaaataattttgcagtatagcttaagtttgtatttctcctattatgagtccacattcatagtaggagatagttttgctttgaatagatacaccatatctatgagtattaggatgaggcacttaagcatttgttgaatgaatggaatgctgcagaacagccaaaatatgccacttgaaacatactctgcaatc

SEQ ID NO: 66382 - DNA, 1102 bp, Homo sapiens
gtagaatatgcctctgaataccctattgttcaggaatagccattccataacaacctcaagaaatgtttgtgaaagatatgtgagtgatggtgcctgtgattgcatgtgatagttttgcaaggcctttgactaaagcaggaaatgctgaattgatcacctggtcttttgaatagtgattggttttctgctagtatgtttagatgtagtcagccggtttctcagtattgaagtagatcctgttgtaactgtcattctctggttgtattaaaacatgatcggaataaaaataacaaatactgtattttcctcctctcttagattcatgcccgaaaccaaaatgaaataatttttgggctgaatgatggatactatggtgctccatttgaacataaggtaagaagatccttctaatgttatgaattttgtttagtgcaggtgtgccttgcaggtgtacagggtagatataatcctgaaaactctgtgtaaatagaatcatgctttaaatttgttgcttagtgtggcttaaggtggatgctttttaatgggaaaactcattctgtaaggcacataaccatccagtccatcttttctaaatccagattatattaatttttctacaggaaatctggagctagctgttttctcttattctacataactctttgggggttaagaaaggatggtgaattttgattaaatgcaatacagttttatgaaatgtttcagatatcttttataactttcaatacatttaagaaactatgaatcggttgttttatagtcagcattatctctacatctaaaagttattagagaaaggaaagggaagcgaattcacatttaccaagtacctactatctatggtactgtgccaggtgattcttgtccttttcctcacttaatactagccaaaaccaatgtggtttgttttgtcctctccattttatagttaaggaaaaaagttgtttgagatgagcttcgtaggttcacccatctagaaagtagctgagctgaaatttcaggttgcctgcctctaaagcctgtgctttttctattctactatggtgttctacccaacaaccctgtgcattatttgctctta

SEQ ID NO: 66383 - DNA, 1019 bp, Homo sapiens
ctacaggggttttctaggtgggtttaaccgctatgatggtgattaggggaggatgataaataaaaagctgttgagtcagtaagctggaaatctttcagatccctattcaggattttgcctttaatgtatacaggtaagattatctttgcctttatttcattttggtgaccactcgtcttttgtgggactgctgacagctgctttttatgaatgcacagtcctagtcgttaggaatatggatattggagtcagattgatataagtttaattataggcactcctgacaactattactccagtaaatggaaacttctactcactaggctctaaatcctatgataagaggaattacatctctaatgcttaccattgtattaacactatatctctagcacagtgcctggtatgtagtaggctctcagtaaaactttgttagtgaatgaaggtgaatgcttgctgtgtttagggctatcacagcaatcattgagaataaaaatcttgagtagatgatatttgttccaccctgggttacctccagcctcaacttttggtatttatttttatgtaactcatattggcataattactccaacttttgtgctattgataaggtgcaaaagcattagaccagttgttataaggctggagtgaaattacttatagacaaatctctaaagattaaagagctgtgaaggtaagtatatagatacatagagatacaagtaagaatttcatttttctgactagaagctacagcggtaatatctttagagtccagtagatggcaatactttctcactttaatggaaaaaattagagcaggcatagaatccaagtcaaaaggagcaaatctttgtggatgaaagaaacccaagatattgaaatagcaatttggtgatgaatttcacaaaaataaccatataacttgatcgtctcgagtacataggctgagattgaagatttaggtataaaaagtttcaggatctgttttgaaagcctgaacaaatgaaaactcctta

SEQ ID NO: 66384 - DNA, 1027 bp, Homo sapiens
ccaaactgagctcagttcccttcccctctcacaacacttcctcctgctgtgtttcttagtgaagtgaatggtaccacaatccatctactttctcaagtcagaacatagagttgtcctgagtcccttcttctgtgtttccatcactactgatggtggctgctacttttttcctggttcttgacattatagtcagatttatttttctaaaatgatcatattcttcctttattcaaatcttgtcagcagtgtttgccctcaataattaatgacttatgaggtcttgctattccttatttctaaacactccatccttaacactttctcaggctaagatttgttcacgtcagttttagctaaggcctcatttctataggaaggtttttctgtgatatacctcttaagtccagtgtggatagatcccttttatatgcttccgtagcaccttgtattacatttccctcttcactgacccttatcctattatattctgattgcccgtttgcttacctctcttacctgctacactgtaaactgtgtgagggcaaggacagtgtctgttttcacctgttgatccctagtgcttagcactgtgtctggcatgtaataataatccagtacattcttgtcaaatgagtgaatgaagcttctgtagcagcagatcattagaaattctattggaatacaccacttggttgtcatcagtagtatagctcagcagtccccaacctttttggcaccagggatcggttttgtggaagacaagtttttccagggacgggagtggggacggtttcaggatgaaactgttccacctcagatgatcaggcattagttagattttcataaggaacgcacaacctagatcccttgcatgtatagtttacagtagggttcgagctcccatgaaaatctaatgcccacgctgatctgacaggagggggagctcaggtggtgatgcttgccctgggggttgggaacccctgatatagcttgttactcaaaattgtaattctctgtcttagtggtt

SEQ ID NO: 66385 - DNA, 1017 bp, Homo sapiens
tggaaccttcactgggttgtgttctctatgaggacagtagtaataattgcctaacaccatctatgtactcggtgttcagtaaacactgaaaggaataagtatatgtataatgctatttgcttcctaatcagttatcctactaactgcgttatttctgtatacattttgtagttttaatgaagttaaggacagtcttgtgttgttgcagctaaaaactctcaaaatatatagtaacatgttttaaaacgtgactcatccaatgaactagtacagggataagcaaactgtagtccagcacatatttttgtatagcttgcgactaagaatgattttacatttttaaagaattttaaagaaaaaataagactatgtgacagaaatgacatgtggcctgcaaagcctaaaacatttactatgtggccctttatggaaaaagtttgctgaccactcatctagaaatacacctgacttgcctggaattactcctgctcattggatatgttaaattatctatttccctgagcagtttaataggcactcacccagacttgttactattctgttccttgaagaattgttaggcctgacttcagaagaattttgagtgacatgtaaatctcttctgggctctttggcacttggcagtatctcacacagataaccagatacaaatgagccgtttctttccattataatccttcatcagaagtctgttgggatcgaacatctggtgaagttagatgtcattcagaacaaggctcttagcatatttcaagaatgttaattgctaagtgatggctgaaacaggagggcttaataatgtccttaaattgccttaaatgtacatggactcagaatttttagaattggaaaaggtcctagagatcatcaagtatagcctggttcttaagaacacgggctgtggagccagactgcatggctcttctctttaatcctctttgtgtctcagtttccacacctttaaagtggggatattaatagcacctgtttcacagg

SEQ ID NO: 66386 - DNA, 1045 bp, Homo sapiens
tgtttggcaagccaaaaaagctttgcatgtatctaatgctcagaggcttaaaggcctcagctctatattttcataatgtctgggcttaattttgaaagattttaaaatctggctttaattttaaatgtgatagatcatcaaggatatttttccagggagcaagccaccaaaataaatgcaattccaaataaagttaacagcaacactcaaccaatgttcaccctactcagacagattgttcattgaaatttgattttgacagtattttctaatgtttacgtgacacataatacatttcagaacattagacatcctttatatatgtacttgaggaagaatccagaaggatgctcggagaactggttattttagaaactttacaaaattggcctttcgtttgtgaaacttgaatcttattacacatgatatagagtttggtcacatggactgtgtccattaatcttaagaaacatgattttgactaaagtaaccatatacattttctgagttttggttcttgcttgagagatgcctacaccttgactgcttaggatatgtagcagaacacacaggatttagaaattagagggtggagattgtagtaaacatattttaatgcctgttcagtttgagacacacaaagttttaagttttgaaaagaagaaagttcagaaattatttgaaatatgagtaagccactaatatttcttgatctcagttttccttagtaagtaaaatgaggcgtagggtacaattattttaaagatatgttctaaatgtgagattgtgtgaccttattagagaaaacagtagaattaaaagaaaaaatactaagtcaggaagaagaggatttgggatagtgcagtatcatagatgctgaaagaggatagtttccaggagtagcgaacactgtgataatgtaggagagcaggaactgaagaaagactgttggatcttgtgaagcagtgtggtatcatggaggatgctttgattaatcctaccctgcctttatctttgatttatcctaattcatttaacctctgat

SEQ ID NO: 66387 - DNA, 1034 bp, Homo sapiens
catgcatcagggatgatagatagcccttgtcttgattgtagaagctgaggccaagaggcattaaatgttttatctatctgagggcacacagcaagtaagagccagactggaggatgctttgacggttttctgacaatgtttttgtagatccttttaatagtctcaccttcctaaactggtggttacaaggcacacatggcataatgactgtggacattctttagaaaacacaatgccctacataaatgcaaagtcatcaggctaatttagtagttgctcagttattgaacattgatcttgcaatgatttggctcttggggagttcatatctagagtatttttcagactcttcagatgtgtcagtaatttgaactgccttattaacagtggtctcctcatgcctattgtacaattcatgcctagctaataacacagatatacttttcctaaaccagatcacgtgactatttatcaaccaaatttactgaacccagggagttgttctggaattggaaactttaaattgcacttattaaagttgatgagtcagatgggactttggtgatagttctctcagacattagtaaagagtacccatcatctgctctattaaatgatcctcttttcccatagtgtttgccatgatatatgtgaagtgctttctaggaaacttaattgtgtgcctattgaattaaactctagttcgtggtttcctctctaacattgtccttggctggagtcattttaaaaaatatatcttttcttttcctgatgctttcttggtttataaaattgctgttacttgatctgtaattttgtgtgaaaacacacagtctaaattctttaatgccacttaactctataaaattctgcatgctgtttagagtcatgtttagaaccctggtctcctgattctgttttttttgagacagagtttcgctctgtcacccaggttggagtgcagcggcccgaccttggctcacttctgccttcatctcccaggttcaagtgattctcctgcctcagcctcccga
